(12) United States Patent
Lee et al.

(10) Patent No.: US 8,716,011 B2
(45) Date of Patent: May 6, 2014

(54) **TRANSCRIPTIONAL CONTROL IN *ALICYCLOBACILLUS ACIDOCALDARIUS* AND ASSOCIATED GENES, PROTEINS, AND METHODS**

(75) Inventors: Brady D. Lee, Idaho Falls, ID (US); David N. Thompson, Idaho Falls, ID (US); William A. Apel, Jackson, WY (US); Vicki S. Thompson, Idaho Falls, ID (US); David W. Reed, Idaho Falls, ID (US); Jeffrey A. Lacey, Idaho Falls, ID (US)

(73) Assignee: Battelle Energy Alliance, LLC, Idaho Falls, ID (US)

( * ) Notice: Subject to any disclaimer, the term of this patent is extended or adjusted under 35 U.S.C. 154(b) by 530 days.

(21) Appl. No.: 12/380,008

(22) Filed: Feb. 20, 2009

(65) Prior Publication Data

US 2009/0215168 A1     Aug. 27, 2009

Related U.S. Application Data

(60) Provisional application No. 61/030,820, filed on Feb. 22, 2008.

(51) Int. Cl.
  *C12N 15/63* (2006.01)
  *C12N 15/67* (2006.01)
  *C07H 21/04* (2006.01)

(52) U.S. Cl.
  USPC ........................................ 435/320.1; 530/350

(58) Field of Classification Search
  None
  See application file for complete search history.

(56) References Cited

U.S. PATENT DOCUMENTS

| | | | |
|---|---|---|---|
| 4,237,226 A | 12/1980 | Grethlein | |
| 4,581,333 A | 4/1986 | Kourilsky et al. | |
| 4,624,922 A | 11/1986 | Horikoshi et al. | |
| 5,098,825 A | 3/1992 | Tchen et al. | |
| 5,882,905 A | 3/1999 | Saha et al. | |
| 5,916,795 A | 6/1999 | Fukunaga et al. | |
| 5,948,667 A | 9/1999 | Cheng et al. | |
| 6,083,733 A | 7/2000 | Gronberg et al. | |
| 6,268,197 B1 | 7/2001 | Schulein et al. | |
| 6,426,211 B1 | 7/2002 | De Buyl et al. | |
| 6,506,585 B2 | 1/2003 | Danielsen et al. | |
| 6,777,212 B2 | 8/2004 | Asakura et al. | |
| 6,833,259 B2 | 12/2004 | Bhosle et al. | |
| 7,727,755 B2 | 6/2010 | Thompson et al. | |
| 2003/0134395 A1 | 7/2003 | Shetty | |
| 2003/0233675 A1 | 12/2003 | Cao et al. | |
| 2004/0029129 A1 | 2/2004 | Wang et al. | |
| 2005/0112742 A1 | 5/2005 | Thompson et al. | |
| 2006/0105442 A1 | 5/2006 | Wu et al. | |
| 2006/0211083 A1 | 9/2006 | Katzen et al. | |
| 2007/0082381 A1 | 4/2007 | Wilting et al. | |
| 2007/0134778 A1 | 6/2007 | Benning et al. | |
| 2007/0148728 A1 | 6/2007 | Johnson et al. | |
| 2009/0203107 A1 | 8/2009 | Thompson et al. | |
| 2009/0221049 A1 | 9/2009 | Shaw et al. | |
| 2009/0226978 A1 | 9/2009 | Thompson et al. | |
| 2009/0253205 A1 | 10/2009 | Thompson et al. | |
| 2009/0263859 A1 | 10/2009 | Thompson et al. | |
| 2009/0269827 A1 | 10/2009 | Thompson et al. | |
| 2010/0203583 A1 | 8/2010 | Thompson et al. | |
| 2010/0311110 A1 | 12/2010 | Thompson et al. | |
| 2011/0081683 A1 | 4/2011 | Thompson et al. | |
| 2011/0275135 A1 | 11/2011 | Lee et al. | |

FOREIGN PATENT DOCUMENTS

| | | |
|---|---|---|
| DE | 197 17 893 A1 | 1/1999 |
| WO | 81/00577 | 3/1981 |
| WO | 99/06584 A1 | 2/1999 |
| WO | 03/068926 A2 | 8/2003 |
| WO | 2005/066339 A2 | 7/2005 |
| WO | 2006/117247 A1 | 11/2006 |

OTHER PUBLICATIONS

Barany, F., 1911, PNAS. USA, 88: 189-193.
Bertoldo et al., 2004, Eng. Life Sci., 4, No. 6.
BLAST Search of Seq. ID. 36, accessed Apr. 22, 2009, 54 pages.
BLAST Search of Seq. ID. 456, accessed Apr. 22, 2009, 48 pages.
BLAST Search of Seq. ID. 458, accessed Apr. 22, 2009, 59 pages.
BLAST Search of Seq. ID. 460, accessed Apr. 22, 2009, 37 pages.
BLAST Search of Seq. ID. 462, accessed Apr. 22, 2009, 35 pages.
BLAST Search of Seq. ID. 464, accessed Apr. 22, 2009, 45 pages.
Borman, S., 2006, Glycosylation Engineering. Chem. Eng. News, 84(36): 13-22.
Buckholz, R. G., 1993, Yeast systems for the expression of heterologous gene products. Curr. Op. Biotechnology 4: 538-542.
Burg, J. L. et al., 1996, Mol. and Cell. Probes, 10: 257-271.
Chu, B. C. F. et al., 1986, NAR, 14: 5591-5603.
Duck, P. et al., 1990, Biotechniques, 9: 142-147.
Edwards, C. P., and Aruffo, A., 1993, Current applications of COS cell based transient expression systems. Curr. Op. Biotechnology 4: 558-563.
Erlich, H.A., J Clin. Immunol., Nov. 1989; 9(6):437-47.
Garrote, G, H Dominguez, and JC Parajo, 2001, Manufacture of xylose-based fermentation media from corncobs by posthydrolysis of autohydrolysis liquors, Appl. Biochem. Biotechnol., 95:195-207.
Guateli, J. C. et al., 1990, PNAS. USA, 87: 1874-1878.
Hamelinck, CN, G van Hooijdonk, and APC Faaij, 2005, Ethanol from lignocellulosic biomass: techno-economic performance in short-, middle-, and long-term, Biomass Bioenergy, 28:384-410.
Huygen, K. et al., 1996, Nature Medicine, 2(8): 893-898.
Jeffries, 1996, Curr. Op. in Biotech., 7:337-342.
Kievitis, T. et al., 1991, J. Virol. Methods, 35: 273-286.
Kohler, G. et al., 1975, Nature, 256(5517): 495497.
Kwoh, D. Y. et al., 1989, PNAS. USA, 86: 1173-1177.
Lavarack et al., "The acid hydrolysis of sugarcane begasse hemicellulose to produce xylose, arabinose, glucose and other products," Biomass and Bioenergy 23 (2002) 367-380.

(Continued)

*Primary Examiner* — Padma V Baskar
(74) *Attorney, Agent, or Firm* — TraskBritt

(57) ABSTRACT

Isolated and/or purified polypeptides and nucleic acid sequences encoding polypeptides from *Alicyclobacillus acidocaldarius* are provided. Further provided are methods of modulating transcription or transcription or transcriptional control using isolated and/or purified polypeptides and nucleic acid sequences from *Alicyclobacillus acidocaldarius*.

5 Claims, 196 Drawing Sheets

(56) References Cited

OTHER PUBLICATIONS

Liu C, and CE Wyman, 2003, The effect of flow rate of compressed hot water on xylan, lignin, and total mass removal from corn stover, Ind. Eng. Chem. Res., 42:5409-5416.
Luckow, V. A., 1993, Baculovirus systems for the expression of human gene products. Curr. Op. Biotechnology 4: 564-572.
Lynd et al., 2002, Micro. and Mol. Biol. Rev., vol. 66, No. 3, p. 506-577.
Malherbe and Cloete, 2002, Re/View in Environmental Science and Bio/Technology, 1: 105-114.
Matthews, J. A. et al., 1988, Anal. Biochem., 169: 1-25.
Merrifield, R. D., 1966, J. Am. Chem. Soc., 88(21): 5051-5052.
Miele, E. A. et al., 1983, J. Mol. Biol., 171: 281-295.
Mielenz, 2001, Curr. Op. in Micro., 4:324-329.
Walker, G. T. et al., 1992, NAR 20: 1691-1696.
Walker, G. T. et al., 1992, PNAS. USA, 89: 392-396.
International Search Report and Written Opinion of the International Search Authority for PCT/US09/32333, mailed Jun. 19, 2009, 9 pages.
UniProtKB/TrEMBL Q9JRQ1 [online]. Oct. 1, 2000. Available on the internet at <<URL://http://www.uniprot.org/uniprot/Q9JRQ1>>.
PCT International Search Report and Written Opinion of the International Searching Authority for PCT/US09/00442, dated May 18, 2009, 8 pages.
Broun et al. "Catalytic Plasticity of Fatty Acid Modification Enzymes Underlying Chemical Diversity of Plant Lipids" Science vol. 282 Nov. 13, 1998 pp. 1315-1317 (4 pages).
Devos et al. "Practical Limits of Functiona Prediction" Proteins: Structure, Function, and Genetics 41 (2000) pp. 98-107 (10 pages).
Seffernick et al. "Melamine Deaminase and Atrazine Chlorohydrolase: 98 Percent Identical but Functionally Different" Journal of Bacteriology vol. 183, No. 8, Apr. 2001 pp. 2045-2410 (6 pages).
Whisstock et al. "Prediction of Protein Function from Protein Sequence and Structure" Quarlty Reviews of Biophysics 36, 3 (2003) pp. 307-340 (35 pages).
Witkowski et al. "Conversion of a β-Ketoacyl Synthase to a Malonyl Decarboxylase by Replacement of the Active-Site Cysteine with Glutamine" American Chemical Society, Biochemistry, vol. 38, No. 36, 1999 pp. 11643-11650 (8 pages).
PCT International Search Report and Written Opinion of the International Search Authority for PCT/US09/35307, dated Jun. 10, 2010, 10 pages.
PCT International Search Report and Written Opinion of the International Searching Authority for PCT/US09/35331, dated Feb. 23, 2010, 10 pages.
PCT International Search Report and Written Opinion of the International Searching Authority for PCT/US09/35275, dated Feb. 25, 2010, 13 pages.
GenBank: E17054.1 Direct Submission *Alicyclobacillus acidocaldarius* genomic DNA clone pOP3 containing acyl carrier protein gene. Nov. 5, 2005 [Retrieved from the Internet Jan. 23, 2010: http://www.ncbi.nlm.nih.gov/nuccore/E17054.1?ordinalpos=2&tool=EntrezSystem2.PEntrez.Sequence.Sequence_ResultsPanel.Sequence_RVDocSum], 3 pages.
GenBank: E17054.1 Direct Submission *Alicyclobacillus acidocaldarius* genomic DNA clone pOP3 containing acyl carrier protein gene. Nov. 5, 2005 [Retrieved from the Internet Jan. 23, 2010: http://www.ncbi.nlm.nih.gov/nuccore/E17054.1?ordinalpos=2&tool=EntrezSystem2.PEntrez.Sequence.Sequence_ResultsPanel.Sequence_RVDocSum], 1 page.
Hulsmann et al., "Maltose and maltodextrin transport in the thermoacidophilic gram-positive bacterium *Alicyclobacillus acidocaldarius* is mediated by a high-affinity transport system that includes a maltose binding protein tolerant to low pH," J. Bacteriol. 2000, 182(22):6292-6301.
Jones et al., "Cloning and transcriptional analysis of the *Thermoanaerobacter ethanolicus* strain 39E maltose ABC transport system," Extremophiles 2002, 6:291-299.

Schafer et al., "X-ray Structures of the Maltose-Maltodextrin-binding Protein of the Thermoacidophilic Bacterium *Alicyclobacillus acidocaldarius* Provide Insight into Acid Stability of Proteins," J. Mol. Biol. 2004, 335:261-274.
Scheffel et al., "Functional reconstitution of a maltrose ATP-binding cassette transporter from the thermoacidophilic gram-positive bacterium *Alicyclobacillus acidocaldarius*," Biochem Biophy Acta, 2004, 1656(1):57-65.
Schneider, "Import of solutes by ABC transporters—the maltose system. ABC protein: from bacteria to man," Elsevier Science, London 2003, p. 157-185. [Retrieved from the Internet on Jan. 24, 2010; <http://www2.hu-berlin.de/biologie/baktphys/paper/1_ABC/review_chap-09.pdf].
Uniprot Direct submission Q9RHZ5_ALIAC, "Putative maltose transport membrane protein malF," Nov. 13, 2007. [Retrieved from the Internet Jan. 22, 2010: <http://www.uniprot.org/uniprot/Q9RHZ5.txt?version=30?].
Lauro et al., "Isolation and characterization of a new family 42 beta-galactosidase from the thermoacidophilic bacterium *Alicyclobacillus acidocaldarius*: Identification of the active site residues," Biochimica et Biophysica Acta 1784 (2008) 292-301.
Schwermann, B. et al., 1994, Purification, properties and structural aspects of a thermoacidophilic alpha-amylase from *Alicyclobacillus acidocaldarius* ATCC 27009, insight into acidostability of proteins. Eur. J. Biochem. 226: 981-991.
Tsao, GT, MR Ladisch, and HR Bungay, 1987. Biomass Refining, In Advanced Biochemical Engineering, Wiley Interscience, N.Y., 79-101.
Urdea, M. S., 1988, Nucleic Acids Research, II: 4937-4957.
Upreti et al., 2003, Bacterial glycoproteins: Functions, biosynthesis and applications. Proteomics, 3: 363-379.
Vieille and Zeikus, 2001, Micro. and Mol. Biol. Rev., vol. 65, No. 1, p. 1-43.
Eckert, Kelvin, "Dissertation, Cloning and Characterization of two glycosidases from the acidothermophile *Alicyclobacillus acidocaldarius* ATCC27009," Berlin, Dec. 18, 1971, 113 pages.
PCT International Search Report and Written Opinion of the International Search Authority for PCT/US10/25521, dated Jul. 14, 2010, 12 pages.
T. Collins et al., "Xylanases, Xylanase Families and Extremophilic Xylanses," FEMS Microbiology Review, 2005, pp. 3-23.
K. Eckert et al., "A Thermoacidophilic Endoglucanase (CelB), etc.," Eur. J. Biochem. 270, 2003, pp. 3593-3602.
Ito et al., "Purification and properties of acid stable xylanases from *Aspergillus kawachii*," Bioscience Biotechnology and Biochemistry 56 (4):547-550, Apr. 1992.
International Preliminary Report on Patentability and Written Opinion of the International Searching Authority for PCT/US06/42566 dated Apr. 23, 2009 (7 pages).
Supplemental European Search Report for EP 06 82 7231, dated Nov. 12, 2009, 6 pages.
Shallom et al., "Microbial hemicellulases," Current Opinion in Microbiology, Current Biology Ltd, GB, vol. 6, No. 3, Jun. 1, 2003, pp. 219-228.
Eckert et al., "Gene cloning, sequencing, and characterization of a family 9 endoglucanase (CelA) with an unusual pattern of activity from the theremoacidophile *Alicyclobacillus acidocaldarius* ATCC27009," Applied Microbiology and Biotechnology, vol. 60, No. 4, Dec. 2002, pp. 428-436.
Neddleman and Wunsch, J. Mol. Biol. 48: 443 (1970).
Olins, P. O., and Lee, S. C., 1993, Recent advances in heterologous gene expression in E. coli. Curr. Op. Biotechnology 4: 520-525.
Pearson and Lipman, Proc. Natl. Acad. Sci. (U.S.A.) 85: 2444 (1988).
Sanchez-Pescador, R., 1988, J. Clin. Microbiol., 26(10): 1934-1938.
Schäffer, C. et al., 2001, Prokaryotic glycosylation. Proteomics, 1: 248-261.
International Search Report of the International Searching Authority for PCT/US06/42566, dated Jul. 25, 2008.
PCT International Preliminary Report on Patentability of the International Search Authority for PCT/US09/32333, dated Aug. 3, 2010.
PCT International Preliminary Report on Patentability of the International Searching Authority for PCT/US09/00442, dated Jul. 27, 2010.

(56) References Cited

OTHER PUBLICATIONS

PCT International Preliminary Report on Patentability of the International Searching Authority for PCT/US09/34701, dated Aug. 24, 2010.
PCT International Preliminary Report on Patentability of the International Searching Authority for PCT/US09/35275, dated Aug. 31, 2010.
PCT International Preliminary Report on Patentability of the International Searching Authority for PCT/US09/35331, dated Aug. 31, 2010.
PCT International Preliminary Report on Patentability of the International Search Authority for PCT/US09/35307, mailed Jan. 25, 2011.
PCT International Search Report of the International Search Authority for PCT/US10/25521 Jul. 14, 2010.
Database UniProt [Online]. Feb. 10, 2009. XP-002674095. Database accession No. B7DM51, 1 page.
Extended Supplementary European Search Report for EP 09 75 5307, dated Apr. 18, 2012, 4 pages.
GenBank: AJ252161.1 Alicyclobacillus acidocaldarius maltose/maltodextrine transport gene region(maIEFGR genese, cdaA gene and glcA gene), NCBI, Hulsmann, A. http://www.ncbi.nlm.nih.gov/nuccore/AJ252161 (Jan. 6, 2000).
Database UniProt [Online]. Feb. 10, 2009. XP-002695727. Database accession No. B7DUZ1, 1 page.
Extended Supplementary European Search Report for EP 09 74 3132, dated Apr. 19, 2013, 4 pages.
Database Uniprot [Online] Nov. 3, 2009. Database accession No. C8WVZ2, 2 pages.
Database UniProt [Online]. Feb. 10, 2009. XP-002698982. Database accession No. B7DRM6, 1 page.
Extended Supplementary European Search Report for EP 09 75 5308, dated Jun. 18, 2013, 3 pages.
Kraus et al., "Identification of a co-repressor binding site in catabolite control protein CcpA," Molecular Microbiology (1998) 30(5), 955-963.
Bork, Peer, "Powers and Pitfalls in Sequence Analysis: The 70% Hurdle," Genome Research, 2000, 10:398-400.
Bowie et al., "Deciphering the Message in Protein Sequences: Tolerance to Amino Acid Substitutions," Science, 1990, 247:1306-1310.
Extended Supplementary European Search Report for EP 10 74 6882, dated Aug. 27, 2012, 9 pages.
Aden et al., "Lignocellulosic Biomass to Ethanol Process Design and Economics Utilizing Co-Current Dilute Acid Prehydrolysis and Enzymatic Hydrolysis for Corn Stover," NREL/TP-510-32438, National Renewable Energy Laboratory, Golden Colorado. Jun. 2002, pp. 1-88.
Avella et al., "A New Class of Biodegradable Materials: Poly-3-hydroxy-butyrate/Steam Exploded Straw Fiber Composites. I. Thermal and Impact Behaviour," Journal of Applied Polymer Science, vol. 49, 2091-2103 (1993).
Badger, P.C., "Ethanol from cellulose: A general review," In: J. Janick and A. Whipkey (eds.), Trands in new crops and new uses. ASHS Press, Alexandria, VA, 2002, pp. 17-21.
Bailey et al., "Interlaboratory testing of methods for assay of xylanase activity," Journal of Biotechnology, 23 (1992) 257-270.
Bergquist et al., "Molecular diversity of thermophilic cellulolytic and hemicellulolytic bacteria," FEMS Microbiology Ecology 28 (1999) 99-110.
Cowling, Ellis B., "Physical and Chemical Constrains in the Hydrolysis of Cellulose and Lignocellulosic Materials," Biotechnol. & Bioeng. Symposium No. 5, 163-181 (1975).
Crout et al., "Glycosidases and glycosyl transferases in glycoside and oligosaccharide synthesis," Current Opinion in Chemical Biology, Current Biology Ltd, London, GB, vol. 2, No. 1, Feb. 1, 1998, pp. 98-111.
Dale, M. Clark, "Enzymatic simultaneous saccharification and fermentation (SSF) of biomass to ethanol in a pilot 130 liter multistage continuous reactor separator," Bio-Process Innovation, Inc., W. Lafayette, IN, 2005, 10 pages.
Database UniProt [Online]. Feb. 10, 2009. XP-000002659383. Database accession No. B7DT70, 1 page.
Ehrman, Tina, "Standard Method for Determination of Total Solids in Biomass," Chemical Analysis and Testing Task, Laboratory Analytical Procedure, Oct. 28, 1994, 242 total pages.
EMBL Submission CP001728, Sep. 2009. [Retrieved from the internet: URL:http://www.ebi.ac.uk/Tools/dbfetch/embifetch?style=html&id=CP001728&Submit=Go], 51 pages.
Extended Supplementary European Search Report for EP 09 82 3952, dated Sep. 20, 2011, 7 pages.
Fan et al., "The Nature of Lignocellulosics and Their Pretreatments for Enzymatic Hydrolysis," Advances in Biochemical Engineering/Biotechnology, 1982, vol. 23/1982, 157-187.
Flanagan, et al., "Development of gas phase bioreactors for the removal of nitrogen oxides from synthetic flue gas streams," Fuel 81 (2002) 1953-1961.
Fushinobu et al., "Crystallographic and mutational analyses of an extremely acidophilic and acid-stable xylanase: biased distribution of acidic residues and importance of Asp37 for catalysis at low pH," Protein Engineering vol. 11, No. 12, pp. 1121-1128, 1998.
Gessesse, Amare, "Purification and Properties of Two Thermostable Alkaline Xylanases from an Alkaliphilic Bacillus sp.," Applied and Environmental Microbiology, Sep. 1998, pp. 3533-3535.
Glenn et al., "Transformation of Acidiphilium by electroporation and conjugation," Can J Microbiol. May 1992;38 (5):387-93.
Goldstein et al., "The Hydrolysis of Cellulose with Superconcentrated Hydrochloric Acid," Biotechnology and Bioengineering Symp. No. 13, pp. 17-25 (1983).
Grassin et al., "Chapter 2.13, Fruit Juices," (T. Godfrey and S. West, eds.), Industrial Enzymology, 2nd Ed., pp. 227-264 (1996).
Grethlein, H. E., "Pretreatment for enhanced hydrolysis of cellulosic biomass," Biotechnol. Adv. 1984. 2:43-62.
Grethlein, Hans E., "Comparison of the Economics of Acid and Enzymatic Hydrolysis of Newsprint," Biotechnology and Bioengineering, vol. XX, pp. 503-525 (1978).
Hanselmann, K.W., "Lignochemicals," Experientia 38 (1982) pp. 176-189.
Houghton et al., "Fungal Upgrading of Wheat Straw for Straw-Thermoplastics Production," Applied Biochemistry and Biotechnology, vol. 113-116, 2004, pp. 71-93.
Keller et al., "Microbial Pretreatment of Biomass: Potential for Reducing the Severity of Thermochemical Biomass Pretreatment," Applied Biochemistry and Biotechnology, vol. 105-108, 2003.
Kenealy et al., "Rapid 2,2'-bicinchoninic-based xylanase assay compatible with high throughput screening," Biotechnology Letters 25: 1619-1623, 2003.
Knappert et al., "Partial Acid Hydrolysis of Cellulosic Materials as a Pretreatment for Enzymatic Hydrolysis," Biotechnology and Bioengineering, vol. XXII, pp. 1449-1463 (1980).
Kulkarni et al., "Molecular and biotechnological aspects of xylanases," FEMS Microbiology Reviews 23 (1999) 411-456.
Lauro et al., "Characterization of a β-glycosidase from the thermoacidophilic bacterium *Alicyclobacillus acidocaldarius*," Extremophiles (2006) 10:301-310.
Lee et al., "Oxygen Effects on Thermophilic Microbial Populations in Biofilters Treating Nitric Oxide Containing Off-Gas Streams," Environmental Progress, vol. 20, No. 3, Oct. 2001.
Lynd, Lee R., "Overview and Evaluation of Fuel Ethanol from Cellulosic Biomass: Technology, Economics, the Environment, and Policy," Annu. Rev. Energy Environ. 1996, 21:403-65.
Mackenzie et al., "Multiple Chromosomes in Bacteria: The Yin and Yang of trp Gene Localization in *Rhodobacter sphaeroides* 2.4.1," Genetics 153: 525-538 (Oct. 1999).
Manchenko, Gennady P., "Handbook of Detection of Enzymes on Electrophoretic Gels," CRC Press, Inc. 1994, pp. 220-240.
McCoy, Michael, "Chemical Makers Try Biotech Paths," Chemical Engineering News, Jun. 22, 1998, pp. 13-19.
Michel et al., "Specificity of the protein secretory apparatus: secretion of the heat-labile enterotoxin B subunit pentamers by different species of Gram bacteria," Gene 152 (1995) pp. 41-45.
Mosier et al., "Industrial Scale-Up of pH-Controlled Liquid Hot Water Pretreatment of Corn Fiber for Fuel Ethanol Production," Applied Biochemistry and Biotechnology, vol. 125, 2005, pp. 77-97.

(56) References Cited

OTHER PUBLICATIONS

Ng et al., 1981, Applied and Environmental Microbiology, 41(6):1337-1343.
Ohta et al., "Purification and Characterization of an Acidophilic Xylanase from *Aureobasidium pullulans* var. melanigenum and Sequence Analysis of the Encoding Gene," Journal of Bioscience and Bioengineering, vol. 92, No. 3, 262-270, 2001.
Ooshima et al., "Simultaneous saccharification and fermentation of cellulose: Effect of ethanol on enzymatic saccharification of cellulose," Department of Applied Chemistry, Faculty of Engineering, Osaka City University, Osaka 558, Japan, Jun. 5, 1984.
Pajunen et al., Microbiology (2005) 151, 1209-1218.
Patel et al., (2006), "Medium and long-term opportunities and risks of the biotechnological production of bulk chemicals from renewable resources: The potential of white biotechnology". The BREW Project. Final Report prepared under the European Commission's Growth Programme (DG Research), (publica.fraunhofer.de/eprints/N-48834.pdf).
PCT International Search Report and Written Opinion of the International Searching Authority for PCT/US10/51095, dated Dec. 2, 2010, 11 pages.
PCT International Search Report and Written Opinion of the International Search Authority for PCT/US11/34852, dated Oct. 21, 2011, 12 pages.
Perlack et al., "Biomass as Feedstock for a Bioenergy and Bioproducts Industry: The Technical Feasibility of a Billion-Ton Annual Supply," USDA and DOE, Apr. 2005, 78 pages.
Peyton et al., "Biotransformation of Toxic Organic and Inorganic Contaminants by Halophilic Bacteria," Halophilic Microorganisms, Antionio Ventosa (Ed.), Springer, 2004, pp. 315-331.
Ragauskas et al., "The Path Forward for Biofuels and Biomaterials," Science, Jan. 27, 2006, vol. 311, pp. 484-4589.
Ramos et al., "Biomechanical and Biochemical Pulping of Sugarcane Bagasse with Ceriporiopsis subvermispora Fungal and Xylanase Pretreatments," J. Agric. Food Chem. 2001, 49, 1180-1186.
Saeman et al., "Quantitative Saccharification of Wood and Cellulose," Industrial and Engineering Chemistry, Jan. 1945, vol. 17, No. 1, pp. 35-37.
Saha et al., "Dilute Acid Pretreatment, Enzymatic Saccharification, and Fermentation of Rice Hulls to Ethanol," Biotechnol. Prog. 2005, 21, 816-822.
Sa-Pereira et al., "Rapid production of thermostable cellulose-free xylanase by a strain of *Bacillus subtilis* and its properties," Enzyme and Microbial Technology, 30 (2002) 924-933.
Schell et al., "Dilute-Sulfuric Acid Pretreatment of Corn Stover in Pilot-Scale Reactor," Applied Biochemistry and Biotechnology, vol. 105-108, 2003, pp. 69-85.
Schwarz, Wolfgang H., "A list of cellulolytic bacteria," Technische Universitat Munchen, Apr. 24, 2003, 8 pages.
Simpson et al., "An extremely Thermostable xylanase from the thermophilic eubacterium Thermotoga," Biochem. J. (1991) 277, 413-417.
Smook, G.A., "Handbook for Pulp & Paper Technologists," Tappi Pr; 2nd Ed. (Jun. 1992) pp. 65-88.
Subramaniyan et al., "Cellulase-free xylanases from Bacillus and other microorganisms," FEMS Microbiology Letters 183 (2000) 1-7.
Sunna et al., "Glycosyl hydrolases from hyperthermophiles," Extremophiles (1997) 12-13.
Techapun et al., "Production of a cellulose-free xylanase from agricultural waste materials by a thermotolerant *Streptomyces* sp.," Biotechnology Letters 23: 1685-1689, 2001.
Thompson et al., "Comparison of Pretreatment Methods on the Basis of Available Surface Area," Bioresource Technology 39 (1992) 155-163.
Thompson et al., "In Vitro Degradation of Natural Insoluble Lignin in Aqueous Media by the Extracellular Peroxidases of *Phanerochaete chrysosporium*," 1998 John Wiley & Sons, Inc. pp. 704-717.
Thompson et al., "Measurement of fumonsins in corn with a fiber-optic fluoroimmunosensor," SPIE vol. 2980, (2010) pp. 532-538.
Thompson et al., "Preliminary Investigation of Fungal Bioprocessing of Wheat Straw for Production of Straw-Thermoplastic Composites," Applied Biochemistry and Biotechnology, vol. 105-108, 2003, pp. 423-436.
Thompson et al., "Purification and Characterization of a Novel Thermo-Alkali-Stable Catalase from Thermus brockianus," Biotechnol. Prog. 2003, 19, 1292-1299.
Thompson et al., "Thermoacidophilic Cellulases and Hemicellulases from *Alicyclobacillus acidocaldarius*," Idaho National Laboratory, 2006, 1 page.
Thompson, et al., "Chapter 31: Changes in the Rate of Enzymatic Hydrolysis and Surface Area Available to Cellulase with Pretreatment Methods," Biotechnology in Pulp and Paper Manufacture: Applications and Fundamental Investigations. Proceedings of the Fourth International Conference on Biotechnology in the Pulp and Paper Industry (ICBPPI), May 16-19, 1989,Raleigh, NC and Myrtle Beach, SC, USA. Kirk, T.K. and Chang, H.M. (eds.). Butterworth-Heinemann, Boston, 1990, pp. 329-338.
Tsao, G.T., "Bacterial Hydrolysis: A Review," Anaerobic Digestion and Carbohydrate Hydrolysis of Waste, Ferrero et al. (eds.), Elsevier Applied Science Publishers, London, 1984, pp. 83-99.
Turner et al., "Potential and utilization of thermophiles and thermostable enzymes in biorefining," Microbial Cell Factories, Biomed Central, London, NL, vol. 6, No. 1, Mar. 15, 2007, p. 9.
Uhl et al., "The first description of an archaeal hemicellulase: the xylanase from *Thermococcus zilligii* strain AN1," Extremophiles (1999) 3:263-267.
Viikari et al., "Xylanases in bleaching: From an idea to the industry," FEMS Microbiology Reviews 13 (1994) 335-350.
Walseth, Curtis S., Occurrence of Cellulases in Enzyme Preparations from Microorganisms, TAPPI vol. 35, No. 5, May 1952, pp. 228-233.
Ward et al., "Characterization of a new bacteriophage which infects bacteria of the genus *Acidiphilium*," Journal of General Virology (1993) 74: 2419-2425.
Ward et al., "Electrotransformation of Acidophilic, Heterotrophic, Gram-negative Bacteria," Electrotransformation of Bacteria, Natalie Eynard, Justin Teissie (eds.), Springer (2000) pp. 94-103.
Wright et al., "Ethanol from Biomass by Enzymatic Hydrolysis," Chemical Engineering Progress, Aug. 1988, pp. 62-74.
Yuan et al., Expression of acidophilic alpha-amylase from *Alicyclobacillus acidocaldarius*, Sheng Wu Gong Cheng Xue Bao, Jan. 2005, 21(1):78-83. Abstract only.
Bhatia et al., "Microbial beta-Glucosidases: Cloning, Properties, and Applications," Critical Reviews in Biotechnology, 22(4):375-407, Jan. 1, 2002.
Breves et al., "Genes Encoding Two Different beta-Glucosidases of *Thermoanaerobacter brockii* Are Clustered in a Common Operon," Applied and Environmental Microbiology, vol. 63, No. 10, Oct. 1997, pp. 3902-3910.
Database EMBL [Online]. Mar. 16, 2007. XP-002627757. Database accession No. ER073884, 1 page.
Database Geneseq [Online]. May 21, 1998. XP-002627734. Database accession No. AAW35004, 1 page.
Database UniProt [Online]. May 1, 1997. XP-002630045. Database accession No. P96090, 1 page.
Database UniProt [Online]. Oct. 1, 2001. XP-002627736. Database accession No. Q97U14, 1 page.
Database UniProt [Online]. Jun. 26, 2007. XP-002627735. Database accession No. A5IKZ4, 1 page.
Database UniProt [Online]. Nov. 3, 2009. XP-002627733. Database accession No. C8WTP2, 1 page.
Extended Supplementary European Search Report for EP 09 70 3173, dated Apr. 20, 2011, 7 pages.
Extended Supplementary European Search Report for EP 09 70 9191, dated Mar. 29, 2012, 6 pages.
Lau et al., "PCR ligation mutagenesis in transformable streptococci: application and efficiency," Journal of Microbiological Methods 49 (2002) 193-205.
Lin et al., "Purification, Characterization, and Gene Cloning of Thermopsin, a Thermostable Acid Protease from Sulfolobus acidocaldarius," The Journal of Biological Chemistry, 1990, vol. 265, No. 3, pp. 1490-1495.

(56) References Cited

OTHER PUBLICATIONS

Lucas et al., C4-Dicarboxylate Transporter/Malic Acid Transport Protein [*Alicyclobacillus acidocaldarius* LAA1], GenBank Direct Submission, Accession No. EED06059, Dec. 17, 2008 (Retrieved from the Internet Dec. 15, 2009: <URL:http://www.ncbl.nlm.nlh.gov/protein/218238848), p. 2.

PCT International Search Report and Written Opinion of the International Searching Authority for PCT/US09/34701, dated Jan. 12, 2010, 10 pages.

FIG. 1

```
ref|YP_001210812.1|    ------------------------------------------------MKEKEVILTVNGLKKL
ref|YP_001111548.1|    ------------------------------------------------MKEKDVMLTVTGLKQL
ref|ZP_01666866.1|     -----------------------------------------------MAEKQTILTVDGLKKI
RAAC01465              MTIPFFRTMVSSMAHSARAARDGMHASRYSGSLEAPTGSKGETAMADKEVLLTPEGLRKL
ref|YP_001039288.1|    ------------------------------------------------NKEVVLTYEGLQKL
ref|ZP_01576004.1|     -----------------------------------------------MSAKEVVLTYEGLKKL
                                                                       *::.:**  **:::

ref|YP_001210812.1|    ESELELLKSVKRREVAERIKQAIEFGDITENSEYEDAKNEQAFIEGRILTLEKMLRNAKI
ref|YP_001111548.1|    EDELEQLKTVKRRQVAERIKQAIEFGDISENSEYEDAKNEQAFIEGRILTLEKMLRNAKI
ref|ZP_01666866.1|     EQKLEHLKSVRRREVAERIKQAIEFGDISENSEYEDAKNEQAFIEGEILTLEKMLRNAKV
RAAC01465              EEELELLKSVKRREVAERIKVAISYGDISENSEYEDAKNEQAFIEGRIMTLEKQLRNARV
ref|YP_001039288.1|    EQELENLKTVKRREVAERIKQALSFGDISENSEYDEAKNEQAYIEGRIFQLENMLKNAKV
ref|ZP_01576004.1|     EEELEFLRGTKRKEVAERIKQALSFGDISENSEYDEAKNEQAQVEGRIVQLESMLKHARI
                       *.:**  *:  .:*::****** *:.:***:*****:.****** :**.*. **. *::*::

ref|YP_001210812.1|    IDDENIGTEVVSIGSTVLLKDLECGDEYKYTIVGSAEADPGANKISNESPVGRAILGQPK
ref|YP_001111548.1|    IDDENLDNEVVSLGSKVILKDLEFGDELEYSIVGSVEADPDANKISNESPVGRAILGQSK
ref|ZP_01666866.1|     IDEGEISTDTVTIGSTVVLKDLEFGDELEYTLVGSAEADPMEFKISNESPVGQAIMGQKV
RAAC01465              INEDEVDTNVVSIGSTVKVLDLDLDEEVEYTIVGSAEANPAENKISNESPVGKALLGKQI
ref|YP_001039288.1|    IDEEDIQTDVVSIGSKVKVLDMEFDEEVEYYIVGSTEADPSQYKISNESPVGKALIGGKI
ref|ZP_01576004.1|     IDEDEVNTDVVSIGSKVRIFDIEFDEEVEYLIVGSTEANPLKSKISNESPVGAALIGHTK
                       *::  ::  ..:.*::**.* :  *:: ..:* :*  :*.:*    ********* *::* ref|YP_001210812.1|    GSVVEVTVPAGQLKYQIIDILR
ref|YP_001111548.1|    GSVVEVNVPAGILKYEIVDILR
ref|ZP_01666866.1|     GSVVEVNVPAGILKYKILEIKR
RAAC01465              GSIVEVNVPAGVIKFKILEIKR
ref|YP_001039288.1|    GDIVEVTVPDGVIKFKILEIRK
ref|ZP_01576004.1|     GETVEVQVPDGVLKFKILEISK
                       *. *** **  * :*::*::* :
```

FIG. 2

```
ref|YP_145986.1|       ---------------MIEIEKPKIETVELSEDAKYGKFVVEPLERGYGTTLGNSLRRILL
ref|YP_001124263.1|    ---------------MIEIEKPKIETVELSEDAKYGKFVVEPLERGYGTTLGNSLRRILL
ref|NP_241028.1|       ---------------MIEIEKPVIETIEISEDAKYGKFVVEPLERGYGTTLGNSLRRILL
RAAC00371              ---------------MIEIEKPRIEIVEQTGD--YGKFVCEPLERGYGTTLGNSLRRILL
ref|YP_001210899.1|    ---------------MLEIEKPKIEIVEMSDDNTYGKFVVEPLERGYGITLGNSLRRILL
ref|YP_001111617.1|    ---------------MLEIEKPKIEIVEQSEDNTYGKFVVEPLERGYGITLGNSLRRILL
                                      *:***   :*  : *  ** **** ********* ref|YP_145986.1|       SSLPGAAVTSVQIDGVLHEFSTIDGVVEDVTAIILNIKKLALKIYSDEEKTLEIDVQGEG
ref|YP_001124263.1|    SSLPGAAVTSVQIDGVLHEFSTIEGVVEDVTAIILNVKKLALKIYSDEEKTLEIDVQGEG
ref|NP_241028.1|       SSLPGAAVTSVQIDGVLHEFSTIPGVVEDVTTIVLNLKQLALKIYSDEDKTLEIDTQGEG
RAAC00371              SSIPGAAVRSVKIEGVLHEFSTIPGVVEDVTEIILNLKRLSLKIHSDEEKTLIIDAVGPG
ref|YP_001210899.1|    SSLPGAAVTSVKIDGVLHEFSTIPGVVEDVTDIILNLKNLCLKIYGDEEKVLRVEASTEG
ref|YP_001111617.1|    SSLPGAAVTSVKIEGVLHEFATVPGVQEDVTDIILNLKNLCLKIHSDEEKVLRVEAQTEG
                       :** :*:******.*::  ** *:**:*.*.*:.:*.*  ::.     * ref|YP_145986.1|       VVTAADITHDSDVEILNPDLHIATLAEGGRLRMRMTAKRGRGYVPAEANKREDQPIGVIP
ref|YP_001124263.1|    VVTAADITHDSDVEILNPDLHIATLAEGGRLRMRMTARRGRGYVPAEANKREDQPIGVIP
ref|NP_241028.1|       VVTAGDLTHDSDVDVLNPDLHIATLTTGAHLRMRITAKRGRGYVPAEGNKSDELAIGVIP
RAAC00371              VVTAGDIRADSDVDIMNPDLHIATLTEGARIYMEMRAGRGRGYVPAHRNKPEEQEIGLIP
ref|YP_001210899.1|    VVKAKDIIHDADVEIMNPDLTIATLAENARLYMEITVAKGRGYVSAERNKKGDHIIGVIP
ref|YP_001111617.1|    PVTAGDIIHDADVEILNPDLHLATLDTGGRLFMEISVNKGRGYSSAEKNKKGEHIIGVIP
                        *.*  *:    *:**::: ****  :***     ..::  *.:  .  :****  .*. **    :   **:**

ref|YP_145986.1|       IDSIYTPVSRVSYQVENTRVGQVTDYDKLTIDVWTDGSIGPKEAISLGAKILTEHLNIFV
ref|YP_001124263.1|    IDSIYTPVSRVSYQVENTRVGQVTDYDKLTIDVWTDGSIGPKEAISLGAKILTEHLNIFV
ref|NP_241028.1|       IDSIYTPVSRVNYQVENTRVGQVTNYDKLTLDVWTDGSIRPEEAVSLGAKILTEHLNIFV
RAAC00371              IDSLYSPISRVNFSVENTRVGQITDYDKLTLEVWTDGSVAPDEAVSIGAKILTEHLMLFV
ref|YP_001210899.1|    VDSVFTPVRKVNYTVENTRVGQITDYDKLTLEVWTDGSIRPDEATSLSAKILSEHLRLFI
ref|YP_001111617.1|    IDSIYTPVRRVNYNVENTRVGQITDYDKLTLEVWTNGSIRPDEATSLSAKILSEHLRLFI
                       :**:::*:  :*.: ********:*:****::  ***:**: *.**  *:.****:***    :*:

ref|YP_145986.1|       GLTDEAQNAEIMVEKEDDQKEKVLEMTIEELDLSVRSYNCLKRAGINTVQELTQKTEEDM
ref|YP_001124263.1|    GLTDEAQNAEIMVEKEDDQKEKVLEMTIEELDLSVRSYNCLKRAGINTVQELTQKTEEDM
ref|NP_241028.1|       GLTDQAQNAEIMVEKEEDQKEKVLEMTIEELDLSVRSYNCLKRAGINTVQELTQKTEEDM
RAAC00371              GLTDRARDTDLMVEKENAHNDKILDMPIEEELDLSVRSYNCLKRAGINTVAELCAKSEEM
ref|YP_001210899.1|    GLTETVSDVEIMVEKEEEHKDRVLEMTIEELDLSVRSYNCLKRAGINTVEELIQRNEEDM
ref|YP_001111617.1|    GLTETVNDVEIMVEKEEEQKDKILEMTIEELDMSVRSYNCLKRAGINTVEELIQRNEEDM
                       *:  . .:.::**: :::::*:*.*** **:*******    :.**:* ref|YP_145986.1|       MKVRNLGRKSLEEVKAKLAELGLSLRKDD
ref|YP_001124263.1|    MKVRNLGRKSLEEVKAKLAELGLSLRKDD
ref|NP_241028.1|       MKVRNLGRKSLEEVQEKLGELGLGLRKEE
RAAC00371              MKVRNLGRKSLEEVKHALGLSLRKDD
ref|YP_001210899.1|    MKVRNLGKKSLEEVINKLHELGLSLRKDD
ref|YP_001111617.1|    MKVRNLGKKSLEEVINKLHELGLSLRQED
                       *******:****** **  ***.**:::
```

FIG. 3A

```
ref|NP_240992.1|        ---MTGQLIQYGRHRQRRSYARINEVLELPNLIEIQTASYQWFLDEGLREMFQDISPIQD
ref|YP_173646.1|        ---MTGQLIQYGRHRQRRSYARINEVLELPNLIEIQTASYQWFLDEGLREMFQDISPIQD
ref|YP_001124230.1|     ---MTGRLVQYGRHRQRRSYARISEVLELPNLIEIQTSSYQWFLDEGLREMFKEISPIED
ref|YP_145951.1|        ---MTGRLVQYGRHRQRRSYARISEVLELPNLIEIQTSSYQWFLDEGLREMFREISPIED
ref|ZP_02326346.1|      ---LAGHLVQYGR-RKRRTYARINEVLEIPNLIEIQQKSYQWFLDEGLREMFQDISPIQD
RAAC00408               MTVLQGHMVKYGW-AERRSYARIREVLDLPNLIEIQQKSYEWFLREGLRETFADISPITD
                           :  *:::*     :::*:::*****.:* *** * :**** * ref|NP_240992.1|        FTGNLVLEFIDYSLGEPKYPVDESKERDVTYAAPLRVKVRLINKETGEVKEQEVFMGDFP
ref|YP_173646.1|        FTGNLVLEFIDYSLGEPKYPVDESKERDVTFAAPLRVKVRLINKETGEVKEQEVFMGDFP
ref|YP_001124230.1|     FSGNLSLEFIDYSLGEPKYSVEEAKERDVTYAAPLRVKVRLINKETGEVKEQDVFMGDFP
ref|YP_145951.1|        FSGNLSLEFIDYSLGEPKYSVEEAKERDVTYAAPLRVKVRLINKETGEVKEQDVFMGDFP
ref|ZP_02326346.1|      FTGNLVLEFIDYSLGEPKYTVDDSKERDVTYAAPLRVKVRLINKETGEVKEQEVFMGDFP
RAAC00408               FTGNLVLEFVDYSLGEPKYDVEESKERDVTYAAPLRVKVRLLNKETGEVKEQEVFLGDFP
                        *:* *:********  *:::****:********:****::**** ref|NP_240992.1|        LMTDTGTFIINGAERVIVSQLVRSPSVYYSEKIDKNGKKGYTATVIPNRGAWLELETDAK
ref|YP_173646.1|        LMTETGTFIINGAERVIVSQLVRSPSVYYSQKLDKNGKKGFTATVIPNRGAWLELETDAK
ref|YP_001124230.1|     LMTETGTFIINGAERVIVSQLVRSPSVYYSDKVDKNGKRGYSATVIPNRGAWLEYETDAK
ref|YP_145951.1|        LMTETGTFIINGAERVIVSQLVRSPSVYYSDKVDKNGKRGYSATVIPNRGAWLEYETDAK
ref|ZP_02326346.1|      IMTETGTFIINGAERVIVSQLVRSPSVYYNTKVDKNGKKAFTATVIPNRGAWLELETDAK
RAAC00408               LMTETGTFIINGAERVIVSQLVRSPSVYYSSKIDKNGKRTFAATVIPNRGAWLEFETDAK
                        ::**********************. *:****:    : :*:******** *** ref|NP_240992.1|        DIVYVRIDRTRKIPVTVLLRALGFGSDQEIIDLLGEDEYLRNTLEKDNTDSAEKALLEIY
ref|YP_173646.1|        DIVYVRIDRTRKIPVTVLLRALGFGSDQEIVDLLGENEYLRNTLEKDNTDSTDKALLEIY
ref|YP_001124230.1|     DVVYVRIDRTRKLPVTVLLRALGFSSDQEIIDLLGDNEYLRNTLEKDNTDSTEKALIEIY
ref|YP_145951.1|        DVVYVRIDRTRKLPVTVLLRALGFSSDQEIIDLLGDNEYLRNTLEKDNTDSTEKALIEIY
ref|ZP_02326346.1|      DIIYVRIDRTRKIPVTVLLRALGFGTDAEILDLLGDDEYIRNTLDKDNTDSTDKALIEIY
RAAC00408               DVVYVRIDRTRKLPITVLLRALGLSSDAEIIELLGEDEYLQNTLDKDTTDSTERALIEIY
                        *::*********:*:*********.:.:* :*:::*::*::::* ref|NP_240992.1|        ERLRPGEPPTVENAKSLLDSRFFDPKRYDLANVGRYKVNKKLHIKNRLFNQRLAETLIDP
ref|YP_173646.1|        ERLRPGEPPTVENAKSLLESRFFDPKRYDLANVGRYKINKKLHIKNRLFNQRLAEKLVDP
ref|YP_001124230.1|     ERLRPGEPPTLENAKSLLASRFFDPKRYDLASVGRYKINKKLHIKNRLFNQRLAETIADP
ref|YP_145951.1|        ERLRPGEPPTLENAKNLLASRFFDPKRYDLASVGRYKINKKLHIKNRLFNQRLAETIIDP
ref|ZP_02326346.1|      ERLRPGEPPTLDNARSLLYARFFDPKRYDLANVGRYKINKKLHIKNRLFNQRLAETLVHP
RAAC00408               ERLRPGEPPTVENARALLASRFFDPKRYDLAAVGRYKINKKLHLKNRLLNQRLAETLVDE
                        **********::::: **: ** :******* *****:*****:****:******.: .

ref|NP_240992.1|        ETGEVIAEEGSIIDRRTLDRILPYLENNVGFRTVRMSGGVVEEDEVRLQSVKIYAPDDQD
ref|YP_173646.1|        ETGEVLAEEGTLLDRRTLDKLIPHLEKNVGFRTARTSGGVLEESDVEIQSVKIYVADDYE
ref|YP_001124230.1|     ETGEIIAEAGTMIDRRTLNRLLPYLEKGAGLQTYRPTEGVAD-GQISVQTVKIYAPNDPD
ref|YP_145951.1|        ETKEVIAEAGAMIDRRTLNRLLPYLEKGVGLQTYRPAEGVVDGD-ISVQTIKIYAPNDPD
ref|ZP_02326346.1|      ETGEIIAEAGQLVDRRLLDEILPCLEEGVGFKEYSVPNGVLESDHIPMQTIDVFSP--IE
RAAC00408               ETGEIIAEAGTVLDRRTLDRIIPRLSGKVGRFTIRGTRDLFEQDEIPLQMVKIFSP--AE
                        ** *::** * ::*** *:..:* *.   .*        . .::  :  .:   :  :

ref|NP_240992.1|        GEHVIRVIGNGLVEKEIKHITPADIIASINYFFNLLHSVGGTDDIDHLGNRRLRSVGELL
ref|YP_173646.1|        GERVISVISNGMVERDVKHIAPADIIASISYFFNLLHGVGDTDDIDHLGNRRLRSVGELL
ref|YP_001124230.1|     NEKVINIIGNGFIAEDVKHITPADIIASISYFFNLLHGVGDTDDIDHLGNRRLRSVGELL
ref|YP_145951.1|        GEKVINVIGNGFIAEDVKHITPADIIASISYFFNLLHGVGDTDDIDHLGNRRLRSVGELL
ref|ZP_02326346.1|      DGKVVKVISNGVIDKNVKNITPADIISSINYFINLLHGIGNTDDIDHLGNRRLRSVGELL
RAAC00408               DGKVLHVISNGELPADVKYITPSDIIAAVSYFFNLLRGVGTTDDIDHLGNRRLRSVGELL
                         . :*: :*.** :    ::* *:*:***:::.**:***:..* *******************
```

FIG. 3B

```
ref|NP_240992.1|           QNQFRIGLSRMERVVRERMSIQDPNSITPQALINIRPVIASIKEFFGSSQLSQFMDQTNP
ref|YP_173646.1|           QNQFRIGLSRMERVVRERMSIQDPNVITPQALINIRPVIASIKEFFGSSQLSQFMDQTNP
ref|YP_001124230.1|        QNQFRIGLSRMERVVRERMSIQDANTITPQQLININRPVIAAIKEFFGSSQLSQFMDQTNP
ref|YP_145951.1|           QNQFRIGLSRMERVVRERMSIQDTNTITPQQLININRPVIAAIKEFFGSSQLSQFMDQTNP
ref|ZP_02326346.1|         QNQFRIGLSRMERVVRERMSIQDANVITPQALININRPVIAAIKEFFGSSQLSQFMDQTNP
RAAC00408                  QNQFRIGLSRMERVVRERMSIQDASAITPQALININRPVIAAIKEFFGSSQLSQFMDQTNP
                           ******************..  .*****:****************** ref|NP_240992.1|           LAELTHKRRLSALGPGGLTRERAGFEVRDVHYSHYGRMCPIETPEGPNIGLINSLSTYAK
ref|YP_173646.1|           LAELTHKRRLSALGPGGLTRERAGMEVRDVHYSHYGRMCPIETPEGPNIGLINTLSSYAK
ref|YP_001124230.1|        LAELTHKRRLSALGPGGLTRERAGFEVRDVHYSHYGRMCPIETPEGPNIGLINSLSTYAK
ref|YP_145951.1|           LAELTHKRRLSALGPGGLTRERAGFEVRDVHYSHYGRMCPIETPEGPNIGLINSLSTYAK
ref|ZP_02326346.1|         LAELTHKRRLSALGPGGLTRERAGFEVRDVHHSHYGRMCPIETPEGPNIGLINSLSTFAR
RAAC00408                  LAELTHKRRLSALGPGGLTRERAGFEVRDVHYSHYGRMCPIETPEGPNIGLINSLSTYAC
                           **********************:**.********************:::* ref|NP_240992.1|           VNEFGFMETPYRRVDPETGKVTAQIDYLTADEEDNYVVAQANMKLAEDGSFIDENIIARF
ref|YP_173646.1|           VNEFGFMETPYRRVDPETGKVTSRIDYLTADEEDNYVVAQANAKLNDDGSFVDDNIIARF
ref|YP_001124230.1|        VNKFGFIETPYRRVDPETGKVTDQIDYLTADEEDNYVVAQANVPLAEDGTFLEENVIARF
ref|YP_145951.1|           VNKFGFIETPYRRVDPETGKVTDQIDYLTADEEDNYVVAQANVPLAEDGTFLEENVVARF
ref|ZP_02326346.1|         INEYGFIEAPYRRVDPKTGVVTDEIVYMTADEEDNYVVAQANAELNEDGTFAADNVYVRY
RAAC00408                  VNEYGFIETPYRRVDPETGVVTDQIDYLTADEEENYLIAQANEPLTEDGHFVAEEITVRS
                           :*:.**:*:*****:.**..*.*.***:::****  *  :**.*   ::: .* ref|NP_240992.1|           RGENIVVSRDRVDYMDVSPKQVVSAATSCIPFLENDDSNRALMGANMQRQAVPLLVPEAP
ref|YP_173646.1|           RGENTVVPCDRVDYMDVSPKQVVSAATSCIPFLENDDSNRALMGANMQRQAVPLLVPEAP
ref|YP_001124230.1|        RGENIVVKRDRVDYMDVSPKQVVSAATACIPFLENDDSNRALMGANMQRQAVPLLQPEAP
ref|YP_145951.1|           RGENIVVKRDRVDYMDVSPKQVVSAATACIPFLENDDSNRALMGANMQRQAVPLLEPEAP
ref|ZP_02326346.1|         KDEILTLPKERVDYMDVSPKQVVSVATALIPFLENDDSNRALMGSNMQRQAVPLLMPKAP
RAAC00408                  REDVITVSRDRIDYMDVSPKQVVSVATALIPFLENDDANRALMGSNMQRQAVPLLVTDSP
                           : :  .:  :*:**********.: ******:**:*******...:* ref|NP_240992.1|           IVGTGMEHVSAKDSGAAIVSKHRGIVERVTAKEIWVRRLEEVDGKEIKGDLDKYRLQKFI
ref|YP_173646.1|           LVGTGMEHVSAKDSGAVVSKYAGIVERVTAKEIWVRRIEEVDGKETKGDLDKYKLQKFV
ref|YP_001124230.1|        IVGTGMEYVSAKDSGAAIICKHRGIVERVEAKEIWVRRLIEVDGKEVKGDLDKYRLLKFV
ref|YP_145951.1|           IVGTGMEYVSAKDSGAAIICKHRGIVERVEAKEIWVRRLIEVDGKEVKGDLDKYRLLKFV
ref|ZP_02326346.1|         LVGTGMEYKAAKDSGVCVVAKHDGIIEKVSGNEIWLRRQEEVDGRLVSGNITKFKLHKFM
RAAC00408                  LVGTGMEYQAAKDSGVCVVSKHNGVVERVTAREIWREEAVVDGQVVKGNVHKYKLIKFA
                           :****:.:***..::.*: *::*:*  ..***:*.   ***: .*:: *::* ** ref|NP_240992.1|           RSNQGTSYNQRPIVKEGDVVEKREILADGPSMEKGEMALGRNVLVGFMTWEGYNYEDAII
ref|YP_173646.1|           RSNQGTSYNQRPIVREGDRIEKREILADGPSMEMGEMALGRNVLVAFMTWDGYNYEDAII
ref|YP_001124230.1|        RSNQGTCYNQRPIVKKGDIVEKGEILADGPSMDKGELALGRNVLVAFMTWDGYNYEDAII
ref|YP_145951.1|           RSNQGTCYNQRPIVKKGDIVEKGEILADGPSMDKGELALGRNVLVAFMTWDGYNYEDAII
ref|ZP_02326346.1|         RSNQGTCINQRPLVLEGQRVKAGDILADGPSTEQGELALGRNVVVAFMTWEGYNYEDAIL
RAAC00408                  RSNQNTCLNQRPIVREGDRVKVGDILADGPATQNGELALGRNVLVAFMTWEGYNYEDAIL
                           ****.*. ****:*  :*:  ::   :******: :  **:****:*.****:********:

ref|NP_240992.1|           LSERLVKDDVYTSIHIEEYESEARDTKLGPEEITRDIPNVGEDALRNLDERGIIRVGAEV
ref|YP_173646.1|           LSERLVKDDVYTSIHIEEYESDARDTKLGPEEITRDIPNVGEDALRNLDERGIIRIGAEV
ref|YP_001124230.1|        MSERLVKEDVYTSIHIEEYEAESRDTKLGPEEITRDIPNVGEDALKNLDERGIVRIGAEV
ref|YP_145951.1|           MSERLVKEDVYTSIHIEEYEAESRDTKLGPEEITRDIPNVGEDALKNLDERGIVRIGAEV
ref|ZP_02326346.1|         LSEKLVKEDVYTSIHIEEYESEARDTKLGPEEITRDIPNVGEDALKNLDERGIIRVGAEI
RAAC00408                  ISEKMVKEDVYTSIHIEEYEIEARDTKLGPEEITRDIPNVGEDALKNLDERGIIRIGAEI
                           :**::**:************ :: ****************:*****:*******:*:***:
```

FIG. 3C

```
ref|NP_240992.1|           KDGDILVGKVTPKGVTELTAEERLLHAIFGEKAREVRDTSLRAPHGGDGIVLDVKIFNRE
ref|YP_173646.1|           KDGDILVGKVTPKGVTELTAEERLLHAIFGEKAREVRDTSLRAPHGGDGIVLDVKIFNRE
ref|YP_001124230.1|        KDGDLLVGKVTPKGMTELTAEERLLHAIFGEKAREVRDTSLRVPHGGGGIVLDVKVFNRE
ref|YP_145951.1|           KDGDLLVGKVTPKGMTELTAEERLLHAIFGEKAREVRDTSLRVPHGGGGIVLDVKVFNRE
ref|ZP_02326346.1|         GAGDILVGKVTPKGVTELTAEERLLHAIFGEKAREVRDTSLRVPHGTDGIVVDVKVFTHE
RAAC00408                  TTNDILVGKVTPKGVTELTAEERLLHAIFGEKAREVRDTSLRVPHGGAGIVVDVKVFTRE
                           .*:*******:*******************.*   *:*:*..:* ref|NP_240992.1|           DGDELPPGVNQLVRVYIVQKRKIHEGDKMAGRHGNKGVISRILPEEDMPYLPDGTPIDIM
ref|YP_173646.1|           DGDELPPGVNQLVRVYIVQKRKINQGDKMAGRHGNKGVISRILPEEDMPFLPDGTPVDIM
ref|YP_001124230.1|        DGDELPPGVNQLVRVYIVQKRKISEGDKMAGRHGNKGVISRILPEEDMPFLPDGTPIDIM
ref|YP_145951.1|           DGDELPPGVNQLVRVYIVQKRKISEGDKMAGRHGNKGVISRILPEEDMPFLPDGTPIDIM
ref|ZP_02326346.1|         NGDELPPGVNQLVRVYIAQKRKISQGDKMAGRHGNKGVIARILPEEDMPFLPDGTPVEVV
RAAC00408                  NGDELPAGVNQLVRVYVAQKRKISEGDKMAGRHGNKGVVARILPEEDMPFLEDGTPVEIV
                           :*****.*********:.***** :*************::*********:* ****:::

ref|NP_240992.1|           LNPLGVPSRMNIGQVLELHLGMAARRLGLHVASPVFDGASEEDVWATLEEAGMARDGKTI
ref|YP_173646.1|           LNPLGVPSRMNIGQVLELHLGMAARKLGIHVASPVFDGASEEDVWGTLEEAGMARDGKTI
ref|YP_001124230.1|        LNPLGVPSRMNIGQVFELHLGMAAKKLGLHIASPVFDGATEEDVWNILEEAGMARDAKTV
ref|YP_145951.1|           LNPLGVPSRMNIGQVFELHLGMAAKKLGLHIASPVFDGATEEDVWNILEEAGLARDAKTV
ref|ZP_02326346.1|         LNPLGVPSRMNIGQVLEVHLGMAAKQLGIHVATPVFDGAHEYDVFDTMEEAGMQRNGKTK
RAAC00408                  LNPLGVPSRMNIGQVLETHLGMAAKVLGLKMATPVFDGAKPEDVFETLREAGLPEDGKQV
                           ***************:*  ****:  ::*:****   :   :.***:  ..:* ref|NP_240992.1|           LYDGRTGEPFDNRVSVGIMYMIKLAHMVDDKLHARSTGPYSLVTQQPLGGKAQFGGQRFG
ref|YP_173646.1|           LYDGRTGEPFDNRVSVGIMYMIKLAHMVDDKLHARSTGPYSLVTQQPLGGKAQFGGQRFG
ref|YP_001124230.1|        LYDGRTGEPFDNRVSVGIMYMIKLAHMVDDKLHARSTGPYSLVTQQPLGGKAQFGGQRFG
ref|YP_145951.1|           LYDGRTGEPFDNRVSVGIMYMIKLAHMVDDKLHARSTGPYSLVTQQPLGGKAQFGGQRFG
ref|ZP_02326346.1|         LYDGRTGEEFEREVTVGVMYMIKLAHMVDDKIHARSTGPYSLVTQQPLGGKAQFGGQRFG
RAAC00408                  LYDGRTGEPFENRVTVGYVYMMKLHHLVDDKIHARSTGPYSLVTQQPLGGKAQFGGQRFG
                           ******** *:...*: ::** *:**:********************* ref|NP_240992.1|           EMEVWALEAYGAAYTLQEILTVKSDDVVGRVKTYEAIVKGENVPEPGVPESFKVLIKELQ
ref|YP_173646.1|           EMEVWALEAYGAAYTLQEILTVKSDDVVGRVKTYEAIVKGENVPEPGVPESFKVLIKELQ
ref|YP_001124230.1|        EMEVWALEAYGAAYTLQEILTVKSDDVVGRVKTYEAIVKGENIPEPGVPESFKVLIKELQ
ref|YP_145951.1|           EMEVWALEAYGAAYTLQEILTVKSDDVVGRVKTYEAIVKGENIPEPGVPESFKVLIKELQ
ref|ZP_02326346.1|         EMEVWALEAYGAAYTLQEILTVKSDDVVGRVKTYESIVKGENVPEPGVPESFKVLIKELQ
RAAC00408                  EMEVWALEAYGAAYTLQELLTVKSDDVVGRVKTYEAIVKGENVPEPGVPESFKVLIKELQ
                           ****************:***********:**:*************** ref|NP_240992.1|           SLGMDVKMLSSTEEEIEMKELDDEDEQASDKLNLNIDSTE---
ref|YP_173646.1|           SLGMDVKMLSSNEEEIEMRELDDEEDQTSEKLNLNLETNE---
ref|YP_001124230.1|        SLGMDVTILT---------------------------------
ref|YP_145951.1|           SLGMDVTILT---------------------------------
ref|ZP_02326346.1|         SLGMDVKILSGDEEEIEMKELDDEDDAGSDKLNLNLEGAEMG-
RAAC00408                  SLGMDVKILSGDEREIEMKEMDDDED-SPDKLNLNLEYNEVGD
                           ******.:*:
```

FIG. 4A

```
ref|YP_001124231.1|    VYPLLDVNKFEYMKIGLASPEKIRSWSYGEVKKPETINYRTLKPEKDGLFCERIFGPTKD
ref|YP_145952.1|       ---MLDVNKFEYMKIGLASPEKIRSWSYGEVKKPETINYRTLKPEKDGLFCERIFGPTKD
ref|NP_976431.1|       ---MIDVNNFEYMKIGLASPDKIRSWSYGEVKKPETINYRTLKPEKDGLFCERIFGPQKD
ref|NP_240993.1|       ---MIDVNNFEYMKIGLASPNKIRSWSRGEVKKPETINYRTLKPEKDGLFCERIFGPQKD
ref|ZP_02326345.1|     ---MMDVNNFEFMKIGLASPDKIRSWSRGEVKKPETINYRTLKPEKEGLFCEKIFGPTKD
RAAC00407              MHKLFDLNNFEFMKIGLASPEKIRSWSHGEVKKPETINYRTLRPEKEGLFCEKIFGPTRD
                          :.*:*::***:**.**********:*.***:**.:* ref|YP_001124231.1|    WECHCGKYKRVRYKGVVCDRCGVEVTRSKVRRERMGHIELAAPVSHIWYFKGIPSRMGLV
ref|YP_145952.1|       WECHCGKYKRVRYKGVVCDRCGVEVTRSKVRRERMGHIELAAPVSHIWYFKGIPSRMGLV
ref|NP_976431.1|       WECHCGKYKRVRYKGVVCDRCGVEVTRAKVRRERMGHIELAAPVSHIWYFKGIPSRMGLV
ref|NP_240993.1|       WECHCGKYKRVRYKGVVCDRCGVEVTRAKVRRERMGHIELAAPVSHIWYFKGIPSRMGLV
ref|ZP_02326345.1|     WECHCGKYKRVRYKGVVCDRCGVEVTRQKVRRERMGHIELAAPVSHIWYFKGIPSRMGLA
RAAC00407              WECHCGKYKRIRYKGVVCDRCGVEVTRSKVRRERMGHIELAAPVSHIWFFKGIPSRMGLI
                       ********:*********** ********************:******* ref|YP_001124231.1|    LDMSPRALEEVIYFASYVVTDPGDTPLEKKQLLSEKEYRAYREKYGQSFQASMGAEAIKK
ref|YP_145952.1|       LDMSPRALEEVIYFASYVVTDPGDTPLEKKQLLSEKEYRAYREKYGQSFQASMGAEAIKK
ref|NP_976431.1|       LDMSPRALEEVIYFASYVVTESGDTPLDKKQLLSEKEYRAYRDRYGSTFQAAMGAEAIKK
ref|NP_240993.1|       LDMSPRSLEEVIYFASYVVTDPGDTPLEKKQLLSEKEFRAYLDKYGRSFTAQMGAEAIRK
ref|ZP_02326345.1|     LDMSPRSLEEIIYFASYVVTDPGDTPLEKKQLLSEKEYRSYREKYGYAFQAGMGAEAVKK
RAAC00407              LDMSPRALEEVIYFASYVVTDPGDTPLEKKQLLSEKEYRSYREKYGYAFKAGMGAEAIRT
                       ******:***.**********:.*****:*********:*:*   ::**  :*  * *****::.

ref|YP_001124231.1|    LLQDIDLDKEVATLKEELKTAQGQRRARIIKRLEVLESFRSSGNDPAWMVLDVLPVIPPE
ref|YP_145952.1|       LLQDIDLDKEVAALKEELKTAQGQRRARIIKRLEVLEAFRSSGNDPAWMVLDVLPVIPPE
ref|NP_976431.1|       LLQDIDLDKEVDFLKEELKTAQGQRRTRAIKRLEVLEAFRNSGNEPSWMILDVLPVIPPE
ref|NP_240993.1|       LLMDIDLDKEVDGLKEELQTAQGQRRTRAIKRLEVLEAFRNSGNEPSWMILDVLPVIPPE
ref|ZP_02326345.1|     LLQDIDIDKEVDVLKEELRTAQGQRRNRAIKRLEVMEAFRNSKNKPDWMILDVLPVIPPE
RAAC00407              LLQEIDLDREVEILREELRTAQGQRRNRAIKRLEVIEAFRQSGNKPSWMILEALPVIPPD
                       ** :**:*:**    *:***:******* * ******:*:**.* *.* **:*:.******:

ref|YP_001124231.1|    LRPMVQLDGGRFATSDLNDLYRRVINRNNRLKRLLDLGAPNIIVQNEKRMLQEAVDALID
ref|YP_145952.1|       LRPMVQLDGGRFATSDLNDLYRRVINRNNRLKRLLDLGAPNIIVQNEKRMLQEAVDALID
ref|NP_976431.1|       LRPMVQLDGGRFATSDLNDLYRRVINRNNRLKRLLDLGAPSIIVQNEKRMLQEAVDALID
ref|NP_240993.1|       LRPMVQLDGGRFATSDLNDLYRRVINRNNRLKRLLDLGAPSIIVQNEKRMLQEAVDALID
ref|ZP_02326345.1|     LRPMVQLDGGRFATSDLNDLYRRVINRNNRLKRLLDLGAPDIIVQNEKRMLQEAVDALID
RAAC00407              LRPMVQLDGGRFATSDLNDLYRRVINRNNRLKRLLDLGAPDIIVQNEKRMLQEAVDALID
                       **************************************.**************** ref|YP_001124231.1|    NGRRGRPVTGPGNRPLKSLSHMLKGKQGRFRQNLLGKRVDYSGRSVIVVGPNLKMYQCGL
ref|YP_145952.1|       NGRRGRPVTGPGNRPLKSLSHMLKGKQGRFRQNLLGKRVDYSGRSVIVVGPNLKMYQCGL
ref|NP_976431.1|       NGRRGRPVTGPGNRPLKSLSHMLKGKQGRFRQNLLGKRVDYSGRSVIVVGPNLKMYQCGL
ref|NP_240993.1|       NGRRGRPVTGPGNRPLKSLSHMLKGKQGRFRQNLLGKRVDYSGRSVIVVGPNLKMYQCGL
ref|ZP_02326345.1|     NGRRGRPVTGPGNRPLKSLSHMLKGKQGRFRQNLLGKRVDYSGRSVIVVGPSLKMYQCGL
RAAC00407              NGRRGRPVTGPGNRPLKSLSHMLKGKQGRFRQNLLGKRVDYSGRSVIVVGPELRMYQCGL
                       ***************************************************.*:****** ref|YP_001124231.1|    PKEMALELFKPFVMKELVERGLAHNIKSAKRKIERVHPEVWDVLEDVIKEHPVLLNRAPT
ref|YP_145952.1|       PKEMALELFKPFVMKELVERGLAHNIKSAKRKIERVHPEVWDVLEDVIKEHPVLLNRAPT
ref|NP_976431.1|       PKEMALELFKPFVMKELVEKGLAHNIKSAKRKIERVQPEVWDVLESVIKEHPVLLNRAPT
ref|NP_240993.1|       PKEMALELFKPFVMKELVSKGLAHNIKSAKRKVERVQPEVWDVLEEVIKEHPVLLNRAPT
ref|ZP_02326345.1|     PKEMALELFKPFVMKELVNKQLAHNIKSAKRKVERVSPEVWDVLEEVIKEHPVLLNRAPT
RAAC00407              PKEMALELFKPFVMKELVARGLAHNIKSAKRKVERVSDEVWDVVEDVIKQHPVLLNRAPT
                       ****************** :  ***********:***   *****:*.***:********
```

FIG. 4B

```
ref|YP_001124231.1|      LHRLGIQAFEPTLVEGRAIRLHPLVCTAYNADFDGDQMAVHVPLSAEAQAEARLLMLAAQ
ref|YP_145952.1|         LHRLGIQAFEPTLVEGRAIRLHPLVCTAYNADFDGDQMAVHVPLSAEAQAEARLLMLAAQ
ref|NP_976431.1|         LHRLGIQAFEPTLVEGRAIRLHPLVCTAYNADFDGDQMAVHVPLSSEAQAEARLLMLAAQ
ref|NP_240993.1|         LHRLGIQAFEPTLVEGRAIKLHPLVCTAYNADFDGDQMAVHVPLSAEAQAEARILMLAAQ
ref|ZP_02326345.1|       LHRLGIQAFEPILVEGRAIMLHPLVCTAYNADFDGDQMAVHVPLSAEAQAEARILMLAAG
RAAC00407                LHRLGIQAFEPVLVEGRAIKLHPLVCTAYNADFDGDQMAVHVPLSAEAQAEARLLMLAAH
                         ********  *** *********************:***:*** ref|YP_001124231.1|      NILNPKDGKPVVTPSQDMVLGNYYLTMEREGAIGEGMVFKDTDEALLAYHNGYVHLHSRI
ref|YP_145952.1|         NILNPKDGKPVVTPSQDMVLGNYYLTMEREGAIGEGMVFKDTDEALLAYHNGYVHLHSRI
ref|NP_976431.1|         NILNPKDGKPVVTPSQDMVLGNYYLTLEREGAIGEGMVFKDANEALLAYQNGYVHLHTRV
ref|NP_240993.1|         NILNPKDGKPVVTPSQDMVLGNYYLTMEREGAKGEGSVFKDTNEALIAYQNGYVHLHTRI
ref|ZP_02326345.1|       NILNPKDGKPVVTPSQDMVLGSFYLTTDNKHAKGSGMILRSVHEAFSVYQNGTAELHARV
RAAC00407                NILNPKDGKPVVTPTQDMVLGSYYLTIEREGAPGEGKVPASVSEVEYALHQRLITLQTRI
                         **************:******..:***  .:: * *.*  ::  .. *.  . ::    *::*:

ref|YP_001124231.1|      AIHAGSLKNETFTPEQNNKLLLTTVGKLIFNEILPKSFPYINEPTTENIEGRTP-DKYFL
ref|YP_145952.1|         AIHAGSLKNETFTEEQNNKLLLTTVGKLIFNEILPNSFPYINEPTTENIEGRTP-DKYFL
ref|NP_976431.1|         AVAASAVNNATFTEEQKSMLLLTTVGKLIFNEILPESFPYINEPTNSNLEKETP-AKYFV
ref|NP_240993.1|         AIPVASLGKTTFKEEQNSQLLLTTVGKLIFNEILPESFPYVNEPTAHNLEVETP-SKYMV
ref|ZP_02326345.1|       AIPAKALNKISFTDKQQDAYLITTIGKIIFNEIFPKDFPYINQSTTSNLMHGPS-DDYFA
RAAC00407                ALPAKAVGKTSFTEKQANALLITTPGKLIFNSIFPSDFPYLNSAAKSNLLGGPP-DDTFI
                         *:  . ::  : :*. :*  . *:** **:***.*:*..***:*..:   *:    .. . :

ref|YP_001124231.1|      -DKGVDVREEIRKRELVPPFKKKVLGQIIAEVFKRFKITETSKMLDRMKDLGFQYSTKAG
ref|YP_145952.1|         -DKGVNVREEIRKRELVPPFKKKVLGQIIAEVFKRFKITETSKMLDRMKDLGFQYSTKAG
ref|NP_976431.1|         -EKGANIKEIIASREEVAPFSKKILGNIIAEVFKRFKITETSRMLDRMKNLGFKYSTKAG
ref|NP_240993.1|         -PTSTNVKELFQERDVVAPFKKGFLGNIIAEVFKKFKITETSKMLDRMKDLGFKYSTKAG
ref|ZP_02326345.1|       FEKGSDIRAKMEELPECKAVGKDYLGSIIAECFRKYHTTETSIILDKVKQLGFTYSTKAG
RAAC00407                FEKGVDIREAILKRPIPKAVIKKDLGNILAECFRRYGTTMTAEILDKVKRLGFHYSTLAG
                         ..  ::: :  . ..  *  **.*:** *:::  * *: :**::*  *  * ** ref|YP_001124231.1|      ITIGVSDIVVLPEKQEILDEAQAKVDTVLKQFRRGLITDEERYERVISVWSAAKDKIQDR
ref|YP_145952.1|         ITIGVADIVVLPEKQEILDEAQAKVDTVLKQFRRGLITDEERYERVISIWSAAKDKIQDR
ref|NP_976431.1|         ITVGVSDILVLGEKDEILHEAQAKVDNVIKQFRRGLITEEERYDRVISIWSNAKDVIQGK
ref|NP_240993.1|         ITVGVADIVVLPEKKEILAEAEKKVDRVLKQFRRGLITEEERYDRVISIWSEAKDVIQDK
ref|ZP_02326345.1|       ITVAVADVIVPKEKQEILKESEQKVQTITNQYRRGLITDDERYDRVIAIWSKAKDDITDI
RAAC00407                ITISISDIVVPEEKKRIIAEAEAKEHKLKLQYRRGLITEEEQYVTFSQIWSEAKEQISSI
                         **:.::.:*: :*  **..*: *:::  *  . :  *:****** ::.:*    .  :**  **: *  .

ref|YP_001124231.1|      LMKSLDKRNPIFMMSDSGARGNASNFTQLAGMRGLMANPAGRIIELPIKSSFREGLTVLE
ref|YP_145952.1|         LMKSLDKRNPIFMMSDSGARGNASNFTQLAGMRGLMANPAGRIIELPIKSSFREGLTVLE
ref|NP_976431.1|         LMKSLNKRNPIFMMSDSGARGNASNFTQLAGMRGLMANPSGRIIELPIKSSFREGLTVLE
ref|NP_240993.1|         LMGSLDKRNPIFMMSDSGARGNASNFTQLAGMRGLMANPSGRIIELPIKSSFREGLTVLE
ref|ZP_02326345.1|       LMKSLDKYNSINMMVESKARGNKSQITQLAGMRGKIIELPIKSNFREGLTVLE
RAAC00407                LMESMDQFNPIYMMATSGARGSNSQITQLAGMRGLMANPSGEIIQLAIKSNFREGLSVLE
                         ** *:::  *.* **    * ***..*:::*.*******.*.**:*.*.*:*** ref|YP_001124231.1|      YFISTHGARKGLADTALKTADSGYLTRRLVDVAQDVIVREEDCGTDRGILARALTDGTEV
ref|YP_145952.1|         YFISTHGARKGLADTALKTADSGYLTRRLVDVAQDVIVREEDCGTDRGILARALTDGTEV
ref|NP_976431.1|         YFISTHGARKGLADTALKTADSGYLTRRLVDVAQDVIVREDDCGTDRGLLIGAIKEGNEV
ref|NP_240993.1|         YFISTHGARKGLADTALKTADSGYLTRRLVDVAQDVIVREDDCGTDRGLEVEAIKEGNEI
ref|ZP_02326345.1|       YFISTHGARKGLADTALRTADSGYLTRRLVDVAQDVIVREEDCGTDKGFVVSKIQDGKEV
RAAC00407                YFISTHGARKGLADTALRTADSGYLTRRLVDVAQDTIVREHDCGTDKGLRVMEIRDGSEV
                         *****************:*****************.****.*****:*:     :  :*.*:
```

FIG. 4C

```
ref|YP_001124231.1|    VVKLEERLVGRYAHKTVHHPETGEVIVRKDEMITEDIANEIIKAGITEVWIRSVFACNTR
ref|YP_145952.1|       VVKLEERLVGRYAHKTVRHPETGEVIVRKDEMITEDIANEIMKAGITEVWIRSVFACNTR
ref|NP_976431.1|       IESLYDRLVGRFARKTVKHPETGEVLVAENQLITEDIAHIVENSGVETVNIRSAFTCNTR
ref|NP_240993.1|       IEGLYDRLVGRVAFKTVRHPETGEPIVKKNELIHEDLAKQIVEAGVEQVTIRSVFTCDTR
ref|ZP_02326345.1|     IEDLFDRIEGRYAFETVRHPETGEIIVHRNELIDANLASRIVEAGVEKIQIRSVMSCRAR
RAAC00407              IEDLRDRLEGRVAFQDVYHPETGEKIVGKNEMIDEEAADKIVAAGIKEVTIRSVLTCRTR
                       :  * :*: ** * : * ****** :* .:::*  : *  : *:  : ***.::* :* ref|YP_001124231.1|    HGVCKKCYGRNMATGMDVEVGEAVGIIAAQSIGEPGTQLTMRTFHTGGVAGDDITQGLPR
ref|YP_145952.1|       HGVCKKCYGRNMATGMDVEVGEAVGIIAAQSIGEPGTQLTMRTFHTGGVAGDDITQGLPR
ref|NP_976431.1|       HGVCKKCYGRNLATGTDVEVGEAVGIIAAQSIGEPGTQLTMRTFHTGGVAGDDITQGLPR
ref|NP_240993.1|       HGVCKKCYGRNLATGSDVEVGEAVGIIAAQSIGEPGTQLTMRTFHTGGVAGDDITQGLPR
ref|ZP_02326345.1|     YGVCKKCYGRNLATGQHVEIGEAVGIIAAQSIGEPGTQLTMRTFHTGGVAGDDITQGLPR
RAAC00407              HGVCQLCYGRNLATGDMVEVGEAVGIIAAQSIGEPGTQLTMRTFHTGGVAGDDITQGLPR
                       :*. *:*   :************************.****** ref|YP_001124231.1|    VQELFEARNPKGQAVISEIDGTVVAINETRDNQYEIVVQSEVETRSYVAPYNARLKVEEG
ref|YP_145952.1|       VQELFEARNPKGQAVISEIDGTVISINKTRDNQYEVVVQGEVETRTYVAPYNARLKVEEG
ref|NP_976431.1|       IQEIFEARNPKGQAVISEIDGVIAAINDVKDRQ-EVVVQGEVETRTYAIPYGARLKVIPG
ref|NP_240993.1|       IQELFEARNPKGQAVITEIEGEVTNINEA-DKR-EITVKGEMETKTYSIPYGARIKVELG
ref|ZP_02326345.1|     IQELFEARNPKGQAIITEIDGMVKDIREAKDRR-EIEVEGEAESRVYSVPFGSRIRVAVN
RAAC00407              VQELFEARNPKGQAVIAEFDGVITDIREGKDKR-EIELTGESETKTYQIPYGSRIRVSVG
                       :**:**********:*:*:*  :  *.. *.: *:  :  .* *::   *  *:.:*::* .

ref|YP_001124231.1|    QHVERGQELTEGSVDPKQLLRVRDITSVQEYLLREVQKVYRMQGVEISDKHIEVMVRQML
ref|YP_145952.1|       QRVERGQELTEGSVDPKQLLRVRDITSVQEYLLREVQKVYRMQGVEISDKHIEVMVRQML
ref|NP_976431.1|       QQISHGKELTEGSIDPKELLKVTDITAVQEYLLREVQKVYRMQGVEIGDKHVEVMVRQML
ref|NP_240993.1|       EQVVPGQSLTEGSIDPKELLKVQGMTGVQEYLLREVQKVYRMQGVEIGDKHVEVMVRQML
ref|ZP_02326345.1|     DHIEAGDELTEGSIDPKEMLRIKGIRGVQNYILQEVQRVYRNQGVEINDKHVEVMIRQML
RAAC00407              QQLEAGEELTEGSVDPKEMLRVKGLQGVQNYLLREVQRVYRLQGVDINDKHIEVMIRQML
                       :::   *..***:*::*: ::  .: .**:*:*:*:* ***:*.*:*:**** ref|YP_001124231.1|    RKVRVIDAGDTDVLPGTLLDVHQFTDVNAQAIREGKRPATARPVLLGITKASLETDSFLS
ref|YP_145952.1|       RKVRVIDAGDTDVLPGTLLDVHQFTDVNAKALREGKRPATARQVLLGITKASLETDSFLS
ref|NP_976431.1|       RKVRVSDAGETDVLPGTLLDIHQFTDANAKVLLQGKQPATARPVLLGITKASLETDSFLS
ref|NP_240993.1|       RKIRVIDAGDTEVLPGSLIEIQHFNDENKKVLLSGREPATGRPVLLGITKASLETDSFLS
ref|ZP_02326345.1|     RKIRIVDAGDTNLLPGSFVDMHEYEEANKTALLEGREPAVAKPILLGITKASLETDSFLS
RAAC00407              RKVRILDAGDTDLLPGTYVDLFEYEAANREALLSGKEPAVARPALLGITKASLETDSFLS
                       **:*: ***:*::***:  :::   .:  * .:  .*:. ..: ************** ref|YP_001124231.1|    AASFQETTRVLTDAAIKGKRDELLGLKENVIIGKLVPAGTGMARYRNVKPAV--------
ref|YP_145952.1|       AASFQETTRVLTDAAIKGKRDELLGLKENVIIGKLVPAGTGMARYRKVKPAV--------
ref|NP_976431.1|       AASFQETTRVLTDAAIKGKRDELLGLKENVIIGKLVPAGTGMNRYRKVD-----------
ref|NP_240993.1|       AASFQETTRVLTDAAIKGKRDELVGLKENVIIGKLVPAGTGMNRYRNLD-----------
ref|ZP_02326345.1|     AASFQETTRVLTDAAIKGKVDQLLGLKENVIIGKLIPAGTGMQRYRNI------------
RAAC00407              AASFQETTRVLTEAAIKGKVDRLLGLKENVIIGKLIPAGTGMVRYRNVEPEVVRPGDAEA
                       ************:******  *:*:***********:******:****  ***.::

ref|YP_001124231.1|    -----------------
ref|YP_145952.1|       -----------------
ref|NP_976431.1|       -----------------
ref|NP_240993.1|       -----------------
ref|ZP_02326345.1|     -----------------
RAAC00407              AATGEEVAETEAVSSAE
```

FIG. 5

```
ref|NP_244660.1|         --------------------SKEEIQELSMVEVAYLVMKETKEPFNYQDLLKKVAELKG
ref|NP_693930.1|         --------------------THDEIDHLSMIELGVKILKEENKAMNYKVIFNKIAELKD
RAAC00480                MATGLSRAGREDSKMAISLARTEHEIQEMPLVELVYEILKARKEPMYFRDIMKEIQELRH
ref|ZP_01168478.1|       --------------------TKEELQEMSFIDIAYELLKGTKQQVSFTDIMNEYKTRLE
ref|ZP_01860921.1|       --------------MSLKQLSTE-ELRQKSFIELAHELLTEKKQAVTFNDLLKEIGDLLK
ref|YP_001127419.1|      --------------MSLQQQYSPEELQEMSFVELANLILLNKREALPFDQIVREAAALTG
                                              :  *:  . ..::::   ::    .:  .  :   :...:

ref|NP_244660.1|         MSEEQMLDRIGYLYTDLNIDGRFVTLGDNRWGLRSWYPLEQVEEEITGPTK---------
ref|NP_693930.1|         FTDEQKQNMMAQFYTDMNVDGRFLTLGSGMWGLKRWYPVEQAEEEIT-------------
RAAC00480                MTDEQVADVIARVFTEINVDGRFVCIGHNVWGLNRWYPTDRNAERLSGGKKFIRKTGDAF
ref|ZP_01168478.1|       VSDEEIRSRIAQFYTDLNLDGRFIAMGENRWGLRSWYPVDTMEE----------------
ref|ZP_01860921.1|       LSKEEVRSRMVQFYTDLNVDGRFIALGENRWGIRAWYPVDQIEEETVPTIKPRKKKAKKT
ref|YP_001127419.1|      ATEDDIAARLAQYYTDLNIDGRFICVGENVWGLRAWYPFDQTED----------------
                          :.::      :    :*::*:****: :*  . **:. *** :     :

ref|NP_244660.1|         ------------------------------------------------------------
ref|NP_693930.1|         ------------------------------------------------------------
RAAC00480                GDEEDDEEEYEEEDVLEDDELDYDEVEAVDEEPEFDDVEVVEDEDEILPEDEYDDAPLFD
ref|ZP_01168478.1|       ------------------------------------------------------------
ref|ZP_01860921.1|       DD----------------------------------------------------------
ref|YP_001127419.1|      ------------------------------------------------------------ ref|NP_244660.1|         -----------
ref|NP_693930.1|         -----------
RAAC00480                EEEEVEEDEED
ref|ZP_01168478.1|       -----------
ref|ZP_01860921.1|       -----------
ref|YP_001127419.1|      -----------
```

FIG. 6

```
ref|NP_465351.1|      ---MLYPSIDNLLLKIDSKYSLVTVAAKRARYMQLENDKGVLPSYQSDKFVGKALEEIHA
ref|NP_471274.1|      ---MLYPSIDNLLLKIDSKYSLVTVAAKRARYMQLENDKGVLPSYQSDKFVGKALEEIHA
ref|YP_014447.1|      ---MLYPSIDNLLLKIDSKYSLVTVAAKRARYMQLENDKGVLPSYQSDKFVGKALEEIHA
ref|YP_850042.1|      ---MLYPSIDNLLLKIDSKYSLVTVAAKRARYMQLENDKGVLPSYQSDKFVGKALEEIHA
RAAC00147             ---MIYPSIDRLLERCNSKYALVVLAAKRAR--KLQNETLNQPGASTTRNVSRALWEIHD
ref|NP_268055.1|      ---MLEPSIDKLLDQVDSKYSLVVLEAKRAH--ELRDKERPTKEFKAVKNTLRALEEIAD
                         *: ****.**  : :***:**.: ****:   :*.:.       .: : . :** **

ref|NP_465351.1|      GKLVLQNDD--
ref|NP_471274.1|      GKLVLQN----
ref|YP_014447.1|      GKLVLQNDD--
ref|YP_850042.1|      GKLVLKN----
RAAC00147             GVVRCKNFDGE
ref|NP_268055.1|      GTVK-------
                      *  :
```

FIG. 7

```
ref|YP_074981.1|         ------ETEARPAEAAVEAWIQQHGEAVLRLAYASLLNRAQAEDVFQEVFIRAYRHADRL
ref|YP_001275817.1|      ------------DHDAFAQLMGRYAGSVFNLAYRMLGNAQEAEDASQEIFLRAYTNLARF
RAAC01826                MRHARRNETPAEDAALLAEWMELYGGDVIRLAYSYVHNFHKAEDIAQDVFLRAWQHYGEF
ref|YP_074736.1|         MSQSDRAALPSDRTAAIDHLMREYGTKVLHLAYSYLKDRHLAEDVAQEVFIKAYRNWENF
ref|YP_001394390.1|      ----------------LERLMNCYGNDILRTAYIYLKDIHLAEDVFQDVFIKVYNNFDKF
ref|NP_244228.1|         ----------------LIAWMEEYGTAILRVVYSYVKDKQIAEDLTQEVFVRAFQSYHTY
                                           . :  :.  .*   :  :    ***  *::*::.:

ref|YP_074981.1|         RDPDRVRPWLLQVTMNACRDLRRSWWWRRTREGSGL--EGLAEAGEGPAADPAAAAVRAD
ref|YP_001275817.1|      DQERRFSTWLLSIGSNYCIDRLR----RRRFAWLTL--DDVVLSVPTSAKGPERSAVERE
RAAC01826                QGQSSIKTWLLSITANRARDVLRSGAERREFAD-----EGEAFAREIEPCDPADLVADKL
ref|YP_074736.1|         RGESSAYTWLYRITVNLCRDKARSAWWRRLLPTDDPRAAGTPVEPDTAGDDPEEAVVLSD
ref|YP_001394390.1|      NGKSSEKTWILTITINTCRDMLRSCWIKKVLRFDDT-EYGIFNSTDDLN-DTEDTVIKNI
ref|NP_244228.1|         QTRSSAKAWLYRIAINRSKDFLKSWHAKHVYPSE------VAEEIETTEQTPEYEVLLKS
                          .*:  :  *. *   :       ::              . .

ref|YP_074981.1|         VSQAVARAVRALPDGFRETVVLHYFEGLDAAEIARITGVRVGTVHSRLHRARQLLRRQLE
ref|YP_001275817.1|      ERDAVQRALLSLPPTYREVAVLRYWNDLSYEEITQVTGLPESTIKTRLHRARRMLAEALR
RAAC01826                ARDAVWRAIRVLPETYREVMELYYGNDLTTHEVAEILGIRDQTVRTRLHRGRQMLERALA
ref|YP_074736.1|         QRERLLDYVMQLSDAYREVIILYYYHDLTTVEIAEVTGQNENTVKTRLFRARAMLKQMLQ
ref|YP_001394390.1|      EYEDILKKVMDLPKKYKEVILLYYYQELSTSEISKILKIPEGTVRSRLYRARGILK----
ref|NP_244228.1|         DEERLAAAVFSLPLSYREVIYFYYYEELSVKEVASFTGLNENTVKTRLRKGRLLLKNLLE
                           : :    *.  ::*.  : * . *   *:: .     *:::** :.* :* ref|YP_074981.1|         AWG-------
ref|YP_001275817.1|      AEG-------
RAAC01826                EQGGMGVDHA
ref|YP_074736.1|         KGG-------
ref|YP_001394390.1|      ----------
ref|NP_244228.1|         KE--------
```

FIG. 8

```
ref|YP_001126509.1|      ----------------TLEQAKEQLAELGKKRGILTYEEIAERLSGFDLDSDQMDEYYEYL
ref|YP_148335.1|         ----------EAAGESLEQVKEQLAELGKKRGILTYEEIAERLSGFDLDSDQMDEYYEYL
ref|ZP_01173341.1|       MAEKSARSKEVDSELTMEQVKEQLTEVGKKTGVLAYDDIAERLSNFELDSDQMDEFYEFL
ref|YP_001376241.1|      ---------------MTLEQVKEQLTELGKKRGVLTYEEIAERMNGFEIESEQMDEYYEYL
ref|ZP_02328521.1|       ----NDQHTELETELTLEQVKDQLIELGKKRSSLTYKEIMDRLAPYDQDAEQIDDFFEHL
RAAC00896                MAKTNDEIRDEDQGITLQEAKQQLIELGKKQGSLTYEEISDRLSSFDMDADAMDDFFEQL
                                   ::::.*:**  *:***  . *:*.:* :*:   ::   ::: :*:::* * ref|YP_001126509.1|      ADQGIEVISESDIETDPDIDELVK-EEEFDLN---DLSVPPGVKINDPVRMYLKEIGRVP
ref|YP_148335.1|         AEQGIEVISESDLEADPDIDDLAK-EEEFDLN---DLSVPPGVKINDPVRMYLKEIGRVP
ref|ZP_01173341.1|       GDQGVELVGD-NDDADPNVQELAKGEEEFDLN---DLSVPPGVKINDPVRMYLKEIGRVD
ref|YP_001376241.1|      GEQGIDLVGD-NDEG-PNNHQITKTEEEFDLN---DLSVPPGVKINDPVRMYLKEIGRVD
ref|ZP_02328521.1|       SEMGIDVGNE-NDDDEDNIRPGNTDNEDEDFNFEDDLTLPPGIKINDPVRMYLKEIGRVP
RAAC00896                AELGIDVVNE-RDEE------GGREDDDYDL---DDLSVPPGVKISDPVRMYLKEIGRVP
                         .: *:::  .:    :       ::: *:    ::*:.*********** ref|YP_001126509.1|      LLSAEEEIELAKRIEQGDEEAKRRLTEANLRLVVSIAKRYVGRGMLFLDLIQEGNMGLIK
ref|YP_148335.1|         LLSAEEEIELAKRIEQGDEEAKRRLTEANLRLVVSIAKRYVGRGMLFLDLIQEGNMGLIK
ref|ZP_01173341.1|       LLSAQEEISLAKRIEEGDEEAKRRLAEANLRLVVSIAKRYVGRGMLFLDLIQEGNMGLIK
ref|YP_001376241.1|      LLSAEEEIQLATRIEEGDEEAKRRLAEANLRLVVSIAKRYVGRGMLFLDLIQEGNMGLIK
ref|ZP_02328521.1|       LLSAEDEVELAKRIEQGDEEAKRRLTEANLRLVVSIAKRYVGRGMLFLDLIQEGNMGLIK
RAAC00896                LLSAQEEIELAKRIEQGDEEAKQRLAEANLRLVVSIAKRYVGRGMLFLDLIQEGNLGLLK
                         ****::*:..*:***::***************************::* ref|YP_001126509.1|      AVEKFDYRKGYKFSTYATWWIRQAITRAIADQARTIRIPVHMVETINKLIRVQRQLLQDL
ref|YP_148335.1|         AVEKFDYRKGYKFSTYATWWIRQAITRAIADQARTIRIPVHMVETINKLIRVQRQLLQDL
ref|ZP_01173341.1|       AVEKFDYRKGYKFSTYATWWIRQAITRAIADQARTIRIPVHMVETINKLIRVQRQLLQDL
ref|YP_001376241.1|      AVEKFDYRKGFKFSTYATWWIRQAITRAIADQARTIRIPVHMVETINKLIRVQRQLLQDL
ref|ZP_02328521.1|       AVEKFDHTKGYKFSTYATWWIRQAITRAIADQARTIRIPVHMVETINKLIRVSRQLLQEL
RAAC00896                AVEKFDYRKGYKFSTYATWWIRQAITRAIADQARTIRIPVHMVETINKLIRVSRQLLQEL
                         ****: :************************************* .***:* ref|YP_001126509.1|      GREPTPEEIAEEMDLTPEKVREILKIAQEPVSLETPIGEEDDSHLGDFIEDQEATSPSEH
ref|YP_148335.1|         GREPTPEEIAEEMDLTPEKVREILKIAQEPVSLETPIGEEDDSHLGDFIEDQDATSPSEH
ref|ZP_01173341.1|       GREPTPEEIAEDMDLTPEKVREILKIAQEPVSLETPIGEEDDSHLGDFIEDQDATSPSEH
ref|YP_001376241.1|      GREPTPEEIGEEMDLAPEKVREILKIAQEPVSLETPIGEEDDSHLGDFIEDQEATSPADH
ref|ZP_02328521.1|       GREPTPEEIAKEMELSTDKVREIMKIAQEPVSLETPIGEEDDSHLGDFIEDQEALAPADA
RAAC00896                GREPTPEEIAAEMDLTPEKVREIQKIAQEPVSLETPIGEEDDSHLGDFIPDDEAPAPADA
                         *********. .:*:*::.:*****  *********************  *::*  :*::

ref|YP_001126509.1|      AAYELLKEQLEDVLDTLTDREENVLRLRFGLDDGRTRTLEEVGKVFGVTRERIRQIEAKA
ref|YP_148335.1|         AAYELLKEQLEDVLDTLTDREENVLRLRFGLDDGRTRTLEEVGKVFGVTRERIRQIEAKA
ref|ZP_01173341.1|       AAYELLKEQLEDVLDTLTDREENVLRLRFGLDDGRTRTLEEVGKVFGVTRERIRQIEAKA
ref|YP_001376241.1|      AAYELLKEQLEDVLDTLTDREENVLRLRFGLDDGRTRTLEEVGKVFGVTRERIRQIEAKA
ref|ZP_02328521.1|       AAYELLKEQLEDVLDTLTEREENVLRLRFGLDDGRTRTLEEVGKVFGVTRERIRQIEAKA
RAAC00896                AAYELLKEQLEDVLDTLTEREENVLRLRFGLDDGRTRTLEEVGKVFGVTRERIRQIEAKA
                         ****************:*************************************** ref|YP_001126509.1|      LRKLRHPSRSKRLKDFLE
ref|YP_148335.1|         LRKLRHPSRSKRLKDFLE
ref|ZP_01173341.1|       LRKLRHPSRSKRLKDFLE
ref|YP_001376241.1|      LRKLRHPSRSKRLKDFLE
ref|ZP_02328521.1|       LRKLRHPSRSKRLKDFLE
RAAC00896                LRKLRHPSRSKRLKDFLE
                         ******************
```

FIG. 9

```
ref|YP_146980.1|        ----------------------------------DEIYYIGGSEALPPPLTKEEEEQLIAR
ref|YP_001125115.1|     ----------------------------------DEIYYIGGSEALPPPLTKEEEERLIER
ref|ZP_01862300.1|      ----------------------------------DEIYYIGGSEALPPPLSKEEEAVLLKK
ref|ZP_01172495.1|      ----------------------------------DEIFYIGGSEALPPPLSKEEEEVLLIK
ref|NP_243422.1|        ----------------------------------DEIYYIGGSEALPPPLSKEEEAHLLKK
RAAC00120               MYAFQFLETKRRLALLRLRLLYIRLRIRLLGQPDEVYYVGGSEALPPPLTKEEEQYLLER
                                                          **:.*:**********.****  *: :

ref|YP_146980.1|        LAAGDDTARSLLIERNLRLVVYIARKFENTGIHIEDLISIGTIGLIKAVNTFNPEKKIKL
ref|YP_001125115.1|     LAVGDKTARSLLIERNLRLVVYIARKFENTGIHIEDLISIGTIGLIKAVNTFNPEKKIKL
ref|ZP_01862300.1|      LPNGDKTARSLLIERNLRLVVYIARKFENTGINIEDLISIGTIGLIKAVNTFNPEKKIKL
ref|ZP_01172495.1|      LPKGDKAARSMLIERNLRLVVYIARKFENTGINIEDLISIGTIGLIKAVNTFNPEKKIKL
ref|NP_243422.1|        LPSGDKAVRSMLIERNLRLVVYIARKFENTGINIEDLISIGTIGLIKAVNTFNPEKKIKL
RAAC00120               LPSGDPSVRSMLIERNLRLVVYIARKFENTGVNIEDLVSIGTIGLIKAVNTFDPSKKIKL
                        *.   :.:*****************:..*************:*.***** ref|YP_146980.1|        ATYASRCIENEILMYLRRNNKVRAEVSFDEPLNIDWDGNELLLSDVLGTDDDVITKDLEA
ref|YP_001125115.1|     ATYASRCIENEILMYLRRNNKVRAEVSFDEPLNIDWDGNELLLSDVLGTEDDVITKDLEA
ref|ZP_01862300.1|      ATYASRCIENEILMYLRRNNKIRSEVSFDEPLNIDWDGNELLLSDVLGTEEDIITKDLEA
ref|ZP_01172495.1|      ATYASRCIENEILMYLRRNNKIRSEVSFDEPLNIDWDGNELLLSDVLGTEEDIITKDLEA
ref|NP_243422.1|        ATYASRCIENEILMYLRRNNKIRSEVSFDEPLNIDWDGNELLLSDVLGTDDDIITRGIEE
RAAC00120               ATYASRCIENEILMYLRRNNKLRAEVSLDEPLNVDWDGNELLLSDVLGTDSDTIYRNLED
                        *******************: .* ***:**************:.* * :.:* ref|YP_146980.1|        DVDRRLLLNALRQLSDREKQIMELRFGLSGGEEKTQKDVADLLGISQSYISRLEKRIIKR
ref|YP_001125115.1|     DVDRRLLLNALRQLSDREKQIMELRFGLSGGEEKTQKDVADLLGISQSYISRLEKRIIKR
ref|ZP_01862300.1|      TVDRKLLFNALTELSDREKQIMELRFGLMGGEEKTQKDVADMLGISQSYISRLEKRIIKR
ref|ZP_01172495.1|      NVDKKLLLKALHQLTDREKQIMELRFGLGSGEEKTQKDVADMLGISQSYISRLEKRIIKR
ref|NP_243422.1|        KVDRKLLMKALHTLTDREKQIMELRFGLAGGEEKTQKDVADLLGISQSYISRLEKRIIKR
RAAC00120               EVDRELLYDALDKLSERERTIMELRFGLGTGQEMTQKDVADLLGISQSYISRLEKRILKR
                        **:.**  .**  *::**: ******** *:* ******:****************:**

ref|YP_146980.1|        LRKEFNKMM
ref|YP_001125115.1|     LRKEFNKMM
ref|ZP_01862300.1|      LKKEFNKMV
ref|ZP_01172495.1|      LKKEFNKMV
ref|NP_243422.1|        LQKEFNKMV
RAAC00120               LQREFNKMM
                        *::****:
```

FIG. 10

```
ref|YP_001126333.1|      -----MPMDVDVKQDQSPIKDQEMKELIRRSQEGDQEARDEIIEKNMRLVWSVVQRFLNR
ref|YP_148161.1|         ------------------IKDQEMKELIRRSQEGDQEARDEIIEKNMRLVWSVVQRFLNR
pdb|1L0O|C               ----------HMQGQSPIKDQEMKELIRRSQEGDQEARDEIIEKNMRLVWSVVQRFLNR
gb|AAB81194.1|           ------------------IKDQEMKELIRRSQEGDQEARDEIIEKNMRLVWSVVQRFLNR
ref|YP_001487306.1|      ---------------QLSNDEVKELIKKSQDGDQQARDLLVEKNMRLVWSVVQRFLNR
RAAC02146                MDQAKERPVPHHVDEYEKLSDEEVRELLERSHNGDAEARERLIVHNQRLVWAVVQRFLGR
                                         :.:.:*::**:..*:: :: :: :* **:****.* ref|YP_001126333.1|      GYEADDLFQIGCIGLLKSVDKFDLSYDVKFSTYAVPMIIGEIQRFLRDDGTVKVSRSLKE
ref|YP_148161.1|         GYEADDLFQIGCIGLLKSVDKFDLSYDVKFSTYAVPMIIGEIQRFLRDDGTVKVSRSLKE
pdb|1L0O|C               GYEADDLFQIGCIGLLKSVDKFDLSYDVKFSTYAVPMIIGEIQRFLRDDGTVKVSRSLKE
gb|AAB81194.1|           GYEADDLFQIGCIGLLKSVDKFDLSYDVKFSTYAVPMIIGEIQRFLRDDGTVKVSRSLKE
ref|YP_001487306.1|      GYEPDDLFQIGCIGLLKSVDKFDLSYDVKFSTYAVPMIIGEIQRFIRDDGTVKVSRSLKE
RAAC02146                GYEAEDLFQIGCIGLMKAVDKFDLSYDVKFSTYAVPMIIGEIQRFLRDDSTVKVSRSLKE
                         *.:******:*:*************************:*.********** ref|YP_001126333.1|      MGNKIRKAKDELSKTRGRAPTITEIADHLGVSPEEVVLAQEAVRSPASIHETVYENDGDP
ref|YP_148161.1|         MGNKIRKAKDELSKTRGRAPTVTEIADHLGISPEDVVLAQEAVRSPTSIHETVYENDGDP
pdb|1L0O|C               MGNKIRKAKDELSKTRGRAPTVTEIADHLGISPEDVVLAQEAVRLPTSIHETVYENDGDP
gb|AAB81194.1|           MGNKIRKAKDELSKTRGRSPTITEIADHLGISPEDVVLAQEAVRLPTSIHETVYENDGDP
ref|YP_001487306.1|      LGNKIRRARDELSKSHGRMPTVQEIAEYLDITPEDVVLAQEAVRTPSSIHETVYENDGDP
RAAC02146                TAKQIRHVRDRLAKELGRQPHITEIAEAMGMEPSEIVFAQEALRAPASIHETVYENDGDP
                          .::**:..:*.*:*  **  *  *:  ***: :.: *.::*:****:* *:********** ref|YP_001126333.1|      ITLLDQIADADEASWFEKIALKKAIEELDERERLIVYLRYYKDQTQSEVAARLGISQVQV
ref|YP_148161.1|         ITLLDQIADADEASWFDKIALKKAIEELDERERLIVYLRYYKDQTQSEVASRLGISQVQV
pdb|1L0O|C               ITLLDQIADADEASWFDKIALKKAIEELDERERLIVYLRYYKDQTQSEVASRLGISQVQM
gb|AAB81194.1|           ITLLDQIADADEASWFDKIALKKAIEELDERERLIVYLRYYRDTQSEVASRLGISQVQV
ref|YP_001487306.1|      ITLLDQIADHSEERWFDKIALKEAIKELEEREKLIVYLRYYKDQTQSEVAERLGISQVQV
RAAC02146                IYLMDQIADEETEGKFDKVELHEIIGRLPERERFIVYMRFFRDKTQSDVARVLGISQVQV
                         * *:*****    .   *:*: *::  *  .* ***::***:::*:***.**  *******:

ref|YP_001126333.1|      SRLEKKILQHIKEKMD
ref|YP_148161.1|         SRLEKKILQHIKDKMD
pdb|1L0O|C               SRLEKKILQHIK----
gb|AAB81194.1|           SRLEKKILQHIKDKMD
ref|YP_001487306.1|      SRLEKKILKQIQMQMD
RAAC02146                SRLEKRILQQIRQELE
                         *****:**::*:
```

FIG. 11

```
ref|YP_001212395.1|        ------------NKVEICGVNTSKLPVLTGSQMKALFEAMHK-GDASARTKLINGNLRLV
ref|ZP_01667054.1|         ------------NKVEICGVNTAKLPVLSANKMRELFEIMQQ-GNPEAREQLIYGNLRLV
RAAC00121                  MTGRLGGTSLKRNKVEICGVNTSQLPVLTNAQMRELFEQLRA-GDPSAREKLVNGNLRLV
ref|YP_001125116.1|        ----MGGNNLTRNKVEICGVDTSKLPVLKNEEMRELFQRMHE-GDLEAREKLVNGNLRLV
ref|NP_243420.1|           ---------MTRNKVEICGVDTSKLPVLKNQEMRELFARLQS-GDTSARETLVNGNLRLV
ref|ZP_02330758.1|         ---------MTRNKVEICGVDTAKLPVLTNTEMRELFALLQTKNERAAREKLVNGNLRLV
                                       ********.*::****.   :*:    ::   .:     *: ****** ref|YP_001212395.1|        LSVIQRFTNRGEYVDDLFQVGCIGLMKAIDNFDLSQNVKFSTYAVPMIIGEIRRYLRDNN
ref|ZP_01667054.1|         LSVIQRFNNRGEYVDDLFQVGCIGLMKAIDNFDLSQNVKFSTYAVPMIIGEIRRYLRDNN
RAAC00121                  LSVIQRFNNRGEYVDDLFQVGCIGLMKAIDNFDLNQNVRFSTYAVPMIVGEIRRYLRDNN
ref|YP_001125116.1|        LSVIQRFNNRGEFVDDLFQVGCIGLMKSIDNFDLNQNVKFSTYAVPMIIGEIRRYLRDNN
ref|NP_243420.1|           LSVIQRFNNRGEYVDDLFQVGCIGLMKSIDNFDLSQNVKFSTYAVPMIIGEIRRYLRDNN
ref|ZP_02330758.1|         LSVIQRFNNRGEFVDDLFQVGCIGLMKSIDNFDLSQNVKFSTYAVPMIIGEIRRYLRDNN
                           *****.:**********.*.*:*******.********** ref|YP_001212395.1|        PIRVSRSLRDVAYKALQVRDALVNKY--SREPSINEIACELKMPREEIVFALDAIQEPIS
ref|ZP_01667054.1|         PIRVSRSMRDIAYKALQVRDALVSKF--SREPSINEIADELKIPREEIIFALDAIQEPVS
RAAC00121                  PIRVSRSLRDIAYKALQVRDMLASKN--LREPSIVEIANEMNLPKEEVVFALDAIQDPVS
ref|YP_001125116.1|        PIRVSRSLRDIAYKALQVRERLMGET--AKEPSTEEIAKELGVAHEEVVLALDAIQDPVS
ref|NP_243420.1|           PIRVSRSLRDIAYKALQVRDQLMGEKQREKEPTVQEIAKELGVPKEDVVFALDAIQDPVS
ref|ZP_02330758.1|         PIRVSRSLRDIAYKALQVRDQLTNRN--SREPTIYEISEVLNVPKEDVVFALDAIQDPVS
                           *****::********* *  ..   ::  :   :  .:*::::******:*:* ref|YP_001212395.1|        LFEPIYHDGGDPIFVMDQISDEKNQDQNWLEGIAIRDALRKLSDREKLILTLRFYEGKTQ
ref|ZP_01667054.1|         LFEPIYHDGGDPIFVMDQISDDKNQDMNWLEGVAIKEALRKLSDREKHILTLRFFEGKTQ
RAAC00121                  MFEPIYHDGGDPIYVMDQIHDEREKDSAWVEGIALREAMRKLSDREKKILAKRFYEGKTQ
ref|YP_001125116.1|        LFEPIYNDGGDPIYVMDQLSDERNRDSQWIEEIALKEGLRRLNEREKMIIRKRFFQGKTQ
ref|NP_243420.1|           LFEPIYNDGGDPIYVMDQISDDRNKDVQWVDEIALKEAMVRLNDREKLILNMRFYQGKTQ
ref|ZP_02330758.1|         LFEPIYHDGGDPIYVMDQISDERNKDLFWIEGIALREAMRKLGSREKMILSMRFFEGKTQ
                           :*****:******:****: *::::*   *::  :*::::.: :*..*** *:   **::****

ref|YP_001212395.1|        MEVAEEIGISQAQVSRLEKAALNHMKKHI--
ref|ZP_01667054.1|         MEVADEIGISQAQVSRLEKAALGHMRKYI--
RAAC00121                  MEVADEIGISQAQVSRLEKAAIHRMYKHIQS
ref|YP_001125116.1|        MEVAEEIGISQAQVSRLEKAAIRQMNKNIQ-
ref|NP_243420.1|           MEVAEEIGISQAQVSRLEKAAIQQMSKHAQS
ref|ZP_02330758.1|         MEVADEIGISQAQVSRLEKSAINQMQKHVKT
                           ****:************.*:  :*  *
```

FIG. 12

```
ref|NP_842661.1|        ------------------------------------------------------------
ref|NP_829995.1|        ------------------------------------------------------------
ref|NP_976421.1|        ------------------------------------------------------------
ref|YP_001373458.1|     ------------------------------------------------------------
ref|YP_001512033.1|     ------------------------------------------------------------
RAAC02546               -------MTDQSLGRSPARLEDTAQASVPERRSRDLRRSFQLKCTISRIFVN-------- ref|NP_842661.1|        ------------------------------------------------DEAIVELVRKGNT
ref|NP_829995.1|        ------------------------------------------------DEAIVELVRKGNT
ref|NP_976421.1|        ------------------------------------------------DEAIVELVRKGNT
ref|YP_001373458.1|     ------------------------------------------------DEAIVELVRKGNI
ref|YP_001512033.1|     ------------------------------------------------VLDEVMVEIAKEGDL
RAAC02546               -----------------------------ALLPCTSLTIGGDFVMDTTLVLSAKRGDQ
                                                     *  .:*   .:.*:

ref|NP_842661.1|        DALEYLIHKYKNFVRAKSRSYFLVGADREDIVQEGMIGLFKAIRDYKEDKLSSFKAFAEL
ref|NP_829995.1|        DALEYLIHKYKNFVRAKSRSYFLVGADREDIVQEGMIGLFKAIRDYKEDKLSSFKAFAEL
ref|NP_976421.1|        DALEYLIHKYKNFVRAKSRSYFLVGADREDIVQEGMIGLFKAIRDYKEDKLSSFKAFAEL
ref|YP_001373458.1|     DALEYLIHKYKNFVRAKSRSYFLVGADREDIVQEGMIGLFKAIRDYKEDKLSSFKAFAEL
ref|YP_001512033.1|     EALEYLIKKYKNFVRAKARSYFLIGADREDIVQEGMIGLYKAIRDFKPDKLSSFRAFAEL
RAAC02546               DSFMALYREFHARIRSWIRNYWIPGADREDLMQHAWIGFWEAIRDYDVRGKVPFRAFAKM
                        ::: * :::: :*: *.*:: ******:*.. **:::****:.   .*:***::

ref|NP_842661.1|        CITRQIITAIKTATRQKHIPLNSYVSLDKPI-YDEESDRTLLDVISEAKVTDPEEMIIS-
ref|NP_829995.1|        CITRQIITAIKTATRQKHIPLNSYVSLDKPI-YDEESDRTLLDVISEAKVTDPEEMIIS-
ref|NP_976421.1|        CITRQIITAIKTATRQKHIPLNSYVSLDKPI-YDEESDRTLLDVISEAKVTDPEEMIIS-
ref|YP_001373458.1|     CITRQIITAIKTATRQKHIPLNSYVSLDKPI-YDEESDRTLLDVISEAKVTDPEEMIIS-
ref|YP_001512033.1|     CITRQIITAIKTATRQKHIPLNSYVSLNKPI-YDEESDRTLLDVISGQKVTDPEELVVS-
RAAC02546               CVMREIQAALKMARRQKHVSHLTALSLDAECPWIEDAERTVLDVFVDRAAPSVDDMVFGP
                        *: *:* :*:* * ****:.  : :**:    : *:::**:***:   ... :::: ..

ref|NP_842661.1|        ------QEEYTDIESKISELLSDLER----------KVLSLYLDGRSYQEISEQLNRHV
ref|NP_829995.1|        ------QEEYTDIESKISELLSDLER----------KVLSLYLDGRSYQEISEQLNRHV
ref|NP_976421.1|        ------QEEYTDIESKISELLSDLER----------KVLSLYLDGRSYQEISEQLNRHV
ref|YP_001373458.1|     ------QEEYSDIELKISELLSDLER----------KVLSLYLDGRSYQEISEQLNRHV
ref|YP_001512033.1|     ------REELGHIEDKIGEILSDLEL----------KVLMLYLEGRSYQEIAGDLERHV
RAAC02546               PPSAGPEELVAWAERHWGLRLTELER----------EVWRLRVEGHSYAEIQRMLGCGY
                         .*      *   : . *::**           :*  *  ::*:    * ref|NP_842661.1|        KSIDNALQRVKRK------------
ref|NP_829995.1|        KSIDNALQRVKRK------------
ref|NP_976421.1|        KSIDNALQRVKRK------------
ref|YP_001373458.1|     KSIDNALQRVKRK------------
ref|YP_001512033.1|     KSIDNALQRVKRK------------
RAAC02546               KAVDNAVQRLRRKAKMLVNNANLQT
                        *::***:**:**
```

FIG. 13

```
ref|YP_077384.1|          ------------------------LEDEQVIEMVHGDSDALDYLITKYRNFVRAKARSYF
ref|YP_001419777.1|       ------------------------LEDEQVIEKVHGDSDALDYLITKYRNFVRAKARSYF
emb|CAA41793.1|           --------------------EQQEDETVVDLVHKGDIDALEYLIHKYKNFVRAKARSYF
ref|ZP_01173595.1|        ------------------------LEDEEIIELVHRGESEALDYLIQKYRNFVRAKARSYF
ref|NP_240981.1|          ------------------------DVGLVNRVRNGDGAALEYLIHKYKNFVRAKARSYF
RAAC00418                 MSTQPTPRDADAAPPYDTAPYENMTDEELVEAVHRGDTDALDYLIHKYKNFVRAKARSYF
                                                  *   :::  *: *:   :* :********* ref|YP_077384.1|          LIGADREDIVQEGMIGLYKSIRDFREDKLTSFKAFAELCITRQIITAIKTATRQKHIPLN
ref|YP_001419777.1|       LIGADREDIVQEGMIGLYKSIRDFREDKLTSFKAFAELCITRQIITAIKTATRQKHIPLN
emb|CAA41793.1|           LIGADREDIVQEGMIGLYKAIRDFREDKLTSFKAFAELCITRQIITAIKTATRQKHIPLN
ref|ZP_01173595.1|        LIGADKEDIVQEGMIGLYKAIRDFKEDKLSSFKAFAELCITRQIITAIKTATRQKHIPLN
ref|NP_240981.1|          LIGADHEDIVQEGMIGLYKAIRDFKGDKLSSFKAFAELCITRQIITAIKTATRQKHIPLN
RAAC00418                 LIGADREDIVQEGMIGLYKSIRDFRGDKLSSFKAFAELCITRQIITAIKTATRQKHIPLN
                          ***:*********.: *:****************************** ref|YP_077384.1|          SYVSLDKPIYDEESDRTLLDVISGAKVMNPEELIINQEEFDDIELKMGELLSDLERKVLA
ref|YP_001419777.1|       SYVSLDKPIFDEESDRTLLDVISGAKTLNPEEMIINQEEFDDIEMKMGELLSDLERKVLV
emb|CAA41793.1|           SYVSLDKPIYDEESDRTLMDVISGTKVANPEELLINREKFDDIELKMAELLSDLERKVLV
ref|ZP_01173595.1|        SYVSLDKPIYDEESDRTLMDVISGAKVMDPEELIINQEEFDNIEVKMSELLSDLERKVLA
ref|NP_240981.1|          SYVSLDKPLYDEESDRTLLDVVCGSRVTDPEELLINQEEFDDIEVKMGELLSDLERKVLM
RAAC00418                 SYVSLDKPIYDEDSDRTLLDVICTVRVADPEELIINQEEFDDIEGKMSELLSDLERQVLM
                          ********::**:*****:***:    :.  :***::**:*:**:**  **:*******:**

ref|YP_077384.1|          LYLDGRSYQEISEELNRHVKSIDNALQRVKRKLEKYLELREI-
ref|YP_001419777.1|       LYLDGRSYQEISDDLNRHVKSIDNALQRVKRKLEKYLEIREI-
emb|CAA41793.1|           LYLDGQSYQEISEELNRHVKSIDNALQRVKRKLERYLEIREI-
ref|ZP_01173595.1|        LYLDGQSYQEISEELNRHVKSIDNALQRVKRKLERYLEVR---
ref|NP_240981.1|          LYLDGRSYQEISAELNRHVKSIDNALQRVKRKLERYMELKGV-
RAAC00418                 LYLDGRSYQEIAVDLARHVKSIDNALQRVKRKLEKYLTVRNVI
                          *****:*****:  :* ******************:*::  ::
```

```
FIG. 14 ref|YP_181606.1|         ------------------------------------------------------------
RAAC02968                ---------------------------------------------MLDVLVDRTAPSVED
ref|YP_001409756.1|      ------------------------------------------------------------
ref|NP_976421.1|         ---------------------------------------------LLDVISEAKVTDPEE
ref|NP_842661.1|         C--------------------------------------------LLDVISEAKVTDPEE
ref|YP_001485343.1|      ---------------------------------------------LLDVISGAKALNPED ref|YP_181606.1|         ----------------WLEPAKGMN------ISHRELEVFVLMIEGHNNKEIGALLGIQY
RAAC02968                VVFGPPKGVSAEELVAWAERHWRLN------LSELEREVWRLRIEGHSYTEIQRMLGCGY
ref|YP_001409756.1|      -----------------------------LNEEETQIFELWLDGYSYKEIEEMVGVNF
ref|NP_976421.1|         MI------ISQEEYTDIESKISEL-------LSDLERKVLSLYLDGRSYQEISEQLNRHV
ref|NP_842661.1|         MI------ISQEEYTDIESKISEL-------LSDLERKVLSLYLDGRSYQEISEQLNRHV
ref|YP_001485343.1|      LI------ISKEEFDDIEMKMGEL-------LSELERKVLVLYLDGRSYQEISEDLNRHV
                                 :..  *  ::   *  ::*  .   **    :.

ref|YP_181606.1|         QSVKN--------------------
RAAC02968                KAVDNAVQRLRKKARRALMRQEGAAL
ref|YP_001409756.1|      KKVDNTV-------------------
ref|NP_976421.1|         KSIDNAL-------------------
ref|NP_842661.1|         KSIDNAL-------------------
ref|YP_001485343.1|      KSIDNAL-------------------
                         : :.*
```

FIG. 15  RAAC03263

```
ref|YP_001666100.1|      ---------- ---------- ---------- ---------- ---------- ----------
ref|NP_621806.1|         ---------- ---------- ---------- ---------- ---------- ----------
ref|NP_346951.1|         ---------- ---------- ---------- ---------- ---------- ----------
ref|YP_001181188.1|      ---------- ---------- ---------- ---------- ---------- ----------
ref|YP_001317994.1|      ---------- ---------- ---------- ---------- ---------- ----------
RAAC03236                MSGCVSSLPF ILALCVSSAA PRVRALGGAW LRLGHRLAIG AAFTVCATAS HCCPTRCRMD
Clustal Consensus ref|YP_001666100.1|      ---------- -----TGIVR KVDELGRVVI PIELRRTLNI AERDALEIYV DGEQIVLKKY
ref|NP_621806.1|         ---------- -----TGIVR KVDELGRVVI PIELRRTLNI AERDALEIYV DGEQIVLKKY
ref|NP_346951.1|         ---------- --MKSTGVVR RVDELGRIVI PIELRRTLNI AEKDALEIYV DGEQIILKKY
ref|YP_001181188.1|      ---------- --MKSTGVVR KVDELGRIVL PIELRRTLDI AEKDALEIFV DGDKIILRKY
ref|YP_001317994.1|      ---------- --MKSTGIVR KVDELGRIVL PIELRRTLTI AEKDSLEIYV DGESIILKKY
RAAC03236                DHEAAKLRRR IRMLVTGYVR KVDHLGRLVI PKRLRKDLAI GQDDSIEIYV EGDAVVLSKY
Clustal Consensus                            :.*:*: * .**: * *  .: *::**:* :*: ::* ** ref|YP_001666100.1|      EPACIFCGNA ENVINYKGKN ICKNCLEELK ------
ref|NP_621806.1|         EPACIFCGNA ENVINYKGKN ICKNCLEELK ------
ref|NP_346951.1|         EPACIFCGDA SDVINYRGKN ICKHCLEELK ------
ref|YP_001181188.1|      EPACIFCGNA KDVIYYKGKN ICKDCMEELK ------
ref|YP_001317994.1|      EPACIFCGNA KDVTVYKTKN VCEDCLEEFR ------
RAAC03236                EPKCVFCG-E KAEKVFHERG VCGTCLEELK AKSKVS
Clustal Consensus        ** *:***   .          ::  :.  :*   *:**::
```

FIG. 16

```
ref|YP_001126560.1|    -----GIFSAFAFLLKELTFLVSYIKNNAFPQPLSPKEEEKYLELMAKGDEQARNRLIEH
ref|YP_148388.1|       -----GIFTAFTFLLKELTFLVSYIKNNAFPQPLSAQEEEKYLALMAKGDEQARNRLIEH
ref|ZP_01861605.1|     ------IATAIGYFLKELVFLVSYVKNNAFPQPLSSQEEKYLRKMANGDEDARNILIEH
ref|NP_242151.1|       ------IIAALTYFFKEVLVFVSYVKNNAFPQPLSKEEERHYLKRMAEGDEEARNRLIEH
ref|YP_175113.1|       -----GILAALTYFMKEVFVFVSYVKNNAFPQPLSKEDEKKYLARMAEGDASARNMLIEH
RAAC00856              MDQVPGLLTLLALVFKDVSLFVSYVKQGAFPHPLSPEEEERAIRDYLAGDADARNRLIEH
                           :  :    .:*::  .:***:*:.*:*  ::*.: :       .* **** ref|YP_001126560.1|    NLRLVAHIVKKFENTGEEVEDLISIGTIGLIKAIESYSPNKGTKLATYAARCIENEILMH
ref|YP_148388.1|       NLRLVAHIVKKFENTGEEVEDLISIGTIGLIKAIESYSPGKGTKLATYAARCIENEILMH
ref|ZP_01861605.1|     NLRLVAHIVKKFENTGEDPEDLISIGTIGLIKAIESYSEGKGTKLATYAARCIENEILMH
ref|NP_242151.1|       NLRLVAHIVKKFENTREHTEDLISIGTIGLIKAIESFSEGKGTKLATYAARCIENEILMH
ref|YP_175113.1|       NLRLVAHIVKKFENTREDVEDLISIGTIGLIKAIESYSEGKGTKLATYAARCIENEILMH
RAAC00856              NLRLVAHLAKKYESSGEEMDDLISIGTIGLIKAVESYRPDKGTKLATYAARCIENEILMY
                       *******:.**:*.: *. :************** **:   .*******************:

ref|YP_001126560.1|    LRSLKKTRKDVSLHEPIGQDKEGNEISLLDILKSEGQDIVDEIQLNMELEQVKKYISVLD
ref|YP_148388.1|       LRSLKKTRKDVSLHEPIGQDKEGNEISLLDILKAEGEDIADEIHLNMELEQVKQYISVLD
ref|ZP_01861605.1|     LRALKKTKDVSLHDPIGQDKEGNEISLIDILKSDADDVIETIQLSMELEKVRKYICVLD
ref|NP_242151.1|       LRALKKVKDVSLHDPIGTDKEGNEITLIDVLQEDSEDIADSIQLKMEKKQIYEYIHVLD
ref|YP_175113.1|       LRALKKVKDVSLHDPIGTDKEGNEITLIDILKDDGEDIVDVLQTEMEKKQIYEYIHVLD
RAAC00856              LRSSKKHRRDAFLSDPVGTDKDGNEMTLADLLGSDPDDVIDAVDMSWEKQKMFECLPLLA
                       :    ::*.  *  :*:* :*:: *:*   : :*:   :..   *  :::    :  :* ref|YP_001126560.1|    EREKEVIVNRFGLGRQREKTQREIAKELGISRSYVSRIEKRALMKMFHEFYRQEK-----
ref|YP_148388.1|       EREKEVIINRFGLGRQREKTQREIAKELGISRSYVSRIEKRALMKMFHEFYRQEK-----
ref|ZP_01861605.1|     DREKEVIIGRFGLDMKEEKTQREIAKELGISRSYVSRIEKRALMKMFHEFYREEK-----
ref|NP_242151.1|       DREKEVIVGRFGLDLEEERTQREIAKELGISRSYVSRIEKRALMKLF-------------
ref|YP_175113.1|       EREKEVIIGRFGLNMEEERTQREIAKELNISRSYVSRIEKRALMKLF-------------
RAAC00856              PREREVLCKRFGLPDGEERTQREIAKELGISRSYVSRIEQKAIVKLYENMRQRKPAGSGA
                        **:**:    ****      .*:********* .************:*:::*::

ref|YP_001126560.1|    --
ref|YP_148388.1|       --
ref|ZP_01861605.1|     --
ref|NP_242151.1|       --
ref|YP_175113.1|       --
RAAC00856              DA
```

FIG. 17

```
ref|YP_148388.1|          VKKFENTGEEVEDLISIGTIGLIKAIESYSPGKGTKLATYAARCIENEILMHLRSLKKTR
ref|YP_001126560.1|       VKKFENTGEEVEDLISIGTIGLIKAIESYSPNKGTKLATYAARCIENEILMHLRSLKKTR
ref|YP_896655.1|          VKKFENTGEDAEDLISIGTIGLIKAIESYSAGKGTKLATYAARCIENEILMHLRVLKKTK
ref|NP_980714.1|          VKKFENTGEDAEDLISIGTIGLIKAIESYSAGKGTKLATYAARCIENEILMHLRVLKKTK
gb|ABY76244.1|            VKKFENTGEDAEDLISIGTIGLIKAIESYSAGKGTKLATYAARCIENEILMHLRVLKKTK
RAAC01814                 MKKFDTSGIDQDDLISIGTVGLIKAVDTYQPSKGTKFATYAARCIQNEILMQLRAQRKSR
                          :***:..*  : :*******:*****::.*...****:*********:*****:**   :*::

ref|YP_148388.1|          KDVSLHEPIGQDKEGNEISLLDILKAEGEDIADEIHLNMELEQVKQYISVLDEREKEVII
ref|YP_001126560.1|       KDVSLHEPIGQDKEGNEISLLDILKSEGQDIVDEIQLNMELEQVKKYISVLDEREKEVIV
ref|YP_896655.1|          KDVSLHDPIGQDKEGNEISLIDILKSESEDVIDMIQLSMELEKIKEYIDILDEREKEVIV
ref|NP_980714.1|          KDVSLHDPIGQDKEGNEISLIDILKSESEDVIDMIQLSMELEKIKEYIDILDEREKEVIV
gb|ABY76244.1|            KDVSLHDPIGQDKEGNEISLIDILKSESEDVIDMIQLSMELEKIKEYIDILDEREKEVIV
RAAC01814                 KDVSLYSPIGTDKEGNEITIGDILFSESDSTEDEVSRRMELNTMRQLLDVLDERERKVIE
                          *****:.*** *******:: *** :*..*  * :   ***: :::  :.:*****::**

ref|YP_148388.1|          NRFGLGRQREKTQREIAKELGISRSYVSRIEKRALMKMFHEFYRQEKEKR---------
ref|YP_001126560.1|       NRFGLGRQREKTQREIAKELGISRSYVSRIEKRALMKMFHEFYRQEKEKR---------
ref|YP_896655.1|          KRFGLGLDKEKTQREIAKALGISRSYVSRIEKRALMKMFHEFVRAEKEKKA--------
ref|NP_980714.1|          KRFGLGLDKEKTQREIAKALGISRSYVSRIEKRALMKMFHEFVRAEKEKKA--------
gb|ABY76244.1|            KRFGLGLDKEKTQREIAKALGISRSYVSRIEKRALMKMFHEFVRAEKEKKA--------
RAAC01814                 LRFGLADGREWTQNEVADSLDISRSYVSRLEKRALLKMFHQSHVAKERKQAIRNARLQP
                          ****. :* **.*:*. *.*********:*****:****:     ::.*:
```

FIG. 18

```
ref|YP_001486125.1|        ---FHDQPILPAVRNMKQFEEFLKSPFTYGVLLDVHLGRLKGIMNEANAHHKKMFVHVDL
ref|NP_388808.1|           MMSFHNQPILPAIRNMKQFDEFLNSSFSYGVILDIHLGQLKGVIKEAQKHGKNMMVHVDL
ref|NP_830819.1|           ---FHEQKILPAVRQIKDLEKLLHSSYEYIVILDIHVGQLKSVISLAKQYCKKVFLHVDL
ref|YP_001643827.1|        ---FHEQKILPAVRQIKDLEKLLHSSYEYIVILDIHVGQLKSVVSLAKQHNKKVFLHVDL
ref|ZP_01696681.1|         ------QRILPASVNMKEFERFLKSDYEIGIFLELHISQLKYVAAMAKAEGKKMIYHVDL
RAAC02673                  MNPFEGRRVLPAVRSLKDFEELMQGPHPVVVLLETNLTALPSLMRMANKAGKRLILHADL
                                 :.***  .:*:::.:::.  .  ::*: ::  *  :    *:    *.:: *.**

ref|YP_001486125.1|        IHGIKHDEYGTEFICQEMKPAGIISTRSSVIVKAKQKKVYAIQRMFLLDTSAMEKSMEFV
ref|NP_388808.1|           IQGIKHDEYGAEFICQDIKPAGIISTRSNVIAKAKQKKIYAIQRLFLLDTSAMEKSMEFI
ref|NP_830819.1|           IHGLQSDGHATEYLCQEFRPYGLLSTKASVIMKAKQKGVVAIQRIFLIDSSAMEKSCNLL
ref|YP_001643827.1|        IHGLQSDGHATEFLCQEYKPYGLLSTKASVIMKAKQKGVVSIQRIFLIDSSAMEKSCNLL
ref|ZP_01696681.1|         IQGLKSDDYATEYLCQEYQPFGLISTKANVIQKAKQKGVVSIQRMFLIDSHALEKSYKLI
RAAC02673                  IQGLKHDEAGTQFLCQMIRPYGIISTHASVIATAKKQGVIAIQRVFLIDSHSLRTSYRVL
                           *:*::  *   .::::**   :*  *::**:..** .**::  :  :***:**:*:  ::..*   ..:

ref|YP_001486125.1|        GKHRPDFIEVLPGVVPNLITEVRERAGIPIFAGGFIRTKEDVERALEAGATAVTTSNTTL
ref|NP_388808.1|           GKHKPDFIEVLPGIVPSLIQEIKEKTGIPIFAGGFIRTEEDVEQALKAGAVAVTTSNTKL
ref|NP_830819.1|           DKTKPDYIEVLPGALTDVIAEVKERTGVPILAGGFIRTVEDVERALNAGATAITTSKREL
ref|YP_001643827.1|        EKTKPDYIEVLPGALTGVIAEVKERTGVPILAGGFIRTVEDVERALNAGATAITTSKKEL
ref|ZP_01696681.1|         ERTKPDYIEVLPGIAPWMITEVKERLGIPIFAGGLIRTREDVEKALKAGAEGITTSDTEL
RAAC02673                  QQAKPDFLEVLPGVVPQLIAEIREQTGLPVLAGGFVRTKEDVERAVAAGATAVTTSVKAL
                            :  :::***    . :*  *::*:  *:*:*:*:. ****:*:  * .:*     * ref|YP_001486125.1|        WK-
ref|NP_388808.1|           WK-
ref|NP_830819.1|           WK-
ref|YP_001643827.1|        WK-
ref|ZP_01696681.1|         WE-
RAAC02673                  WQL
                           *:
```

FIG. 19

```
ref|ZP_01725195.1|      MKRHEAREKALQVLFQLD-NT------DLTVEEAMGH------IKGQPTNA-----FYEK
RAAC02112               MTRHEARECALQALCVLDVQR------DLGSAEAIASA-----LAERGTDAGGDFTYIEE
ref|ZP_00538565.1|      MKRHMARELAVQSLFQMELS-------DLSAQEAIEFA-----VEGKEYD-----TFVTR
ref|YP_148250.1|        MKRHEAREKALQALFQIDVGR-------IPPDEALHNV-----TGGGDIDP-----FLRQ
ref|YP_001126420.1|     MKRHEAREKALQALFQIDVGH-------IPPDEAIGNV-----TGSGEVDP-----FLRQ
ref|NP_390312.1|        MKRRTAREKALQALFQIDVS-------DIAVNEAIEHA-----LDEEKTDP-----FFEQ
                        *.*: *** *:* *  ::        :   **:         :        :    .

ref|ZP_01725195.1|      IVTGTAEHLEEIDATLEQHLEKWSLARLPKIERTVLRLAVYELLYMPETPKRVVLNEAIE
RAAC02112               LVDGTRRHLDEIDELLARHMERWSPERIGRVERNVLRLATYELLFEPELPIASAIDEAVE
ref|ZP_00538565.1|      LVEGVEANKPEIDQKLRAALVNWSFERIGNIERTILRLAVYELLFEAKIPVRVTINEAIE
ref|YP_148250.1|        LVFGVVEHQEEIDELLRANLEKWTLERVANVDRAILRMATYEMKYADDVPVSVSLDEAVE
ref|YP_001126420.1|     LVFDVIEHRAEIDELLRSNLEKWKLERVANVDRVILRMATYEMKYVDDVPVSVSLDEAVE
ref|NP_390312.1|        LVHGVLEHQDQLDEMISKHLVNWKLDRIANVDRAILRLAAYEMAYAEDIPVNVSMNEAIE
                        :* .. :  ::*  :   : .*.  *: .::* :**:*.**: :  . *    ::**:* ref|ZP_01725195.1|      LCKTFGDDSSSKFVNGVLSK----------------------------------------
RAAC02112               IAKTFATEQSGRFVNGVLAKLLPAVADRRRADTREAGQEKRTASAAEPAREGVDDGA
ref|ZP_00538565.1|      LTKAFADEEATKIVNGVLGKVAQEV--------------------------------
ref|YP_148250.1|        LAKKFGDWKSGSFVNGVLSKVKAAL--------------------------------
ref|YP_001126420.1|     LAKKFGDWKSGSFVNGVLSKVKAAL--------------------------------
ref|NP_390312.1|        LAKRFGDDKATKFVNGVLSNI------------------------------------
                        : * *.  .:  :*****.:
```

FIG. 20

```
ref|YP_147113.1|            ------------------------MNTQLLEALADLMREKGISKEVVMEAIEAAIVSAY
ref|YP_001125233.1|         ------------------------MNTQLLEALADLMREKGISKEVIMEAIEAALVSAY
ref|NP_243282.1|            ------------------------MNSEFMDALTTLEKEKGISKEVIIEAIEAALISGY
ref|YP_175727.1|            ------------------------MNSEFMEALSTLEADKGIKKEVIIEAIEAALISGY
ref|ZP_02330483.1|          ------------------------MNSEFIEALSEIEREKGISKDLLIDAIEAAMISSY
RAAC02902                   MRTRGWLWSGDPNAPEISRRGGSLVMNVDFLEALDQLAREKGIDKEVLLEAIEAALIASY
                                                      :::     :   :***.*::::***** :::.* ref|YP_147113.1|            KRNFGQAQNVRVDLNMDTGTIRVFARKDVVEEVADPRLEISLEDAQRINPNYQIGDVVEL
ref|YP_001125233.1|         KRNFGQAQNVRVDLNMDTGTIRVLARKDVVEEVTDPRLEISLEEAQRLNPNYQIGDVVEL
ref|NP_243282.1|            KRNFNQAQNVRVDVNRENGSIRVFARKEVVEEVFDARLEISLDEAKGINPNYEVDDVVEI
ref|YP_175727.1|            KRNFGQAQNVRVDVNRDNGSIRVFARKVVVEEVFDKRLEISEAEAQRINPHYEVDDIVEI
ref|ZP_02330483.1|          KRNFNTAQNVRVDINRQTGVIRVFARKTVVEDVLDPRLEISLTAAREINQNYQLGDIVEI
RAAC02902                   RRNFHSAANVRVEVKRDTGEVHVYARKTVVEEPKDTRLEISLDAARDINPSYQIGDVVEI
                             :***   * ****:::  ..* ::* *** ***:  * *****   *: :*   *::.*:**:

ref|YP_147113.1|            EVTPRDFGRIAAQTAKQVVTQRVREAERSIIYAEFVDREEDIMTGIVQRVDPRFVYVSLG
ref|YP_001125233.1|         EVTPRDFGRIAAQTAKQVVTQRVREAERSIIYAEFVDREEDIMTGIVQRIDPRFVYVSLG
ref|NP_243282.1|            EVTPRDFGRIAAQTAKQVVTQRVREAERGIIYADFIDREEDIMTGIVQRQDNRFIYVDLG
ref|YP_175727.1|            EVTPKDFGRIAAQTAKQVVTQRVREAERGIIYSDFIDREEDIMNGIVQRQDHRFIYVDLG
ref|ZP_02330483.1|          EVTPRDFGRIAAQTAKQVVTQRIREAERGLIYNAFIDKEEDIVTGIVQRQDQRSYYVDLG
RAAC02902                   EVTPRDFGRIAAQAAKQVVMQRVKEAERSVIYSKFADREEEVVSGIVSRLEPRVAYIDLG
                            ****:*********:***** **::****..:**   * *:**::::.***.* : *  *:.**

ref|YP_147113.1|            KAEALLPANEQMPNETYKPHDRLKVYITKVEKTTKGPQIFVSRTHPGLLKRLFELEVPEI
ref|YP_001125233.1|         KAEALLPANEQMPNETYKPHDRLKVYITKVEKTTKGPQIFVSRTHPGLLKRLFELEVPEI
ref|NP_243282.1|            KVEALLPLSEQMPNESYRHNDRIKAYITKVEKTTKGPQIMISRTHPGLLKRLFELEVPEI
ref|YP_175727.1|            KVEALLPLSEQMPNETYKHNDRIKAYITKVEKTTKGPQILISRTHPGLLKRLFELEVPEI
ref|ZP_02330483.1|          KVEAVLPLNEVMPTEKFKHGDRVKAYITKVENTTKGPQIILSRTHPGLLKRLFELEVPEI
RAAC02902                   DTEAILPQSEQMASDKLQVGKRLKVFIARVERTSKGPQIVVSRTHPGLLRRLFELEVPEI
                            ..:  .* *...:.  :   .*:*.:*::**.*:***.:****:******** ref|YP_147113.1|            YDGTVEIKSIAREAGDRSKISVHSDNPEVDPVGACVGPRGQRVQAIVDELNGEKIDIVRW
ref|YP_001125233.1|         YDGTVEIKSIAREAGDRSKISVHSDNPEVDPVGACVGPKGQRVQAIVDELHGEKIDIVRW
ref|NP_243282.1|            YDGTVELKSVAREAGDRSKISVHAENPEVDPVGACVGPKGSRVQTIVNELKGEKIDIVRW
ref|YP_175727.1|            YDGTVEIKSDSVREAGDRSKISVHSDNPEVDPVGACVGPKGQRVQTIVDELKGEKIDIVRW
ref|ZP_02330483.1|          FDGVVEIRSVAREAGFRSKIAVDSRNEEVDPVGSCVGPKGLRVQTIVNELRGEKIDIVRW
RAAC02902                   YEGIVEIKAVAREAGSRSKIAVHSRNPEVDPIGACGARGSRVQAIVNELNGEKVDIVEW
                            ::* :::::: **:*.: * ***.:*:*** :* *::.*:***.* ref|YP_147113.1|            SADPVEFVANALSPAKVLRVIVNEEQKATTVIVPDYQLSLAIGKRGQNARLAAKLTGWKI
ref|YP_001125233.1|         SADPVEFVANALSPAKVLRVIVNEEQKATTVIVPDYQLSLAIGKRGQNARLAAKLTGWKI
ref|NP_243282.1|            SEDPVEYVANALSPSKVVKVNVNEEEKTTQVIVPDYQLSLAIGKRGQNARLAAKLTGWKI
ref|YP_175727.1|            SEDPVVYVANALSPAKVMKVNVLEGEKMTQVIVPDYQLSLAIGKRGQNARLAAKLTGWKI
ref|ZP_02330483.1|          MESTEEYVANALSPSKVLEVNIFEDEKMARVIVPDYQLSLAIGIKGQNARLAAKLTGWKI
RAAC02902                   SEDPATFVANALSPAKVIDVHIYEDERVARTVVPDYQLSLAIGKEGQNARLAARLTGWKI
                             ..  :*****:: * :  * ::  .:*********  .***:**** ref|YP_147113.1|            DIKSESE-------------------------------
ref|YP_001125233.1|         DIKSESE-------------------------------
ref|NP_243282.1|            DIKSESEAQELGLLED-EAASHE---------------
ref|YP_175727.1|            DIKSESEARELGLLDE-ENENDELEEF-----------
ref|ZP_02330483.1|          DIKSETQ-------------------------------
RAAC02902                   DIKSESQMASHSLLDQLEDTNEEEPEFATLSDDWLNEP
                            *****::
```

FIG. 21

```
ref|ZP_01173598.1|      --------------MEKNWYVVHTYSGYENKVKANLEKRVETMAMQDKIFRVIVPEEEETD
ref|YP_848410.1|        --------------MEKNWYVVHTYSGYENKVKANLEKRVESMGMSDKIFRVIVPEEEETE
ref|YP_089786.1|        --------------MEKKWYVVHTYSGYENKVKANLEKRVESMGMQDKIFRVVVPEEEETD
ref|NP_691027.1|        --------------MEKNWYVVHTYSGYENKVKMNLEKRVESMGMEDKIFRVIVPEDEEAE
ref|YP_173640.1|        --------------MEKNWFVVHTYSGYENKVKANLEKRVESMEMTDHIFRVLVPVEEETE
RAAC00415               MGVAGCSPCSMENLEKQWYVIHTYSGYENKVKSNLESRVQTMGMEDRIFRVVVPTEEAVE
                                      :**:*:*:***********  ***.**::* * *:****:** :* .:

ref|ZP_01173598.1|      IKNGKKKVVKRKVFPGYVLVEIVMTDDSWYVVRNTPGVTGFVGSAGSGSKPTPLLPEEVN
ref|YP_848410.1|        VKNGKTKTIKRKVFPGYVLVEIVMTDDSWYVVRNTPGVTGFVGSSGSGSKPTPLLPEEAE
ref|YP_089786.1|        IKNGKKKVVKKKVFPGYVLVELVMTDDSWYVVRNTPGVTGFVGSAGSGSKPTALLPGEAE
ref|NP_691027.1|        IKNGKKKMVKKKSFPGYVLTEMVMTDDSWYVVRNTPGVTGFVGSSGHGAKPTPLMPGEID
ref|YP_173640.1|        IKNGKTKQVSRKVFPGYVLVEMVMTDDSWYVVRNTPGVTGFVGSAGAGSKPTPLMPDEVE
RAAC00415               IKNGKKRVVQRKTYPGYVLVEMIMTDDSWYVVRNTPGVTGFVGSPGAGSKPVPLMPHEVE
                        :****.: :.:*  :*****.*::**********************.* *:**..*:* * :

ref|ZP_01173598.1|      VILKRMGVDEKRVDIDFEIGETVKVNEGPFANFTGSIEEIDKDKAKIKVLVNMFGRETPV
ref|YP_848410.1|        RILKSMGMVEKRAEADFEIGETVMVKEGPFADFSGKVDEMDNDKGKAKVMVNMFGRETPV
ref|YP_089786.1|        KILKRMGLEERKTEIDFELKETVKVIDGPFADFTGTIEEIDHDKNKVKVFVNMFGRETPV
ref|NP_691027.1|        VVLKRMGVSEPTVQVDFEIKENVRVTDGPFTDFTGSIEHIDTDKQKIKVHVNMFGRETPV
ref|YP_173640.1|        RILKQMGVVEAQEEVDFELKESVKVKSGPFADFVGTIEEIQVEKRKLKVHVNMFGRETPV
RAAC00415               QILSSMGVNEAKPVAQFKVGDVVRLTSGPFADMVGTVEEVHPEHQKLKVLVSMFGRETPL
                        :*. **: *    :*:: : * : .***:::  *.:.:.. :: * **  *:.*******:

ref|ZP_01173598.1|      ELDFTQIEKL-
ref|YP_848410.1|        EVDFNQIEKL-
ref|YP_089786.1|        ELEFTQVDKL-
ref|NP_691027.1|        ELDFSQVEKL-
ref|YP_173640.1|        ELEFGQVEKI-
RAAC00415               EADFTQVEHLP
                        *  :* *::::
```

FIG. 22A

```
ref|YP_149235.1|           ------------------------------------------------------------
ref|YP_001127411.1|        ------------------------------------------------------------
ref|YP_001377035.1|        ------------------------------------------------------------
ref|YP_039325.1|           ------------------------------------------------------------
gb|AAU09403.1|             ------------------------------------------------------------
RAAC00475                  --------------------------------MPPGHECEGRCLDIRELEEKKLTEL ref|YP_149235.1|           ---AKQYKISYYSKLTKKELIFAILKARAEQDGLFFMEGILEIIPSEGFGFLRPINYSPS
ref|YP_001127411.1|        ---ARQYKISYYSKLTKKELIFAILKARAEQDGLFFMEGVLEIIPSEGFGFLRPINYSPS
ref|YP_001377035.1|        ---AKEYKISYYSKLTKKELIFAILKARAEKEGFFFMEGVLEIIQSEGFGFLRPINYSPS
ref|YP_039325.1|           ---AKEFKISYYSKLTKKELIFAILKARAEKEGFFFMEGVLEIIQSEGFGFLRPINYSPS
gb|AAU09403.1|             ---AREYKVSYYSKLTKKELVFAILKAQAEQDGLLFMEGVLEIIQSEGFGFLRPINYSPS
RAAC00475                  YKYAREFQIPHYGSMKKKELIFAILKAQAERDGLMFAEGVLEIMP-EGYGFLRPVGYLPS
                              *:::::.:*...:.**:**:::*::* :*:  :***:.* ** ref|YP_149235.1|           SEDIYISASQIRRFDLRNGDKVSGKVRPPKENERYFGLLHVEAVNGEDPEVAKERVHFPA
ref|YP_001127411.1|        SEDIYISASQIRRFDLRNGDKVSGKVRKPKENERYFGLLHVEAVNGEDPEIAKERVHFPA
ref|YP_001377035.1|        SEDIYISASQIRRFDLRNGDKVSGKVRPPKENERYFGLLQVEAVNGDDPESAKERVHFPA
ref|YP_039325.1|           SEDIYISASQIRRFDLRNGDKVSGKVRPPKENERYFGLLQVEAVNGDDPESAKERVHFPA
gb|AAU09403.1|             SEDIYISASQIRRFDLRNGDKVSGKVRPPKENERYYGLLHVEAVNGEDPETSKDRVHFPA
RAAC00475                  QEDIYVAASQIRRFDLRTGDLVSGKVRPPKENERYFGLLHVEAVNGYSPEVAAERLHFAA
                           .**::******. **** ***:*:**** . : :*:**.* ref|YP_149235.1|           LTPLYPNRQMKLETTPDKLSTRIIDLIAPVGFGQRGLIVAPPKAGKTMLLKEIANSITTN
ref|YP_001127411.1|        LTPLYPNRQMKLETTPDKLSTRIIDLIAPVGFGQRGLIVAPPKAGKTMLLKEIANSITAN
ref|YP_001377035.1|        LTPLYPNRQMKLETEPKKLSTRIMDLIAPVGFGQRGLIVAPPKAGKTILLKEIAHSITTN
ref|YP_039325.1|           LTPLYPDRQMKLETEPKKLPTRIMDLIAPVGFGQRGLIVAPPKAGKTSLLKEIAHSVTTN
gb|AAU09403.1|             LTPIYPNEQMLLETQPRSFSTRIIDLISPIGFGQRGLIVAPPKAGKTMLLKEIANSITTN
RAAC00475                  LTPLFPSKRIVLETTPENLATRLIDLFAPIGFGQRGMIVAPPKAGKTVLLKEIAHSIATN
                           ***::*..:: *** *  .:.:::*:**** :****** ****:*:::* ref|YP_149235.1|           HPDVELIVLLIDERPEEVTDIERSVQGDVVSSTFDEVPENHIKVAELVLERAMRLVEHKR
ref|YP_001127411.1|        HPDVELIVLLIDERPEEVTDIERSVQGDVVSSTFDEVPENHIKVAELVLERAMRLVEHKR
ref|YP_001377035.1|        HPEAELIVLLIDERPEEVTDIERSVKGDVVSSTFDEVPENHIKVAELVLERAMRLVEHKK
ref|YP_039325.1|           HPEAELIVLLIDERPEEVTDIERSVKGDVVSSTFDEVPENHIKVAELVLERAMRLVEHKK
gb|AAU09403.1|             HPDAELIVLLIDERPEEVTDIERSVDGDVVSSTFDEVPENHIKVAELVLERAMRLVEHKK
RAAC00475                  YPDVHLFVLLIDERPEEVTDMQRSVKGEVIASTFDEVPENHIKVSELVLERALRLVEHKQ
                           :*:...*:************:.***.*:*::*************:******:******:

ref|YP_149235.1|           DVVILMDSITRLARAYNLVIPPSGRTLSGGIDPAAFHRPKRFFGAARNIEEGGSLTILAT
ref|YP_001127411.1|        DVVILMDSITRLARAYNLVIPPSGRTLSGGIDPAAFHRPKRFFGAARNIEEGGSLTILAT
ref|YP_001377035.1|        DVVILMDSITRLARAYNLVIPPSGRTLSGGIDPAAFHRPKRFFGAARNIEEGGSLTILAT
ref|YP_039325.1|           DVIILMDSITRLARAYNLVIPPSGRTLSGGIDPAAFHRPKRFFGAARNIEEGGSLTILAT
gb|AAU09403.1|             DVVILMDSITRLARAYNLVIPPSGRTLSGGIDPAAFHRPKRFFGAARNIEDGGSLTILAT
RAAC00475                  DVVILLDSLTRLTRAYNLVVPPSGRTLSGGIDPAAFHRPKRFFGAARNVEEGGSLTILAT
                           **:**:**:***:******:***********************:*:*********
```

FIG. 22B

```
ref|YP_149235.1|       ALIDTGSRMDDVIYEEFKGTGNMELHLDRSLAERRIFPAIDIRRSGTRKEELLIPKEHLE
ref|YP_001127411.1|    ALVDTGSRMDDVIYEEFKGTGNMELHLDRSLAERRIFPAIDIRRSGTRKEELLIPKEHLD
ref|YP_001377035.1|    ALVDTGSRMDDVIYEEFKGTGNMELHLDRSLAERRIFPAIDIRRSGTRKEDLLIPKEHLD
ref|YP_039325.1|       ALVDTGSRMDDVIYEEFKGTGNMELHLDRSLAERRIFPAIDIRRSGTRKEDLLIPKEHLD
gb|AAU09403.1|         ALIDTGSRMDDVIYEEFKGTGNMELHLDRSLAEKRIFPAIDIRRSGTRKEELLIPKEHLD
RAAC00475              ALIDTGSRMDDVIYEEFKGTGNMELHLDRRLAEKRVFPSIDIRRSGTRREEALMPKEELE
                       **:************************ ***:*:**:*********:*: *:***.*:

ref|YP_149235.1|       KLWAIRKTMADSPDFIERFLNKLRRTKSNEEF----------------------------
ref|YP_001127411.1|    KLWAIRKTMADSPDFIERFLNKLRRTKSNEEF----------------------------
ref|YP_001377035.1|    KLWGIRKTMRDTPDFVESFLRKLRQTKTNEEFLQNI------------------------
ref|YP_039325.1|       KLWGIRKTMRDTPDFVESFLRKLRQTKTNEEFLQNI------------------------
gb|AAU09403.1|         HLWAIRKSMADAPDFAEKFLKRLRQTKTNEEFFSMLT-----------------------
RAAC00475              KVWAIRKSMGDNQDFTEMFLRKFRHYKTNKEFLDSLSLNRVERKPVASAEKPAAQPVTSE
                       ::*.***:* *  ** * **.::*: *:*:**

ref|YP_149235.1|       -
ref|YP_001127411.1|    -
ref|YP_001377035.1|    -
ref|YP_039325.1|       -
gb|AAU09403.1|         -
RAAC00475              T
```

FIG. 23A

```
ref|YP_001488275.1|      ---------------LYKQMLDLIDVGVHAIDENGHTVVYNKKMMEIESLKRSDVLHKNVL
ref|YP_173520.1|         ---------------LYQMLIDEINVGIHVIDQDGHTIIYNKKMMEIESMVDTDVLHKNLL
ref|ZP_01173129.1|       ---------------ILEQILEHVDAGIHAIDHEGRTIIYNRKMAEIEGMDPESVIGRSLL
ref|ZP_01696484.1|       ---------------LYETIMNLVDAGIHAVDEEGRTMIYNQKMRDIEGMDSREVLYKKLE
ref|ZP_02171541.1|       MQPEKLTDTAFIHPVYRKLLDYLDIGIHMINTEGRSVIYNRKMSEMEDMNPKEVLNKRIM
RAAC02984                ---MEPSVVADVWKLYQEILEFAPVGVHAVDREGRTRVYNRVMGEIDGYRPDEVLEKNVF
                                         :  . ::    *:*  :: :*::  :**: *  :::.     .*:  : :

ref|YP_001488275.1|      DFFAFQDEMHSTLVQALRTGKQTVHAKQTYHNYNGKEITTINHTYPLVRDG---------
ref|YP_173520.1|         EVFTFHDDERSTLVQALKTGKVTKDVKQTYFNNKGEEITTINNTFPFIENG---------
ref|ZP_01173129.1|       EVFPFSRREDSTLLLALQNGKGTQPAKQTYFNSKGKEITAINHAIPILAAG---------
ref|ZP_01696484.1|       DVFRFRSSEESTLLKALKTGEESHLVKQTYFNNKGREITSVNHTYPFYYKG---------
ref|ZP_02171541.1|       EIFLFDSEEESRLLQALNNNVVHKDAKQVYFNFKGQEITTVNNTFPLTVDG---------
RAAC02984                ELYELD-EETSTLWRALKTGHPVQIDEQVYVARNGRRVVTQNRTKPVVIAG---------
                         :.: :    * *  **...     :*.*   :*..:.: *.:  *.    * ref|YP_001488275.1|      --LIQGAVE--ISNDVTKLERLIHHNMKKKGSTRFTFESIIGQSPAFLEVIEHAKRATRT
ref|YP_173520.1|         --KITAAVE--IAKDMTQLDHVIKKNVLRKRESHYTFDQIIGNSKAFLAVIEEAKRAART
ref|ZP_01173129.1|       --KSLGAIE--IAKDVSRIERLVKENLSRKNSDRYTFESIIGSSKAILEVVEAAKRAVRT
ref|ZP_01696484.1|       --KLAGAVE--IAEDITKIERLIRRN--HESHTGYTFHHIIGKSKAISEVIEFSRRAART
ref|ZP_02171541.1|       --EKIGAVE--IARDITKLERLSRETSRGASDARFTFDQIIGNSPAIEDVVENARRATRT
RAAC02984                --EIIGAME----IAVPREAGGAQEAADARIRRRYSFADILGESRAMQRALDLAERAARM
                           .*:*        :.:       :.           ::*  *:*.* *:  .: :.**.* ref|YP_001488275.1|      SSYVLIVGETGTGKELFAQSIHNGSSRSSGPFITQNCAALPDNLIESLLFGTQKGAFTGA
ref|YP_173520.1|         SSSVLIVGETGTGKELFAQSIHYASPRSHAPFLAQNCAAIPENLMESLLFGTKKGAFTGA
ref|ZP_01173129.1|       TSPILIAGETGTGKELFAQSIHSGSLRSPGPFVAQNCAALPENLVESILFGTKKGAFTGA
ref|ZP_01696484.1|       SSYVLIIGETGTGKELFAQSIHYESERSRGPFIAQNCAALPDNLIESILFGTKKGAFTGA
ref|ZP_02171541.1|       TSSVLIYGETGTGKELFAQSIHNGSSRASKPFISQNCAALPDTLIEGILFGSVKGAFTGA
RAAC02984                DLPVLLVGETGTGKELFAQAIHGSARKHGPFLAQNCAAWPEGLAESVLFGTRRGGFTGA
                          .*: **********:  *  *   :.***  *:  * *.:***. :*.**** ref|YP_001488275.1|      ADQPGLFEQAQGGTLLLDEINSLNPHLQAKLLRVLQEKRVRRLGSTKEIAVDVRVIANMN
ref|YP_173520.1|         LDTPGLFEQADGGTLLLDEINSLDPALQAKLLRVIQEKTIRRIGDTKDKKVDVRIIATIN
ref|ZP_01173129.1|       VDRPGLFEQAEGGTLLLDEINSMPAPLQAKLLRVLQEKKVRRIGDTKDREIDVRVVAAIN
ref|ZP_01696484.1|       VDRAGLFEQADGGTLLLDEINALNIHLQAKLLRVLQEKKVKRIGGTQEKPVDVRVIATMN
ref|ZP_02171541.1|       TDHPGLFEQANGGTLMLDEINSLSASLQAKLLRAIQEKTIRRIGDTKSRSVDVRIIATMN
RAAC02984                VDRAGVFELACGGTLLLDEVHAMSPSVQAKLLRALQDGEVWPIGARRSVQTDVRVIAAMN
                         *  .*:**  *  **:*:::      :******.:*:     :*   :.    ***::*  :* ref|YP_001488275.1|      EDPVDAIASGRMRKDLFYRLGIVTLFIPPLSERKEDIPTFVNHFIQKYNELFQMKVKAAD
ref|YP_173520.1|         EDPIDMIAKQRLRKDLYYRLSVVTLFIPPLRERKEDILPLIEEFIHKYNTLFQMNVKTIS
ref|ZP_01173129.1|       EDPVDAIAEGRLRKDLYYRLSAVSLFIPPLRERKEDILLLSSFFIQKYNDWFGMEVPGLD
ref|ZP_01696484.1|       ETPYEAIANHRLRKDLYYRLGVVTLFIPPLRDRLEDLPLLTGHFIQKYNPLFQMNVRGIT
ref|ZP_02171541.1|       EDPVDALSKNKLREDLYYRLSVVSIVIPPLRHRKEDLTVLIAHFIRKYNRLFQMNIQEVT
RAAC02984                VPPSAALSRGLVRPDLLYRIGAIAIHLPPLRERPEDIPLLAQAFLRRYG---EARAVRLS
                              *     ::   :* **  **:.  :::   :*** .* **:   :       *:::*.        .

ref|YP_001488275.1|      EEVLALFKAYDWPGNVRELEHVIEAGMNMMMMDEDELSMHHLPYHFRFKQMEGRPPAQLQT
ref|YP_173520.1|         EEAKAILFQHDWPGNARELEHTIEGTMNFISDETEIHIHNLPFRLRNR------------
ref|ZP_01173129.1|       EETEEQFLRYDWPGNIRELEHVIEGAMNMAEDDARITSEILPHHFRQK------------
ref|ZP_01696484.1|       PEVLTFFFRSYRWPGNIRELEHMIEAAMNVMLDEDMIELRHLPMQYRQSGH---------
ref|ZP_02171541.1|       DDVFNLFSEYDWPGNVRELEHTIEGAMNLIYDDEPIGFQHLPLHLKHKFTQP--------
RAAC02984                SDAMAFLTSHDWPGNVRELEQTVRSALALWPEAREITSEMLRS----------------
                         :.   :   :   ****  ****  :..    :.  .    :     . *
```

FIG. 23B

```
ref|YP_001488275.1|    NSLQQTVAADTFVYTSPEQTTDFQTQMERFEKQYIVHYLEKMDDNISQTAKLLGMSRQSL
ref|YP_173520.1|       ---YQKEVKDTETGNLPAKT--LQEKMAEVEKLYILQALRENNNNVSQTAKNLGMSRQNL
ref|ZP_01173129.1|     -AETSHSFPGRNLGEPAGPQPSLSDYVASAEKAYINKVWREQDGNITRTAKILGMSRQNL
ref|ZP_01696484.1|     ------------FNSPAEKSPLLKDRLFEYEKHCILEALEANGSNISKAAEQLGLSRQSL
ref|ZP_02171541.1|     --PATSEGTERLFTQQPEPGLPLETYMDTVEKAYIQKSLTEAGGNISQAARTLGLKRQSL
RAAC02984              --------AHPLLGEGAPRELERVARAARPSDDAIRRAYEAASGNLTHAAQALGISRQRM
                               .              ..  *  .      ..*::::*. **:.**  :

ref|YP_001488275.1|    QYRMKKL---------
ref|YP_173520.1|       QYRLKKFHL-------
ref|ZP_01173129.1|     QYRIKKHGL-------
ref|ZP_01696484.1|     QYRMKRLGI-------
ref|ZP_02171541.1|     QYRMRKFNL-------
RAAC02984              QYHVRRLGLRTSSQPK
                       **::::
```

FIG. 24A

```
ref|YP_090070.1|      ------------------------------------------------------------
ref|YP_077660.1|      ------------------------------------------------------------
ref|NP_244812.1|      ------------------------------------------------------------
ref|ZP_02171541.1|    ------------------------------------------------------------
ref|ZP_01173129.1|    ------------------------------------------------------------
RAAC02994             MIRRARIRAGSTCTIEANFVPNGQRRCRAGGAADRTGAKRALRFSDSDCKLGLHADLDRR ref|YP_090070.1|      ------------------------------------------GLHVVDENGTSVVYNKKM
ref|YP_077660.1|      ------------------------------------------GLHVVDENGTSVVYNKKM
ref|NP_244812.1|      ------------------------------------------GIHVIDTFGQTIIYNKKM
ref|ZP_02171541.1|    ------------------------------------------GIHMINTEGRSVIYNRKM
ref|ZP_01173129.1|    ------------------------------------------GIHAIDHEGRTIIYNRKM
RAAC02994             HKALCILMQARLEHAERRRGMRAQDAEARRTLLEAALDALDEGVHVVDAEGVTVFYNRKM
                                                                *:*  ::   *  ::.**:**

ref|YP_090070.1|      SQIEGMDVGDVLGKNVLDVFTFASQHDSTLLQALHHGKTNKNVKQTYFNNKGQEITTVNH
ref|YP_077660.1|      SQIEGMDVGDVLGKNVLDVFTFASQHDSTLLQALIHHGKTNKNVKQTYFNNKGQEITTVNH
ref|NP_244812.1|      MEIESLTKEDVENKDFLDIFMFEEGQGSTLLEALYKKKHSKDVKQTYFNNRGKEITTINN
ref|ZP_02171541.1|    SEMEDMNPKEVLNKRIMEIFLFDSEEESRLLQALNNNVVHKDAKQVYFNFKGQEITTVNN
ref|ZP_01173129.1|    AEIEGMDPESVIGRSLLEVPFSRREDSTLLLALQNGKGTQPAKQTYFNSKGKEITAINH
RAAC02994             ADIEAMSRQDVMGRRIDDVFSFPDAAGSTLLDAVRRGVRRDDVRQTYFNRRGQAITTVNR
                       ::*   :   .* .:. ::* *    * ** *: .    . .:*.*** :*: **:*:.

ref|YP_090070.1|      TFPIMENGNTKGAVEIAKDVTKLERLIRENMNKTESTKYTFDSLIGVSPAFKEVIEHAKR
ref|YP_077660.1|      TFPIMENGNTKGAVEIAKDVTKLERLIRENMNKTESTKYTFDSLIGVSPAFKEVIEHAKR
ref|NP_244812.1|      TFPLYENGQVIGAIEISKDVTKLERLIRKNMESKGNTRYTFDSIIGESTAIREVIENTKR
ref|ZP_02171541.1|    TFPLTVDGEKIGAVEIARDITKLERLSRETSRGASDARFTFDQIIGNSPAIEDVVENARR
ref|ZP_01173129.1|    AIPILAAGKSLGAIEIAKDVSRIERLVKENLSRKNSDRYTFESIIGSSKAILEVVEAAKR
RAAC02994             TFPVYADGRILGAVEIARDVTSVEQLRSTAFGQAG-VRYTFASIIAESLAMREVLEQARR
                       ::*:    *.  ::* :.*::  :*:*          ::** .:*. * *: :*:* ::* ref|YP_090070.1|      ATRTSSSILIVGDTGTGKELFAQSIHNGSQRSTGPFISQNCAALPESLVEGLLFGTVKGA
ref|YP_077660.1|      ATRTSSSILIVGDTGTGKELFAQSIHNGSQRSTGPFISQNCAALPESLVEGLLFGTVKGA
ref|NP_244812.1|      ATRTSASSVLIVGETGTGKELFAQSIHNGSDRSKGPFISQNCAAMPETLIESLLFGTKKGA
ref|ZP_02171541.1|    ATRTTSSVLIYGETGTGKELFAQSIHNGSSRASKPFISQNCAALPDTLIEGILFGSVKGA
ref|ZP_01173129.1|    AVRTTSPILIAGETGTGKELFAQSIHSGSLRSPGPFVAQNCAALPENLVESILFGTKKGA
RAAC02994             AARTDSSVLIIGETGTGKELLAQGIHAASPRRDGPFVSQNLAAIPDTLVEGILFGTARGA
                      *.** *.:** *:*******:**.** .* * *      **::** **:*:.*:*.:***: :**

ref|YP_090070.1|      FTGAVDRPGLFEQADGGTLLLDEINSLDFRLQAKLLRAIQEKTIRRIGASKDTPIDVRII
ref|YP_077660.1|      FTGAVDRPGLFEQADGGTLLLDEINSLDFRLQAKLLRAIQEKTIRRIGASKDTPIDVRII
ref|NP_244812.1|      YTGAIERPGLFEEAEGGTLLLDEINSLPPLQAKLLRAIQEKQIRRVGDTVDRKVNVRII
ref|ZP_02171541.1|    FTGADHPGLFEQANGGTLMLDEINSLSASLQAKLLRAIQEKTIRRIGDTKSRSVDVRII
ref|ZP_01173129.1|    FTGAVDRPGLFEQAEGGTLLLDEINSMPAPLQAKLLRVLQEKKVRRIGDTKDREIDVRVV
RAAC02994             FTGAVDRPGLIEQANGGTLLLDELNAMPAPLQAKLLRVLQERVVRRVGDLKDRPVDVRIL
                      :***   ::***:*:*:****:***.*::        *******.:**:  :**:*    . ::**::

ref|YP_090070.1|      ATMNEDPVDAVSGQRLRKDLYYRLSVVTLFIPPLKDRKEDIMPLTQHFIDKYNALFQMEV
ref|YP_077660.1|      ATMNEDPVDAVSGQRLRKDLYYRLSVVTLFIPPLKDRKEDIMPLTQHFIDKYNALFQMEV
ref|NP_244812.1|      STINEDPIEAIASGRLRKDLYYRLGVVTLFIPPLRERKEDIVPLVDHFIAKYNERFQMEV
ref|ZP_02171541.1|    ATMNEDPVDALSKNKLREDLYYRLSVVSIVIPPLRHRKEDLTVLIAHFIRKYNRLFQMNI
ref|ZP_01173129.1|    AAINEDPVDAIAEGRLRKDLYYRLSAVSLFIPPLRERKEDILLLSSFFIQKYNDWFGMEV
RAAC02994             ATMNEDPGRAIREGRLRADLFYRLSVVTLTVPPLRSRREDIPPLVAHFIRRLNGAFGLRV
                      :::.****  *:    :** **:***..*::  :***: *:**:  * .**  *  *:::
```

FIG. 24B

```
ref|YP_090070.1|      KGFEEEVRRFLLSYDWPGNVRELEHLIEGAMNLMSYEDKIELTHLP--LQYRTKPAAKEQ
ref|YP_077660.1|      KGFEEEVRRFLLSYDWPGNVRELEHLIEGAMNLMSYEDKIELTHLP--LQYRTKPAAKEQ
ref|NP_244812.1|      KGLSDEVTQLLLQYDWPGNVRELEHIIEGAMNLMIGEDLIDVRHLP--FHFRQKSLSAPL
ref|ZP_02171541.1|    QEVTDDVFNLFSEYDWPGNVRELEHTIEGAMNLIYDDEPIGFQHLP--LHLKHKFTQPPA
ref|ZP_01173129.1|    PGLDEETEEQFLRYDWPGNIRELEHVIEGAMNMAEDDARITSEILP--HHFRQKAET---
RAAC02994             EGCEPRLMDAFLAYEWPGNVRELEHVIEGAMNLMEDEAKIGFQHLPGHVRRRLEQALDEM
                        : *:****:***** ******:    :   *     **    : : :

ref|YP_090070.1|      L---PQQGYDLFA-----PLPSASAAPL--------------KEQIENAE---KYYIQK
ref|YP_077660.1|      L---PQQGYDLFA-----PLPSASAAPL--------------KEQIENAE---KYYIQK
ref|NP_244812.1|      S----SQITSVYETGPSDAIEHSVEEQQP----------LRDLKDYLLEAE---KMYIKK
ref|ZP_02171541.1|    T----SEGTE--------RLFTQQPEP-----------GLPLETYMDTVE---KAYIQK
ref|ZP_01173129.1|    -----SHSFPGRN------LGEPAGPQ-------------PSLSDYVASAE---KAYINK
RAAC02994             QGNEDQGGRDARAEVVREPTPQGASDEIP----------RGRPSFRDLVRDYARTVLQA
                          .                                          ..   :   ::

ref|YP_090070.1|      TVKKCNYNVSQAARVLGISRQSLQYRLKK----------
ref|YP_077660.1|      TVKKCNYNVSQAARVLGISRQSLQYRLKK----------
ref|NP_244812.1|      ALERNKYHVTKTAEKLGLSRQSLQYRMKRLGI-------
ref|ZP_02171541.1|    SLTEAGGNISQAARTLGLKRQSLQYRMRK----------
ref|ZP_01173129.1|    VWREQDGNITRTAKILGMSRQNLQYRIKK----------
RAAC02994             ALEETRGNVSEAARRLGMSRQNLQYWLREVAVDPARYRR
                      .    :::.:*. **:.**.***  ::.
```

FIG. 25

```
ref|YP_177603.1|           --KKGLGKGLQAFFPEQE--DKQEEQ-IVQVDLADVRPNPYQPRKTFSEEALKELSNSIR
ref|NP_244925.1|           ---KGLGKGLNAFFPEAA--DETTEQ-VEEVKLLELRPNPYQPRKTFLEEALQELADSIK
ref|ZP_02172038.1|         ---KGLGKGIGAFFPDSERYEESDSQGAQNIKIKDLRPNPYQPRKHFDDEAIDELRQSIE
ref|YP_001423363.1|        MAKGGLGKGINALFNQVD---LSEET-VEEIKISDLRPNPYQPRKQFDDESLAELKESII
RAAC00039                  MAKRGLGRGLDALIPQLN---VSDEDQIVQIDIRDLRPNPYQPRRTFNEEKLQELCNSIR
ref|ZP_02327875.1|         MSKR-LGRGLDALLPSMD---IEDDDKVIEIPLSKLRANPYQPRKSFNEDGIQELAASIK
                               **:*: *::  .         .  :: : ..:*.****** : * :: : ** **

ref|YP_177603.1|           EHGILQPVTVRKA-IKGYEIVMGERRVKAAKQAGLTQIPVIVQELDENKMMEIALIENLQ
ref|NP_244925.1|           EHGILQPIVVRKSSVKGYEIVVGERRFRAAERAGLVKVPVVIRELDDQKMMEMALIENLQ
ref|ZP_02172038.1|         QHGILQPLVVRKS-IKGYEIVVGERRYRAAKAAKLDSVPAIVRELTDDEMMELALIENLQ
ref|YP_001423363.1|        QHGILQPIIVRKS-LKGYDIVAGERRYRAAKLAGKETVPAIVRDLSESLMREIALLENLQ
RAAC00039                  EHGILQPLIVRRSQVKGFDIVAGERRYRAAKMAGLQVVPAVVRDLSDVLLMEIALIENLQ
ref|ZP_02327875.1|         EHGVIQPIIVR-SVLKGYEIIAGERRFRASQACGLKSIPAVVKKFSDQQVMEIALIENVQ
                           ::::  : :::*: **** :*::   :*.::::.:  :  : *:::* ref|YP_177603.1|           REDLNPIEEAIAYEKLMEHTNSTQEQLAKRLGKSRPHIANHMRLLQLPKVVQEFISVGKL
ref|NP_244925.1|           REDLNPIEEANAYEKLMTHLQMTQEQLAVRLGKSRPHIANHLRLLQLPKVVQEFISEGKL
ref|ZP_02172038.1|         REDLNPLEEAKAYKKLMEHLSLTQDQLSVKLGKSRPHIANYLRLLQAPQIVQQYLQEEKI
ref|YP_001423363.1|        REDLSPLEEALAYDSLLKHLDLTQEQLAKRLGKSRPHIANHLRLLTLPESIQNLIAEGTL
RAAC00039                  REDLNPIEIADAYAKLIEKCHLTQDELAKRVGQSRSHITNMLRLLQLPAQIQDMVSRGTL
ref|ZP_02327875.1|         REDLNALEIAIAYQAIIDQFSLTQEELSAKVGKSRSHIANFLRLLTLPDSIKQHVSRGTL
                           ****..:* *  **   ::  :   **::*:  ::*:**.**:* :*** *   :: :  .:

ref|YP_177603.1|           TMGHGRALLGLQDKQKLSQLLEKVLQDKLSVREVEQLVQRLNEHVPRETKQVK-VKLPPI
ref|NP_244925.1|           SMGHGRALLGLANKNEISSVLNKILEEKLSVRQVEALVQQMNERVSRGTKKAK-PKLSPF
ref|ZP_02172038.1|         STGHARALLGLKEDKKLSPLLQKTIKEQWSVRHLESVIHDMNENVSRETSKGK-PALDVY
ref|YP_001423363.1|        SMGHGRTLLGLKNKDKLEPLVKKVVEEQLNVRQLEQLIQQLNNNVPRETKKKE-PVQDVV
RAAC00039                  TMGHARALLSVEDAEEQLRLAEQTVKEAWSVRKLEMVIYQP-KKVSRETDK---PALPTE
ref|ZP_02327875.1|         SMGHARAIVGVKDNQKKQILADACIREQWSVRQLEEEIKKLEGNSGNAKKKSKDKKRDPY
                           : **.*:::.:  .:    :  . ::   .**.**:*    .    . ...:

ref|YP_177603.1|           IKEQQERLRDTLGTSVLIKPGKKKGKIEIDYFSEDDLERILSLLV----
ref|NP_244925.1|           LKERQDFLRSHFGTSVAIKKGKKKGKIEIEFFSDDDLERILEML-----
ref|ZP_02172038.1|         LKDREAFLKSYFGTNVTIKQGKKKSKIEIDFFDDDDLQRILRLMSA---
ref|YP_001423363.1|        LKERESYLQNYFGTTVNIKRQKKKGKIEIEFFSNEDLERILELL-----
RAAC00039                  YRRYQEQVQAYLGTSVRIQPGKKRGKIEIDYYSEDDLRRIMDLMLAHAP
ref|ZP_02327875.1|         IQQVEDQLRDVYRTTVKIKHQKNKGKIELLYYSNDDLERLLDML-----
                            :    :  ::    *.* *:   *::.***:  ::.:**.*:: ::
```

FIG. 26

```
ref|NP_243941.1|              ---------------KPLLTKREREVFELLVQDKTTKEIAEQLFISEKTVRNHISNTMQK
ref|YP_176156.1|              ---------------KPLLTKREREVFELLVQDQTTKEIANHLFISEKTVRNHISNTMQK
ref|YP_080133.1|              ----------KEFQSKPLLTKREREVFELLVQDKTTKEIASELFISEKTVRNHISNAMQK
ref|YP_001376422.1|           -------------QSKPLLTKREREVFELLVQDKTTKEIASELFISEKTVRNHISNAMQK
ref|YP_001422137.1|           ----------KDFQSKPLLTKREREVFELLVQDKTTKEIASELFISEKTVRNHISNAMQK
RAAC02034                     ------MAPVKDGRGKSLLTNREREVFELLVQDKTTKEIASQLFVSEKTVRNHISNVMKK
                                    *.*.********:**..:**********.*:* ref|NP_243941.1|              LGVKGRSQAVIELIRLGELEI
ref|YP_176156.1|              LGVKGRSQAVIELIRLGELTI
ref|YP_080133.1|              LGVKGRSQAVVELLRMGELEL
ref|YP_001376422.1|           LGVKGRSQAVVELLRMGELEL
ref|YP_001422137.1|           LGVKGRSQAVVELLRMGELEL
RAAC02034                     LNVKGRSQAVVELVRLGEITI
                              *.********:**:*:**:  :
```

FIG. 27

```
ref|NP_242122.1|         ----------VRQDAWSHEDDVFLAETVLKHIEEGSTQLRAFDEVGDVLNRTSAACGFRW
RAAC00092                MSETRQKDRAMRQDAWTTEDDEILAEIVLKHIKQGSTQLAGFNEAARRLGRTAAACGFRW
ref|ZP_01697682.1|       ----------AVRQDAWTQEEDLLLSDIVLRHIREGSTQLRAFEEAGKRMNRTAAACGFRW
ref|ZP_01860230.1|       -----------RQDAWSQDEDLLLAEVVLRHIREGGTQLQAFEEVGRKLSRTAAACGFRW
ref|YP_146960.1|         ----------VRQDAWTKEEDELLANVVLQYIREGGTQLEAFAEVGRRLSRTAAACGFRW
ref|YP_001125095.1|      ----------VRQDAWTKEEDELLANVVLEYIRTGGTQLEAFAEVGRRLSRTAAACGFRW
                                   *****: ::* :*:: **.:*. *.*** .* *..  :.:***** ref|NP_242122.1|         NAVVRQRYVKQIAEAKKERKRRKRAASYAYQLYPTA-------SQQPVVLTGEATSLTLP
RAAC00092                NACVRKQQRYRIELAKEERKKNK-SQRVQAQLEGGD-------ADHP-----TATLMTWA
ref|ZP_01697682.1|       NSYVRKQYASEIEAAKKERKE-KKQLVRDSGRAPAE--------------EGQQTEATLF
ref|ZP_01860230.1|       NSFVRKQYKSGIELAKRQRKESKKQPVPSPAREVKQPDVKHEVASADKKVEPQSSKVTLN
ref|YP_146960.1|         NSCVRKQYKEEIEQAKQERKMRKKETPSTKESEGQE----------KVEAAVKSHLSWA
ref|YP_001125095.1|      NSYVRKQYKEEIEQAKQERKTRKKETASEKDGRGQP----------EMEAAVESKLSWA
                         *: **::   * **:** *                                    :  :

ref|NP_242122.1|         ---MVIEFL-QQLATHQVA---DGQTRKEQEELMK---QNEQLQERNKELEKEL---QKI
RAAC00092                ---QVLRFLRQEKNTAQEW---ASRWRSTERQLNEWKAKYEALEADYKRVCEEL---REL
ref|ZP_01697682.1|       ---DAIRILQQLAEKSRHE---SGQLSASRRGTEEWKSK---YEALLQKY-------LEE
ref|ZP_01860230.1|       ---GVIEFLEGLKDNLNQ----DKELESAYKKLEEYVGK---IEQQLEKLKEEN---SVY
ref|YP_146960.1|         ---EVLAFLQAEEQKARD----ARRTADENRAL---KNDMEQLQQMVTKLQMEK---ESL
ref|YP_001125095.1|      ---EVLAFLQAEGQKARE----IRRTADENRAL---KNDMEQLQQMVTKLQMEK---EAL
                            .: :*     .   .        .     .           .      .

ref|NP_242122.1|         KQEHSIIEEDYQSMIQIMNRARRMAILQDD--EPASTQAF--KMDKNGNLEKI-------
RAAC00092                KSTHDAITRDYKALLEIMERARKAALLDDDLIGPKFAEGFMYRIDEYGNLERITTGERME
ref|ZP_01697682.1|       KEKHEQLQKEYSALLSIMEKARQLS---EQD-----------------------------
ref|ZP_01860230.1|       KEKLELLEEDHQSLLSIFEKARKMALLQESDDKVKF------QMDKNGNLQRL-------
ref|YP_146960.1|         QKQLAAIQEEYKTLLSIMERARK-------------------------------------
ref|YP_001125095.1|      QKQLAAVQEEYKTLLTIMERARK-------------------------------------
                         :.       : .::.::: *:::**:

ref|NP_242122.1|         ---
RAAC00092                QAE
ref|ZP_01697682.1|       ---
ref|ZP_01860230.1|       ---
ref|YP_146960.1|         ---
ref|YP_001125095.1|      ---
```

FIG. 28

```
ref|YP_001125095.1|        --------VRQDAWTKEEDELLANVVLEYIRTGGTQLEAFAEVGRRLSRTAAACGFRWNS
ref|YP_146960.1|           --------VRQDAWTKEEDELLANVVLQYIREGGTQLEAFAEVGRRLSRTAAACGFRWNS
ref|YP_896293.1|           ----EMATTRQDAWTDDEDLLLAEVVLRHIREGGTQLSAFKEVGRHLSRTPAACGFRWNS
ref|ZP_02261942.1|         --------RQDAWTDDEDLLLAEVVLRHIREGGTQLSAFKEVGRHLSRTPAACGFRWNS
ref|NP_389392.1|           --------RQDAWTQDEDLLLAEVVLRHIREGGTQLSAFEEVGRALTRTAAACGFRWNS
RAAC02454                  MASVEKSPVRSDAWTAEDDERLAQLVLRHIRTGSTQLKAFEEAAEQLGRTAAACGYRWNG
                                    *.****  :.*  **::**.:** *.***.**  *... * **.****:***.

ref|YP_001125095.1|        YVRKQYKEEIEQAKQERKTRKKETASEKDGRGQP-----EMEAAVESKLSWAEVLAFLQA
ref|YP_146960.1|           CVRKQYKEEIEQAKQERKMRKKETPSTKESEGQE-----KVEAAVKSHLSWAEVLAFLQA
ref|YP_896293.1|           YVRKQYKERIEEAKQLRKVEHYEVKETKVLEP--------------KSITLNDVIDFLQN
ref|ZP_02261942.1|         YVRKQYKERIEEAKQLRKVEHYEVKETKVLEP--------------KLITLNDVIDFLQN
ref|NP_389392.1|           YVRKQYQSGIELAKKQRKELRKQIGVHSVNMPNSMKQTASASSEGKRDLSIQDVIQFLEQ
RAAC02454                  VIRKRYRDEIEAAKAERKALHVKTQTQKAATAP--------------TASMQEVIRFLQT
                            :**:*:. ** ** **  :  :                         :  :*: **:

ref|YP_001125095.1|        EGQKAREIRRTADENRALKNDME-QLQQMVTKLQMEKEALQKQLA-----------AVQE
ref|YP_146960.1|           EEQKARDARRTADENRALKNDME-QLQQMVTKLQMEKESLQKQLA-----------AIQE
ref|YP_896293.1|           YKD--------------ENSLM-VLQQQIESLQTEKESLLERLS-----------VYEE
ref|ZP_02261942.1|         YKD--------------ENSLM-VLQQQIESLQTEKESLLERLS-----------VYEE
ref|NP_389392.1|           FKETP-SAQEFQLEREKLKEQIQ-SLQKELEDLRSENQTLRNQLE-----------MTEE
RAAC02454                  YDEQYQRLREYVSAIEREKSELEARVRALESQLREGGPELPLSPE-----------QLEE
                            :                :..:   ::     .*:     *                :* ref|YP_001125095.1|        EYKTLLTIMERARKMM--------
ref|YP_146960.1|           EYKTLLSIMERARKMVTDS-----
ref|YP_896293.1|           EYR---------------------
ref|ZP_02261942.1|         EYR---------------------
ref|NP_389392.1|           DYKALIDIMDRARKMV--------
RAAC02454                  DSRTLFAIMERARKLLAENRSAGT
                            : :
```

FIG. 29

```
ref|ZP_01666183.1|      MKSTGIVRRVDELGRVVIPIELRRTLDIEEKDALEIYVDNDRIILRKYEPACVFCGNADE
ref|YP_077079.1|        MKSTGIVRKVDELGRVVIPIELRRTLNIEEKDSLEIYVDGDKIILRKYEPACVFCGNAAN
RAAC00212               MKSTGIVRKVDELGRVVIPIELRRTLGIGEKDALEIYVDGDRIILKKYEPACIFCGQADE
ref|YP_001666100.1|     LKSTGIVRKVDELGRVVIPIELRRTLNIAERDALEIYVDGEQIVLKKYEPACIFCGNAEN
ref|NP_621806.1|        LKSTGIVRKVDELGRVVIPIELRRTLNIAERDALEIYVDGEQIVLKKYEPACIFCGNAEN
ref|YP_752777.1|        LKSTGVVRKVDELGRIVIPIELRRTMGIEEKDALEIYVDSEKIILKKYEPACIFCGNAEE
                        :****:**:******:*********:.* *:*:******.::*:*:******:***:*  :

ref|ZP_01666183.1|      VTNFKGKNVCRECLEAM---
ref|YP_077079.1|        VENFKGKNVCQSCLASM---
RAAC00212               IIHFKGKNICPSCIAEMQHA
ref|YP_001666100.1|     VINYKGKNICKNCLEELK--
ref|NP_621806.1|        VINYKGKNICKNCLEELK--
ref|YP_752777.1|        VVNYKGKNLCKSCLTEL---
                        : ::****:*  .*:   :
```

FIG. 30

```
ref|YP_001666100.1|      ------------------------------------------------------------
ref|NP_621806.1|         ------------------------------------------------------------
ref|YP_001317994.1|      ------------------------------------------------------------
ref|YP_001181188.1|      ------------------------------------------------------------
ref|NP_346951.1|         ------------------------------------------------------------
RAAC03236                MSGCVSSLPFILALCVSSAAPRVRALGGAWLRLGHRLAIGAAFTVCATASHCCPTRCRMD ref|YP_001666100.1|      ---------------TGIVRKVDELGRVVIPIELRRTLNIAERDALEIYVDGEQIVLKKY
ref|NP_621806.1|         ---------------TGIVRKVDELGRVVIPIELRRTLNIAERDALEIYVDGEQIVLKKY
ref|YP_001317994.1|      ------------MKSTGIVRKVDELGRIVLPIELRRTLTIAEKDSLEIYVDGESIILKKY
ref|YP_001181188.1|      ------------MKSTGVVRKVDELGRIVLPIELRRTLDIAEKDALEIFVDGDKIILRKY
ref|NP_346951.1|         ------------MKSTGVVRRVDELGRIVIPIELRRTLNIAEKDALEIYVDGEQIILKKY
RAAC03236                DHEAAKLRRRIRMLVTGYVRKVDHLGRLVIPKRLRKDLAIGQDDSIEIYVEGDAVVLSKY
                                          :.*:*:* .**: * *.: *::**:*:*: ::* ** ref|YP_001666100.1|      EPACIFCG-NAENVINYKGKNICKNCLEELK------
ref|NP_621806.1|         EPACIFCG-NAENVINYKGKNICKNCLEELK------
ref|YP_001317994.1|      EPACIFCG-NAKDVTVYKTKNVCEDCLEEFR------
ref|YP_001181188.1|      EPACIFCG-NAKDVIYYKGKNICKDCMEELK------
ref|NP_346951.1|         EPACIFCG-DASDVINYRGKNICKHCLEELK------
RAAC03236                EPKCVFCGEKAEKVFHERG--VCGTCLEELKAKSKVS
                         ** *:*** .*..*   :    :*   *:**::
```

FIG. 31

```
ref|YP_001666100.1|                     ---------------------------------------STGIVRKVDELGRVVIPIELRR
ref|NP_621806.1|                        ---------------------------------------STGIVRKVDELGRVVIPIELRR
ref|NP_346951.1|                        -------------------------------------MKSTGVVRRVDELGRIVIPIELRR
ref|YP_001181188.1|                     -------------------------------------MKSTGVVRKVDELGRIVLPIELRR
ref|YP_001317994.1|                     -------------------------------------MKSTGIVRKVDELGRIVLPIELRR
RAAC02603                               MAVSAAFAVCAIASHCCRDRCRMGDDETTVLRRKSRMIATGYVRKVDRLGRLVVPNRIRS
                                                                             : :.*:*:*  .:* ref|YP_001666100.1|                     TLNIAERDALEIYVDGEQIVLKKYEPACIFCG-NAENVINYKGKNICKNCLEELK-----
ref|NP_621806.1|                        TLNIAERDALEIYVDGEQIVLKKYEPACIFCG-NAENVINYKGKNICKNCLEELK-----
ref|NP_346951.1|                        TLNIAEKDALEIYVDGEQIILKKYEPACIFCG-DASDVINYRGKNICKHCLEELK-----
ref|YP_001181188.1|                     TLDIAEKDALEIFVDGDKIILRKYEPACIFCG-NAKDVIYYKGKNICKDCMEELK-----
ref|YP_001317994.1|                     TLTIAEKDSLEIYVDGESIILKKYEPACIFCG-NAKDVTVYKTKNVCEDCLEEFR-----
RAAC02603                               DLHLAKEDPVEIYVEADSIVLTKYEPKCVFCG--EKAEKVFHERAVCGTCLEELKTRSKR
                                         *  :*:..*.:**:*:...*:* **** *:***    ::  : :*  *:**::
```

FIG. 32

```
ref|YP_001374031.1|       ----------------------------------------MANQNSS--NQLVVPGAT
ref|NP_830661.1|          ----------------------------------------MANQNSS--NQLVVPGAT
gb|AAC62407.1|            ----------------------------------------MANNNSS--NQLVVPGVQ
RAAC00161                 ----------------------------------------MMANQNGS--NKVLVQGAN
ref|YP_037204.1|          ----------------------------------------MANKNSGSRNELLVRGAE
ref|NP_979446.1|          ----------------------------------------MANNNSGNRNELLVRGAE
                                                                  ***:*..  *:::* *.

ref|YP_001374031.1|       AAIDQMKYEIAQEFGVQLGADTTARANGSVGGEITKRLVAMAEQSLGG-
ref|NP_830661.1|          AAIDQMKYEIAQEFGVQLGADSTARANGSVGGEITKRLVAMAEQSLGG-
gb|AAC62407.1|            QALDQMKYEIASEFGVQLGPDATARANGSVGGEITKRLVQMAEQQMGGY
RAAC00161                 RALDQMKYEIATEFGVQLGPDTTARQNGSVGGEITKRLVAYAEQQLAGH
ref|YP_037204.1|          QALDQMKYEIAQEFGVQLGADTTARSNGSVGGEITKRLVAMAEQQLGG-
ref|NP_979446.1|          QALDQMKYEIAQEFGVQLGADTTARSNGSVGGEITKRLVAMAEQQLGG-
                          *:******* ******.*:*** ************* ***.:.*
```

FIG. 33

```
ref|YP_001422239.1|    ------------------------------------------QQSNSGNSNQLLVPGAAQ
ref|YP_001420593.1|    -----------------------------------------MANNNSSNQLVVPGAAQ
ref|YP_001486165.1|    -----------------------------------------MANSNSSNQLLVPGAEQ
ref|ZP_01170670.1|     -----------------------------------------MANNNSSNQLLVPGVSQ
ref|ZP_01697004.1|     ----------------------------------------QMANNSNSNQLLVSGAEQ
RAAC00923              MYSLFEAIATPAESTFGAPRGAYGRMARSHYRCHHHHIRRECKMANNSGSNRTLVPQASK
                                                                :*...**: :*.  . :

ref|YP_001422239.1|    AIDQMKYEIASEFGVNLGPETTSRANGSVGGEITKRLVSFAQQSMGG--
ref|YP_001420593.1|    AIDQMKYEIASEFGVNLGGETTSRANGSVGGEITKRLVSFAQQNMGGQ-
ref|YP_001486165.1|    AIDQMKYEIASEFGVNLGAETTARANGSVGGEITKRLVSYAQQHMGG--
ref|ZP_01170670.1|     ALDQMKYEIANEFGVNLGAETTARANGSVGGEITKRLVQMAEQQLGG--
ref|ZP_01697004.1|     ALDQMKYEIAQEFGVNLGADTTSRANGSVGGEITKRLVQMAEQQLGG--
RAAC00923              ALDQMKYEIATEFGVNLGPDTTSRQNGSVGGEITKRLVAYAEQSLAGRA
                       *:******** ****** :**:* ************* *:* :.*
```

FIG. 34

```
ref|ZP_02330525.1|      ---SNVLVVPQANQALEQLKYEVAQELGIQIPQDGYYGYMATRDTGAIGGNITRRLVQIA
ref|ZP_02330045.1|      ---SNVLVVPQANAALDQLKYEVAQELGIVIPQDGYYGNMATRDTGAIGGHITRRLVQIA
ref|YP_001665292.1|     ----NPLVVKEAKQVMSQWKYEIANELGITPPADGYWGNLTSRDCGAVGGHMVRKMIQMA
ref|YP_001665293.1|     ----NPLVVKEAKQVMSQWKYEIARELGITPPADGYWGNLTSRDCGAVGGHMVRKMIQMA
ref|NP_623103.1|        ----NPLVVKEARQVMNQWKYEIANELGITPPADGYWGYLTSRDCGAVGGHMVRKMIQMA
RAAC00643               MAKSNRLLLGQASRALQDMKYEIAGELGITPPADGYWGFVSSYENGSIGGSITKRLVRYA
                            *.*::.:*   .::.: ***:* ****  * ***:* :::  : *::** :.::::: * ref|ZP_02330525.1|      EQSLA-------
ref|ZP_02330045.1|      EQQLS-GTQGS-
ref|YP_001665292.1|     ESQMA-------
ref|YP_001665293.1|     ESQMA-------
ref|NP_623103.1|        ESQMA-------
RAAC00643               QERLAQGDAGSP
                        :. ::
```

FIG. 35

```
ref|NP_829946.1|         ----------------------------------------MSRRRGVMSNQFKEELAKE
ref|NP_842611.1|         ----------------------------------------MSRRRGVMSNQFKEELAKE
ref|YP_001419725.1|      ----------------------------------------MGRRRGVMSDEFKYELAKD
ref|NP_240926.1|         ----------------------------------------MSRRRGIMSDRLKEEIAKE
ref|ZP_02330558.1|       ----------------------------------------RRRSTMSDQLKNELAKD
RAAC01427                ----------------------MPCRRIVSVSPLTREGFGMARRRSTMSDAFKVELAKE
                                                                 ***. **:  :* *:**:

ref|NP_829946.1|         LGFYDVVQKEGWGGIRAKDAGNMVKRAIEIAEQQLMKRN---
ref|NP_842611.1|         LGFYDVVQKEGWGGIRAKDAGNMVKRAIEIAEQQLMKQN---
ref|YP_001419725.1|      LGFYDTVKNEGWGGIRARDAGNMVKRAIEIAEQQMAAQN---
ref|NP_240926.1|         LGFYDTVQQEGWGGIRARDAGNMVKRAIELAEQQLAERESSR
ref|ZP_02330558.1|       LGFYDTVQKEGWGGIKAKDAGNMVKRAIQIAEQAAQKK----
RAAC01427                LGFYDTVQREGWGGIKARDAGNMVKRAIEIAEQALAEKSGQR
                         *****.*:.******:*:**********::***    :
```

FIG. 36

```
ref|YP_173696.1|         -----------LLFAAVLLWVQYDSTL---KDSSSTWHLPMS-------------GKVIV
ref|NP_241105.1|         ----------------------------------------LS-------------GKVII
ref|ZP_01696660.1|       ------------------------------------------------------------
ref|YP_001124272.1|      ------------------------------------------------------------
ref|ZP_02329530.1|       ---------------VALLVMIYAYKLPATETWTEWTQPLA-------------GKTIA
RAAC00365                MIMHGKHRHVPLAFAAMAMLVGATSLVVPVQDARAAWFRPLQHRVNPGVQATGIQGKVIV ref|YP_173696.1|         LDPGHGGMDGGAVSKTGTLEKEVTLAVALKLRDYLQEAGALVIMTREEDVDLADAGTAKI
ref|NP_241105.1|         LDPGHGGIDGGATSRAGALEKDITLAVSLELRDYLQEAGALVLMTREEDRDLADATTAKV
ref|ZP_01696660.1|       ------------------EKDVALSVAAKIKDYLQQQGALVIMTRETDTDLADNETKGY
ref|YP_001124272.1|      ------------------VVEKEIALNVAKKLRDYLQQQGALVLMTRETDRDLASPSTRGY
ref|ZP_02329530.1|       LDAGHGGPDGGASSKSGVIEKDINLIISLYVRDYLQQAGAIVVMTREMDKDLANPDTKGY
RAAC00365                VDAGHGGRDSGARGVGGIEEKDITLSVALKLARYLQQGGAIVIMTRTTDTDLATERDRAM
                                           **::  *  ::   :   *: :*:***   * *** ref|YP_173696.1|         RQRKTEDLRKRAMIINDSEADAFLSIHMNAIPSERWNGAQTFYHLKNQRNEDMAVFIQEE
ref|NP_241105.1|         RQRKVQDLKRRVEIVNGSGADMFVSIHLNAIASPRWSGAQTFYNRAIPENEPLARFVQDQ
ref|ZP_01696660.1|       SRRKVEDLRKRLSLINESEADLFISIHLNAIPQSQWHGAQTFYAPTMIENKRIATFIQAE
ref|YP_001124272.1|      SRRKTEDLRERTTFINKSDADLFISIHLNAIPSPRWRGAQTFYYGSLIENERLAKFIQAE
ref|ZP_02329530.1|       SKRKTEDLLKRAEFVIQKKADLFLSIHLNSVPSPKWRGAQAFYYPNNQDNYRLASLIQEE
RAAC00365                RQRHLGDLRGRLNVVRRQRVDAFVSIHCNSAPSPDWRGAQVLYLKTNPHAKQLATVMQEA
                          :*:   **  *   .:  .* *:***  *:  .. * ***.:*           :*  .:* ref|YP_173696.1|         IKRNLQNTNRYPKPIHHVYLLKEAEIPGALVEAGFLSNPQEAALLATEEYQDKMAASIYE
ref|NP_241105.1|         LKRNLENTSRYAKPINNVFLLKHAEIPGLLVEAGFLSNPSEAELLETEDYQQKVAASIYQ
ref|ZP_01696660.1|       LVRNLENTNRASKTLSNVYLLKHAKKPGCLVEIGFLSNPGEREQLKSDAYQTKVAASIYE
ref|YP_001124272.1|      LRRNLENTHRVAKMIDTVYLLKHAKKPGALVEIGFLSNPDERELLASDHYQTQLAASIYK
ref|ZP_02329530.1|       IKRNMENTDRVAKQEESVYLLKTLKMPSTLIELGFLSNPDEARMLADDKYQKKLAASIYQ
RAAC00365                FRTELLPTHRDVQSNRTLFLLKRIEGPTVLAEIGFVSNPEEARALTTDAYQERVAFAMYE
                           :    ::    *  *   :    ::***   :   *  * ** :***  *    *  : ** ::* ::*:

ref|YP_173696.1|         GMLRFFTD-----------
ref|NP_241105.1|         GIMRYYTN---EDAPE---
ref|ZP_01696660.1|       GIMRYFT------------
ref|YP_001124272.1|      GVLRYFSN-----------
ref|ZP_02329530.1|       GILRYYAGEKV--------
RAAC00365                ALVRYFSDPAVEQVPEDDG
                         .::*:::
```

FIG. 37A

```
ref|YP_036745.1|        ------------------------------------------------------------
ref|YP_083969.1|        ------------------------------------------------------------
ref|YP_028716.1|        ------------------------------------------------------------
ref|ZP_02259717.1|      ------------------------------------------------------------
ref|ZP_01665476.1|      ------------------------------------------------------------
RAAC01563               MFAMPSKVVVTLGSAYAPMASKDNDFCRPDEVSGATSPPRLRAPYLLVRASAREMSFFEF ref|YP_036745.1|        ------------------------------------------------------------
ref|YP_083969.1|        ------------------------------------------------------------
ref|YP_028716.1|        ------------------------------------------------------------
ref|ZP_02259717.1|      ------------------------------------------------------------
ref|ZP_01665476.1|      ------------------------------------------------------------
RAAC01563               VRDLAATHPDPDPFLCLVLDAEGGVMTSAAHGEWEKDEMAACLSAASREFPAVAAQETSM ref|YP_036745.1|        ------------------------------------------------------------
ref|YP_083969.1|        ------------------------------------------------------------
ref|YP_028716.1|        ------------------------------------------------------------
ref|ZP_02259717.1|      ------------------------------------------------------------
ref|ZP_01665476.1|      ------------------------------------------------------------
RAAC01563               SPRTEFGLSAVALLRTDGWHTAWTRLPMAVGRARHLAVIRRASDEDPRSLGRLALHLAHA ref|YP_036745.1|        ------------------RKKTEELLNKSDTLAAIGQLAAGVAHEVRNPLTVIKGFIQL
ref|YP_083969.1|        ------------------RKKTEELLNKSDTLAAIGQLAAGVAHEVRNPLTVIKGFIQL
ref|YP_028716.1|        ------------------RKKTEELLNKSDTLAAIGQLAAGVAHEVRNPLTVIKGFIQL
ref|ZP_02259717.1|      ------------------RKKTEELLNKSDTLAAIGQLAAGVAHEVRNPLTVIKGFIQL
ref|ZP_01665476.1|      ------------------IREVRHRMHHLETLAALGQLAAGTAHEIRNPLTSIRGFTQL
RAAC01563               ATQAWTSCERTLVRRSQCVIERMRKKLQEFEKVSALAQLCAGIAHEIRNPLTTARGFLQL
                                          ..  ..  ::. :.::*:.**.** ***:*****   :** **

ref|YP_036745.1|        FQIN----KEDQEK-YFDLMLSEIERIEAILQEFLSIAKTDEISTEKKNIYQIFKNVVSL
ref|YP_083969.1|        FQIN----KEDQEK-YFDLMLSEIERIEAILQEFLSIAKTDEISTEKKNIYQIFKNVVSL
ref|YP_028716.1|        FQIN----KEDQEK-YFDLMLSEIERIEAILQEFLSIAKTDEISTEKKNIYQIFKNVVSL
ref|ZP_02259717.1|      FQIN----KEDQEK-YFDLMLSEIERIEAILQEFLSIAKTDEISTEKKNIYQIFKNVVSL
ref|ZP_01665476.1|      IQTRALRRNDATTADYCRLIMQEIDHINNILTDILSLARPTTRQLSLLNIVKIVHDVIAF
RAAC01563               FAER----CDDKDRGYLELTISELDRIRELLEDFMGLCRPDREEAAEVDMVEIARSVHRF
                        :  .   :        *  * :.*::*. :*  :::.: :.    .    ::  :*  ::.*   :

ref|YP_036745.1|        INTKAIMTNIQVELYTDSKDIIIECSENQLKQVFINILQNSIEAMPDGGRISIHIKEIGK
ref|YP_083969.1|        INTKAIMTNIQVELYTDSKDIIIECSENQLKQVFINILQNSIEAMPDGGRISIHIKEIGK
ref|YP_028716.1|        INTKAIMTNIQVELYTDSKDIIIECSENQLKQVFINILQNSIEAMPDGGRISIHIKEIGK
ref|ZP_02259717.1|      INTKAIMTNIQVELYADSKDIIIECSENQLKQVFINILQNSIEAMPDGGRISIHIKEIGK
ref|ZP_01665476.1|      MYGEAILSGITLRPELPPEELWVQGHIDKLKEVLINICRNAFQAMG--PGGVLTLSVAAD
RAAC01563               LVPEASLCDIAFELNVPAHPIPAAVRPAQIKQVLINLVQNALQACRGQAHAVVRLDVAEK
                        :  :*  :  .*   ..   .. :           ::*:*:**: :*:::*          :  :.    .

ref|YP_036745.1|        -DGIIISVIDKGIGIPEERIKRLGEPFYSTKEKGTGIGLMLSYKIIESHQGNISIMSEVG
ref|YP_083969.1|        -DGIIISVIDKGIGIPEERIKRLGEPFYSTKEKGTGIGLMLSYKIIESHQGNISIMSEVG
ref|YP_028716.1|        -DGIIISVIDKGIGIPEERIKRLGEPFYSTKEKGTGIGLMLSYKIIESHQGNISIMSEVG
ref|ZP_02259717.1|      -DGIIISVIDKGIGIPEERIKRLGEPFYSTKEKGTGIGLMLSYKIIESHQGNISIMSEVG
ref|ZP_01665476.1|      TATVKIVLADTGCGMTKEVMDQIFTPFFTTKETGTGLGLAICQQIMHEHGGDIQVESTPG
RAAC01563               EDRVLVQVVDNGCGI--EHMDRIFRPFYTTKSTGTGLGLFVCKHIIESHGGSISVRSQVG
                         :  :  :.*.*  *:     *:  ::.**:: :*.:**:**..***:**  :. :*:..* *.*.: *   *
```

FIG. 37B

```
ref|YP_036745.1|      VGTTVTIYLPKIQSKK-
ref|YP_083969.1|      VGTTVTIYLPKIQSKK-
ref|YP_028716.1|      VGTTVTIYLPKIQSKK-
ref|ZP_02259717.1|    VGTTVTIYLPKIQSKK-
ref|ZP_01665476.1|    QGSTFTLLLPRC-----
RAAC01563             AGTTVTVEIPKCASRRA
                       *:*.*:  :*:
```

FIG. 38

```
ref|YP_145847.1|        ------TITMGIQKGGCGKSTTTGVLAYLLSRDGYRVLAVDMDSQGN-LTELLSRKP---
RAAC02315               MERVGCTISVGLQKGGVGKSTTTALTSYILAEQGHRVLAVDFDSQGN-LTQLLTQRS---
ref|YP_536482.1|        ---MGTVIAIANQKGGVGKTTTSVNLGACLARAGQKVLLIDTDAQGNATSGIGVRKH---
ref|YP_799230.1|        ---MGKIVSISNQKGGVGKTTTSINLAANLASIGKKVLIIDMDPQGNSGSGLGIEIN---
gb|ABG00342.1|          ------TIIIGNQKGGVGKTTNTYLIAYTLAKLGIKTLVCDLPQSNSTKALILTKS-QN
ref|YP_891181.1|        MLKMAITITVGNYKGGVGKTTNAVLNSYEFAKKGKRTLLVDLPQSNATKSLMLTKSILN
                             : :.  *** **:*.:     .  ::   *  ::.*   * *.*.*    . :

ref|YP_145847.1|        --SNEFTEKSVLEAMQERDPEPYIVKVND-----RLDLLPANNFLAT-----FPRWIYTG
RAAC02315               --PYDFVHRTSLEACKERDPRPYIHAISD-----NLHLLPAEDFLSQ-----FDKWIYT-
ref|YP_536482.1|        --NIENDVYDVI--VSELPIREAIMPTYI----DNLDVVPATIQLAG------AEIELTA
ref|YP_799230.1|        --TLVKTSYELL--LGESSTNECIQRTNV----SNLHIIPSNINLSG------AEADLLV
gb|ABG00342.1|          SNEIMTIDKTLMWGVQQRDLKDLPVSIIE-----NLDLLPSYIDFED-----FAKYLYKN
ref|YP_891181.1|        PDEIVTVEKTLMKGIQEGNLDGLEVEITD-----NLYLIPSYVDFQD-----FAKFLYQN
                                    :         :           .* ::*:     :           .

ref|YP_145847.1|        ETYLGKYIRYKGKPTLILDDTLDKIRHRYDFIVIDTPPSLSEQTTNALCASQYVIMMFEC
RAAC02315               EVHVS-------QQMVILKNTLDVVKSDYDYILIDLPPNLGGLTLNGVCASDYCVVVCQS
ref|YP_536482.1|        QMAREKK---------LYDAVQDVKEEYDFILIDCPPSLGLLTINAFTASDSILIPVQS
ref|YP_799230.1|        EDQREYR---------LKNAVSELRSEYDYILIDCPPSLGILTINALCAADSVMITLQT
gb|ABG00342.1|          TSNEYEET-------HLLEPLFEPLKEDYDIILIDVPPLSVEVTSNAVMFSDYVLISLQT
ref|YP_891181.1|        CASEAEED-------HYFKGLLEKIKHKYDYIFIDVPPMSLEVTKNAVVASDYVLIALQT
                                   :    .. ::  ** *.** **     * *..   ::   ::   :

ref|YP_145847.1|        SNWCYSAVPNFMESVEGARVHGRHNTRLLGILRTMNDVRRNDAKAFNEMIEEDY-PNEVF
RAAC02315               EPFAYDALDRYMEIIQAAQQRVNPNLRIAGILISLLDARTAIGNYITERIREEY-QDFVF
ref|YP_536482.1|        EYYALEGLSQLMNTIQLVQKHFNPDLQIEGVLMTMLDARTNLGNQVVEEVKKFF-KEKVY
ref|YP_799230.1|        EYFALEGLTQLMKIISLVQNQLNPSLELEGVLLTMFDKRTNLANQVAEDVKSYF-KDKVY
gb|ABG00342.1|          QDDSMTGAIEYIKTLVKLKMKYELGIEVLGALPMLSNSRGSVDKLIIESAKEEWGEDLVF
ref|YP_891181.1|        QERSLTGAENYVNELIKLKEQYDLDIEVVGILPVLLKNNGKVDEYIMENAREIFGEENLF
                             .    . :: :   :    :    . .:  **  . .  :   . * .. :  : ::

ref|YP_145847.1|        KTIITRKAPIGRLSLYGFEENN-ELN-QALEQYENFYKEMMERV--
RAAC02315               DTVIRRKSRIIEFSVEGIKIQT-KADREAIAMYESFVEELKARVSR
ref|YP_536482.1|        KTVIPRNVRLSEAPSHGMSIIDYDPRSRGAEEYEALAKEV------
ref|YP_799230.1|        TTIIPRNVKLSE----------------------------------
gb|ABG00342.1|          ETVIPQMERIKRFSINGITDED-RFDRKVLEMYEKVVSEMLSKL--
ref|YP_891181.1|        KNIVPQMERIKRFDVNGITEKD-RHDMNVIELYETISDELLSRI--
                          .:: :    :.
```

FIG. 39

```
ref|YP_001423364.1|    ----KIIAITNQKGGVGKTTTSVNLGACLAYIGKRVLLVDIDPQGNATSGLGIEKADVDH
ref|NP_391977.1|       ----KIIAITNQKGGVGKTTTSVNLGACLAYIGKRVLLVDIDPQGNATSGLGIEKADVEQ
ref|YP_093870.1|       ----KIIAITNQKGGVGKTTTSVNLGACLAYIGKRVLLVDIDPQGNATSGIGVEKADVDQ
ref|YP_081433.1|       ----KIIAITNQKGGVGKTTTSVNLGACLAYIGKRVLLVDIDPQGNATSGIGVEKADVDQ
ref|YP_001488932.1|    ----KIIAITNQKGGVGKTTTSVNLSACLAYIGKRVLLVDIDPQGNATSGIGIEKADVEK
RAAC00040              MSSARVIAIANQKGGVGKTTTAVNLGACLATLGKRVLLIDIDPQGNTTSGVGINKADVKY
                           :.***.***********.***.****  .:******.*******.***.*::****.

ref|YP_001423364.1|    CVYDILVDDADVTDIIKPTSVENLDVIPATIQLAGAEIELVPTISREVRLKRALESVKQN
ref|NP_391977.1|       CVYDILVDDADVIDIIKATTVENLDVIPATIQLAGAEIELVPTISREVRLKRALEAVKQN
ref|YP_093870.1|       CVYDILVDDADVKDVIKTTSVENLDVIPATIQLAGAEIELVPTISREVRLKRALESVKQN
ref|YP_081433.1|       CVYDILVDDADVKDVIKTTSVENLDVIPATIQLAGAEIELVPTISREVRLKRALESVKQN
ref|YP_001488932.1|    CVYDILVDDADVLDVIKTTEVENLDVIPATIQLAGAEIELVPTISREVRLKRALESVKQN
RAAC00040              CVYDVIINDVNIADAIMPSGLDNLDVLPATIQLAGAEIELVPTISREVRLRRAIQGMRSR
                       ****::::.*.:: *  *   .:  :***:************************:** ::..:..

ref|YP_001423364.1|    YDYMIIDCPPSLGLLTINALTASDSVVIPVQCEYYALEGLSQLLNTVRLVQKHLNTDLMI
ref|NP_391977.1|       YDYIIIDCPPSLGLLTINALTASDSVVIPVQCEYYALEGLSQLLNTVRLVQKHLNTDLMI
ref|YP_093870.1|       YDFMIIDCPPSLGLLTINALTASDSVVIPVQCEYYALEGLSQLLNSVRLVQKHLNTDLMI
ref|YP_081433.1|       YDFMIIDCPPSLGLLTINALTASDSVVIPVQCEYYALEGLSQLLNSVRLVQKHLNTDLMI
ref|YP_001488932.1|    YDYMIIDCPPSLGLLTINALTASDSVLIPVQCEYYALEGLSQLLNTVRLVQKHLNTDLAI
RAAC00040              YDYIVIDCPPSLGLLTVNALTAADSVMIPIQCEYYALEGLSQLLNTVRLVQKHLNTSLEV
                       **::::***********:*****.***::**:***********************.* :

ref|YP_001423364.1|    EGVLLTMLDARTNLGIQVIEEVKKYFRDKVYQTIIPRNVRLSEAPSHGKPIILYDPRSRG
ref|NP_391977.1|       EGVLLTMLDARTNLGIQVIEEVKKYFRDKVYKTVIPRNVRLSEAPSHGKPIILYDPRSRG
ref|YP_093870.1|       DGVLLTMLDARTNLGIQVIEEVKKYFRDKVYKTVIPRNVRLSEAPSHGKPIILYDPRSRG
ref|YP_081433.1|       DGVLLTMLDARTNLGIQVIEEVKKYFRDKVYKTVIPRNVRLSEAPSHGKPIILYDPRSRG
ref|YP_001488932.1|    EGVLLTMLDARTNLGIQVIEEVKKYFRDKVYQTVIPRNVRLSEAPSHGKPIILYDPRSRG
RAAC00040              EGVVLTMLDARTNLGLQVIEDVKKFFRDKVYKTIIPRNVRLSEAPSHGRPIIHYDPKSRG
                       ::*******::*:******:*:************:* *:* ref|YP_001423364.1|    AEVYLDLAKEVAANG
ref|NP_391977.1|       AEVYLDLAKEVAANG
ref|YP_093870.1|       AEVYLELAKEVAA--
ref|YP_081433.1|       AEVYLELAKEVAA--
ref|YP_001488932.1|    ADVYLDLAKEVDANG
RAAC00040              AESYMELAKEVIARG
                       *: *::*****  *
```

FIG. 40

```
ref|ZP_01697918.1|         ------------------------------------FFMLVMLIIYLESPLSRVHRIQIE
ref|ZP_01172488.1|         ------------------------------------LLLLFFSMIVFVIYFQSPLSRVKEISIS
emb|CAJ75583.1|            ------------------------------------FFLFILCVLYFQSPLGAVGHVEVS
ref|YP_146973.1|           ------------------------------------FFLFILCVLYFQSPLGAVGHVEVS
ref|YP_001125108.1|        ------------------------------------FFLFILCVLYFQSPLSAVRHVEVS
RAAC00113                  MNRGRTGGERRESMPRQETAEERERRKARNRRIVVSFFAFIGLVAVLESPLARVRHIEVS
                                                               **  ::  :  ::***. * .:.:.

ref|ZP_01697918.1|         GNEAVSKPYILKKSGIATGENIWNI-RKDAVRKRIASIPEVDSVKVGISLPN-TLYIKVK
ref|ZP_01172488.1|         GNQTYTTKELIAVSGLSKKTNIWKVD-KGAIEGRLKELPEISGAEIKTRLPN-TVDIKVA
emb|CAJ75583.1|            GNRHLTAERIISLSGITKRTSFWKVNEQNVEKKL-TRHPEIKEATVEKQLPN-TIAIHVR
ref|YP_146973.1|           GNRHLTAERIISLSGITKRTSFWKVNEQNVEKKL-TRHPEIKEATVEKQLPN-TIAIHVR
ref|YP_001125108.1|        GNRHLPAERIISLSGITKRTSFWKVNEQNVEAKI-ARHPEIKEATVKKRLPN-TIVIDVR
RAAC00113                  GNTTIPMAQIVACSGVVYGESLWEVNRKRAASEIVAKLPMVDRAAISVSWPSGTVSIHVH
                              .  ::  :    .:*::  :  .       *  :. .  :   *. *: *.* ref|ZP_01697918.1|         EHQKIGYLQQKGGFLPVLDNGSVV-KRTVKEIPAAS----LIFTGFKQDT---------H
ref|ZP_01172488.1|         EHNRIAYIAKEKSFLPVLENGMILSKQEITDIPVNA----PLLLGFKEGD---------V
emb|CAJ75583.1|            EWRRIAYVYDRQTFFPLLENGRLLKQEGTKTAPSDA----PVLVGWKDGD---------A
ref|YP_146973.1|           EWRRIAYVYDRQTFFPLLENGRLLKQEGTKTAPSDA----PVLVGWKDGD---------A
ref|YP_001125108.1|        EWRRVAYVYNRQTFFPLLENGQLLKQEAVKTAPSDA----PVLVGWKS---------GEA
RAAC00113                  ERDVVAVYADPNGFYELMSNGYVYQKIPSAAGLPYP-----IVTGQDSELS---------
                           *   :.  .   *  ::.**  :  :        .         :. * ..

ref|ZP_01697918.1|         LHEM---------IRQMQKLPDSITNAISEVRYTPSNVDRDLVTLYMNNGFEVRASIPSF
ref|ZP_01172488.1|         LLEMIDS--------LESLPKEVLNAISEIHYSPKETDEYHITLYMNDGFEVSATLRSF
emb|CAJ75583.1|            IAEMTG---------QLAELPAAVLGAMSEIHYKPTREYEDRVIVYMNDGYEVSATI---
ref|YP_146973.1|           IAEMTG---------QLAELPAAVLGAMSEIHYKPTREYEDRVIVYMNDGYEVSATI---
ref|YP_001125108.1|        IAEMTG---------QLAELPAAVLGAISEIHYKPTGEYKDRVVVYMNDGYEVSATIHN-
RAAC00113                  VHQMASAAVSS-VCRQLASVPASELTGVSEIHVN----GDGTVTIYLDNDFEVLADVANL
                           : :*            :..:*      .:***::  .       : :*:::.:** * :

ref|ZP_01697918.1|         AEKMAHYPSIISQLDPK--KKGVIDL----------------------------------
ref|ZP_01172488.1|         SEKMAHYPSIISQLDPG--VSGVIDL----------------------------------
emb|CAJ75583.1|            ------------------------------------------------------------
ref|YP_146973.1|           ------------------------------------------------------------
ref|YP_001125108.1|        ------------------------------------------------------------
RAAC00113                  RGSVAAIQPTIRYFEGKGYRPGVIDLTGSPPYRYTPFSSLPSSNAKTSSASGRGGPVEGT ref|ZP_01697918.1|         --------
ref|ZP_01172488.1|         --------
emb|CAJ75583.1|            --------
ref|YP_146973.1|           --------
ref|YP_001125108.1|        --------
RAAC00113                  SSKTASHP
```

FIG. 41A

```
emb|CAJ75587.1|        MSSNEIVVSLDVGTSSVKVIIGEMLGSSINIIGVGNVKAEGLKKGAIVDIDKTVQSIRRA
ref|YP_146977.1|       MSSNEIVVSLDVGTSSVKVIIGEMLGSSINIIGVGNVKAEGLKKGAIVDIDKTVQSIRRA
ref|YP_001125112.1|    MSSNEIVVSLDVGTSSIKVIIGEMLGSSINIIGVGNVKSEGLKKGAIVDIDKTVHSIKRA
ref|NP_243425.1|       MNNNEIYVSLDIGTSNVRIIIGEITDGSINIIGVGNAPSEGIKKGSIVDIDETVRSIRRA
ref|ZP_02330014.1|     MSSSDIIVSLDIGTSKVRAIIGEVNNGTINIIGVGSADSEGIRKGAIVDIDQTVSSIRAA
RAAC00117              MAKEDYIVSLDIGTSKVRVIIGESTGNNLNIIGVGSASSQGLRHGAIVDIDKTVDSIREA
                       *  ..:  **:*.:: **   ...:****.. ::*:::*:**: **: * emb|CAJ75587.1|        VEQAERMVGLSIRRVIVGVAGSHIQLHDCHGIVAVASENREISDEDVARVIDAAQVVSIP
ref|YP_146977.1|       VEQAERMVGLSIRRVIVGVAGSHIQLHDCHGIVAVASENREISDEDVARVIDAAQVVSIP
ref|YP_001125112.1|    VEQAERMVGLSIRRVIVGVAGSHVQLQDCHGIVAVASENREISDEDVARVIDAAQVVSIP
ref|NP_243425.1|       VEQAERMVGLSIRQVIVGVNGNHVQLQPCHGVVAVSSPDREIGDEDIARVIDAAQVVSIP
ref|ZP_02330014.1|     VDHAERMVGLQISEVYVGITGNHIALQTSHGVVAVSNEDREIGEEDIERVNQAARVIALP
RAAC00117              VDHAERMVGIRIPSAYVGISGEHIQLHSSHGVVAVSSADREITDEDIERVLQQARVVALP
                       *::******:  * . **: *.*: *: .:*:. :* :: **  : *:*:::* emb|CAJ75587.1|        PDREIIGVVPRQFIVDGLDGIHDPRGMLGVRLEMEGTMVTGAKTVLHNLLRCVERAGLEI
ref|YP_146977.1|       PDREIIGVVPRQFIVDGLDGIHDPRGMLGVRLEMEGTMVTGAKTVLHNLLRCVERAGLEI
ref|YP_001125112.1|    PDREIIGIVPRQFIVDGLDGIHDPRGMLGVRLEMEGTMITGAKTILHNLLRCVERAGLEI
ref|NP_243425.1|       PEREIIDVIPKQFIVDGLDEINDPRGMIGVRLEMEGTIITGSKTLLHNLLRCVERAGLEV
ref|ZP_02330014.1|     PEREIIGIVPKQYIVDGQEGIQDPRGMIGVRLEVEATIITGAKTGIHNLRVVEKSGLKV
RAAC00117              PEREVIDVVAKEFVVDGLRGIMDPRGMLGVRLEVDAYLITGSRTAIHNIVRCVERAGLEV
                       *:**:*.  .::.:::***  * *****:****::. ::**:.* :**::* **:**::

emb|CAJ75587.1|        SDICLQPLAAGSLVLSDDERHLGAALVDLGGGSTTVAVFEQGTLQAVSSLPVGGEHITKD
ref|YP_146977.1|       SDICLQPLAAGSLVLSDDERHLGAALVDLGGGSTTVAVFEQGTLQAVSSLPVGGEHITKD
ref|YP_001125112.1|    SDICLQPLAAGSLVLSDDERHLGAALVDLGGGSTTVAVFEQGTLQAVSSLPVGGEHITKD
ref|NP_243425.1|       ADICLQALAAGSVAISKDEKSLGVCLIDIGGGSMTISCFEQGSLVDTSVIPVGGDHVTND
ref|ZP_02330014.1|     SGLILMSLAAGQLALSKDEKQIGTVLVDVGAGTTTISVFDQGSLVATSTLPIGGDFITTD
RAAC00117              ANLVLAPMAASQIALTQDERKLGVALVDVGAGVTSVSVFANGVLMGTSIIPIGGDYVTQD
                       :.: * ..:..:.::.:  :*. *:*:*.*  ::: * :* *  .* :*:**:.:* * emb|CAJ75587.1|        LAIGLRTTTDDAEKIKLKHGHAFYDYASEEEVFSVPIMGTDQHQQFSQLEIADIIEARLE
ref|YP_146977.1|       LAIGLRTTTDDAEKIKLKHGHAFYDYASEEEVFSVPIMGTDQHQQFSQLEIADIIEARLE
ref|YP_001125112.1|    LAIGLRTTTEDAEKIKLKHGHAFYDYASEEEVFTVPIMGTDQHQQFSQLEIADIIEARLE
ref|NP_243425.1|       IAVGLRISTEEAIKIKHTHGHAYIDEASEEDRFEVKAIGSTEPEAFSQFELAHIIEPRME
ref|ZP_02330014.1|     ISIGLRTQMDIAEKIKLKFGCASIADSAPDQMFKVNRIGSNVDKEFSQVDLANIVEPRVQ
RAAC00117              IAIGLRTNTVAAEQVKLRHACAMVEQASEHETFRVPRMGSNKEAEFTQYDLATIIEPRMQ
                       :::***    *  ::*  .. *   ::   .: * *   :*:   *:*  ::* *:*.*::

emb|CAJ75587.1|        EILQMVQQEVRRLGFRD-LPGGYVLTGGVANMPGLLELAHVVLGTSVRIAMPDYIGVRDP
ref|YP_146977.1|       EILQMVQQEVRRLGFRD-LPGGYVLTGGVANMPGLLELAHVVLGTSVRIAMPDYIGVRDP
ref|YP_001125112.1|    EILQMVQHEVRRLGFRD-LPGGYVLTGGVANMPGVLELAHVVLGTSVRVALPDYIGVRDP
ref|NP_243425.1|       EMFELINRELRRLGQHD-FPGGFVLTGGSVMMPGVLELAKETLGRNVRVAIPDYIGVREP
ref|ZP_02330014.1|     EIFQLIRGEVHRMGYSD-LAGGYVLTGGTVNLPATLVIAQEELAATVRIATPDYIGVRDP
RAAC00117              EIFGLVRKEVEKMGYADELPAGYVFHGGVMSTPSAAELAGEELQAPVRIAVPEFLGVRDP
                       *:: ::.  *:..:* * :..*:*: **    *.  :*    * **:* *:::***:* emb|CAJ75587.1|        QYTIGVGLLKFAYR----------------------------------------------
ref|YP_146977.1|       QYTIGVGLLKFAYR----------------------------------------------
ref|YP_001125112.1|    QYTIGVGLLKFAYR----------------------------------------------
ref|NP_243425.1|       QYTTGVGLIQFAYKNVKIQGKEVAAAVAEAGVEQEQRPKKEKERSRTNEGPGVKSKVKNW
ref|ZP_02330014.1|     AYTSGVGIIQFVIKYIR-------NRPASLNKKQPIKAAASKSGSQEKEGEGFFDRVKNF
RAAC00117              SFVNGVGMIVYAAR-------------TGLRPSSADYNAGARQVRSSNHVGVFARIKDW
                       :. ***:: :. :
```

FIG. 41B

```
emb|CAJ75587.1|         -----
ref|YP_146977.1|        -----
ref|YP_001125112.1|     -----
ref|NP_243425.1|        FKVFL
ref|ZP_02330014.1|      LKEFI
RAAC00117               LRDFV
```

FIG. 42

```
ref|YP_001646530.1|         ------------------------MLEFDTTQDQLANIKVIGVGGGGNNAVNRMIEHG
gb|AAN04557.1|              ------------------------MLEFDTTQDQLANIKVIGVGGGGNNAVNRMIEHG
ref|YP_001375784.1|         ------------------------MLEFDTTQDQLANIKVIGVGGGGNNAVNRMIEHG
ref|YP_078922.1|            ------------------------MLEFETNIDGLASIKVIGVGGGGNNAVNRMIEND
ref|ZP_02171874.1|          ------------------------MLEFEMDTDQLATIKVIGVGGGSNAVNRMIENG
RAAC00118                   MCARTCALTPYCRRGSAEPNRLGGPTVLEFDFETDSLANIKVIGVGGGCNAVNRMIESG
                                                    :***:   *  **.**********  ********  .

ref|YP_001646530.1|         VQGVDFIAVNTDAQALNLSKAETKMQIGGKLTRGLGAGANPEVGKKAAEESKEQIQEALR
gb|AAN04557.1|              VQGVDFIAVNTDAQALNLSKAETKMQIGGKLTRGLGAGANPEVGKKAAEESKEQIQEALR
ref|YP_001375784.1|         VQGVDFIAVNTDAQALNLSKAETKMQIGEKLTRGLGAGANPEVGKKAAEESKEQIQEALR
ref|YP_078922.1|            VQGVDFIAVNTDAQALNLSKAETKLRGLGAKLTRGLGAGANPEVGKKAAEESKEQIEEALK
ref|ZP_02171874.1|          LQGVEFIAVNTDAQALQLSKAEHKLQLGGKLTRGLGAGANPDIGKKAAEESRDQLEEYLT
RAAC00118                   VKGVEFIVVNTDAQALKLSKAETKLQIGEKLTRGLGAGANPEIGKKAAEESREMLANALK
                            :::.******:**  *:*:*  *********::*****::  :  :  * ref|YP_001646530.1|         GADMVFVTAGMGGGTGTGAAPVVAQVAKELGALTVGVVTRPFTFEGRKRATQAASGIASF
gb|AAN04557.1|              GADMVFVTAGMGGGTGTGAAPVVAQVAKELGALTVGVVTRPFTFEGRKRATQAASGIAAF
ref|YP_001375784.1|         GADMVFVTAGMGGGTGTGAAPVVAQVAKELGALTVGVVTRPFTFEGRKRATQAASGIAAF
ref|YP_078922.1|            GADMVFVTAGMGGGTGTGAAPVIAQIAKDLGALTVGVVTKPFTFEGRKAAEESPKRQIEEALK
ref|ZP_02171874.1|          GADMVFITAGMGGGTGTGAAPVIAEIAKEAGALTVGVVTKPFTFEGRRRMNQAQTGISDL
RAAC00118                   GADMVFVTAGMGGGTGTGAAPVIAEIAKELGALTVGVVTKPFRFEQRRRMIQAEQGVNEL
                            ******:***************:::**: ********:** **  *:*  ** *:   :

ref|YP_001646530.1|         KENVDTLIVIPNDRLLEIVDKNTPMLEAFREADNVLRQGVQGISDLIATPGLINLDFADV
gb|AAN04557.1|              KENVDTLIVIPNDRLLEIVDKNTPMLEAFREADNVLRQGVQGISDLIATPGLINLDFADV
ref|YP_001375784.1|         KENVDTLIVIPNDRLLEIVDKNTPMLEAFREADNVLRQGVQGISDLIATPGLINLDFADV
ref|YP_078922.1|            KEAVDTLIVIPNDRLLEIVDKNTPMLEAFREADNVLRQGVQGISDLIATPGLINLDFADV
ref|ZP_02171874.1|          KEKVDTLIVIPNDRLMEIVDKNTPMIEAFREADNVLRQGVQGISDLIAVPGLINLDFADV
RAAC00118                   KQKVDTLIVIPNDRLLEIVDRNTPVLEAFREADNVLRQGVSGISDLIATPALINVDFADV
                            *:  *********::*::************.*****.*.*:*** ref|YP_001646530.1|         KTIMSNRGSALMGIGSGNGENRAAEEAAKKAISSPLLETSIDGAQGVIMNITGGANLSLYE
gb|AAN04557.1|              KTIMSNRGSALMGIGSGNGENRAAEEAAKKAISSPLLETSIDGAQGVIMNITGGANLSLYE
ref|YP_001375784.1|         KTIMSNRGSALMGIGSGNGENRAAEEAAKKAISSPLLETSIDGAQGVIMNITGGANLSLYE
ref|YP_078922.1|            KTIMSNKGSALMGIGVATGENRAAEEAAKKAVSSPLLETAIDGAQGVLMNITGGTNLSLYE
ref|ZP_02171874.1|          KTIMSEKGSALMGIGIATGESRAAEEAAKKAISSPLLETSVDGAQGVLMNITGGTNLSLFE
RAAC00118                   KAIMTERGSALMGIGIASGENRAAEEAAKKAISSPLLETSIDGARGILMHVAGGTNLSLWE
                            *:::::****  ...********:***::*:*::*::::**:* ref|YP_001646530.1|         VQEAADIVASASDPEVNMIFGSVINEGLKDDIVVTVIATGFDDSASTQPPKPIIRPTANH
gb|AAN04557.1|              VQEAADIVASASDPEVNMIFGSVINEGLKDDIVVTVIATGFDDSAATQPPKPIIRPTANH
ref|YP_001375784.1|         VQEAADIVASASDPEVNMIFGSVINEGLKDDIVVTVIATGFDDSIVAQQQKTLVRPKINS
ref|YP_078922.1|            VQEAADIVAAASDQDVNMIFGSVINENLKDEIVVTVIATGFIE--QDQDSSKPQRPLNQG
ref|ZP_02171874.1|          VHEAADIVSSASDEEVNMIFGSVINDNLKDEIIVTVIATGFDEASQQKAQPKRSKPNAQK
RAAC00118                   VNEAADIVSMTADPDVNMIFGAAIDPNLEDEIVVTVIATGFDGSNQQQQARQNHLHHEPH
                            *:****:**:  ::.*  :******..:*:  .*:*:*:*********          :

ref|YP_001646530.1|         TQQQQQPVAQPSKQREVKREMKREEPVVHDRHTDS---DDIDIPAFLRNRRRRR-----
gb|AAN04557.1|              TQQQQQPVAQPTKQREVKREMKREEPVVHDRHTDS---DDIDIPAFLRNRRRRR-----
ref|YP_001375784.1|         SHVQQQAAVQPPKHREVKREVKREEPVIHDRNTDA---DDIDIPAFLRNRRRRR-----
ref|YP_078922.1|            LKQHHQP--------APKREPKREEPSMPHRSPSQPAEDTLDIPTFLRNRNKR-----
ref|ZP_02171874.1|          SGRQEQK------DQPQQKAAEVEETSQEEI-------DTLDIPTFLRNRRQR-----
RAAC00118                   DNVVRGT---------VQRHPSAQDPVINVPNTGN----PWEIPAFMRRQNSRFGRDR
                                   .          ::    . ::.                :**:*:*.:. *
```

FIG. 43

```
ref|YP_001395809.1|      ---KDSITVSLCMIVKNEEDTIGRCLDSVKDVIDEFIIVDTGSSDNTKDVIKKYTDNIYD
ref|YP_001309701.1|      -------TISLCMIVKNEEDVIANCLESVKDIVDEMIIVDTGSDDKTKKIVKRYTDKIYD
ref|YP_001643660.1|      -------TISLCMIVKDEEQTISKCLESVKSVVDEIIIVDTGSTDGTKEIVKKYDAKVYD
ref|YP_520670.1|         ---------SLCMIVRNEEKTIARCLDSVCDIADEIIIVDTGSTDRTKEIVARYTDKIFD
ref|YP_147952.1|         -------TISLCMIVKNEEDVLARCLDSVQHLVDEIVIVDTGSTDRTKEIARSYTARVID
RAAC01377                MSAKTENTWSLCMIVKDEEAVLDRCLQSIADIVDEIVIVDTGSQDRTQEIARKYTDLVFD
                                  ****:: .: .**:*:   : ::**** * *:..    *   : * ref|YP_001395809.1|      FEWIDDFSAARNFAFSKATKDYIFWLDADDVLLPEDVEKFKALKKNLDTSIDSVTMRYNV
ref|YP_001309701.1|      FKWIDDFSAARNFAFSKATKDYILWLDADDVVLPEDGEKFKDLKETLDPTVDSVTAKYNT
ref|YP_001643660.1|      FQWIEDFSAARNFAFSKATKEYILWLDADDIIDTEDIKKLLQLKHTLDRSTDAVSMKYYL
ref|YP_520670.1|         FAWIDDFAAARNYAFSLGTKEYLLWLDADDVILESDRLKFHNLKKNLNPSIDVVNMHYLL
ref|YP_147952.1|         FPWSDDFSAARNFSFSHATMDYIFWLDADDILPAEEQTKFLTLKRTLSSDIDSVTMIYSL
RAAC01377                FEWVDDFSEARNESPRHASMDYVLWLDADDVVSDVDRIKLAEFKKNLSSDVDAVTMWYHL
                         * *  :: * :*    .:  :*::******::     *:  :*..*.   * *. * ref|YP_001395809.1|      SFDEYSNVTTSYRRNRLVKKEKNFKWIGFVHEYLEVYGNIINSEISVTHKKINYSPNRNL
ref|YP_001309701.1|      AFDEYGNVTASYRRNRLVKRSNNFQWFGFVHEYLAVGGNIINSEIAITHRKLKQTPKRNL
ref|YP_001643660.1|      TFDIEGNPTHSLRRYRLVNRSKNFQWYGFVHEYLEVYGNLINSDVGVSHKKEKAYTNRNL
ref|YP_520670.1|         AFDSSENPTFTLRRRNRLVRRGKNFRWKGAVHEYLEVSGNIMNSDIAIAHKSEEHDSERNL
ref|YP_147952.1|         AQDEYGKTISSVRRNRLVKRSSGFRWHGMVHEYLEVWGTILNSDITIIHQPNRCASDRNL
RAAC01377                AFQGDQPTVSS-RLVRLVKRSRGFVWRGRVHEYLEINGNILNSDIAIIHRPVEHDAARNL
                         : :         :  ***.:  .* * * *****  : *.::**::  : *:  .  . *** ref|YP_001395809.1|      EIFQNKLKEGVEFTPRDILYYGNELYEHRMFEDALKYYNDFLDSKRGWYEDNIHVCGKIC
ref|YP_001309701.1|      EIYQNKLKEGVVFTPRDILYYGNELYDHRMFDEALQYYNKFLDSKQGWFEDNIRVCEKIC
ref|YP_001643660.1|      KIYEKHLESGKEFSPRDVYYANECKDHRLFDKAVKGYSRFLDEEKGWVEDNIQACLKRA
ref|YP_520670.1|         RIYEKRLEQGEEFSPRDLYYFANELYDHKQYEKAVEYYEKFLNTEKGWVEDNISACGKLA
ref|YP_147952.1|         QIYEKQLAQGKEFSPRDLFYFANELFDHQQYERAIQYYEQFLQTKKGWVEDCIAACGKVA
RAAC01377                RIYEKKLALGEDFSPRDMLYYANELLDHAQYEKAVQWYKRFLATGQCWKEDAITACFKLA
                         .*:::::*   *  *:***:  *:.**   :*   ::  *:: *. **    : * **  * .* * .

ref|YP_001395809.1|      DYYQSINNGEECRKYAFKSFEYDSPRAEACCRLGFSFLQENKINQAIFWYETAANLKKPI
ref|YP_001309701.1|      DYYQSIDKVEDGRRYAFRSFEYDTPRAEACCKIGFSFLHEKKYKQSAFWYEQATKLEKPK
ref|YP_001643660.1|      ECYLELGDLKKSIQSCLQSFTYDTPRGELCCHLGRVFLQQGEYSKAIYWYHAAIDGPRPK
ref|YP_520670.1|         DIYKLLGDSANAQAYLYKSFYDTPRAEFCCRIGFNHLNAGKYQQAIFWYKLASELEKPT
ref|YP_147952.1|         DCFDALGDEEQALRYALRSFEYDTPRAECCCRLGYYFLQRKQYRLAAFWYHLATQLTMPS
RAAC01377                ECFRAMNQPEQSKQAVLHSFLYDTPRAEACCRIGYGYLEEGKIDQAIFWYDLATKCRRPA
                         : :  :...  .      : :**.* **::*   .*.  :    :  :**. * .   * ref|YP_001395809.1|      NSLGFFSDACWTWLPHLQLCVCYDRIGKHQLAYEHNEIAGKFRPNDKKILYNRNYFQS--
ref|YP_001309701.1|      DSWGFFNDACWTWLPHLQLCVCYDRLGDHNLAYEHNEIAAKFRPNDSRILYNRNYFKS--
ref|YP_001643660.1|      D-SPFVREECHTWLPHIQLCICYDRIKEYEKAIYHNEQAALFIPNNPSIEYNR-------
ref|YP_520670.1|         NSWGPKSEACWTYLPHLQLCVCYDRLGMHELAYKHNEIARDYRPDNPQILHNKKYL----
ref|YP_147952.1|         DSWGFVHHACWTWLPHLQLCVCYFMGEYELAYQHNEKAKQYVPHHPAVLHNECLLQSIL
RAAC01377                NFVGFVNHACETWLPHIQLCVCYSRLGQYRKAYDHNERAAEYLGEDPMIVHNRSVLRAWM
                         :         .  * *:***:***:**    :  :. *   *** *    :  ..  :  :*.

ref|YP_001395809.1|      -------
ref|YP_001309701.1|      -------
ref|YP_001643660.1|      -------
ref|YP_520670.1|         -------
ref|YP_147952.1|         AAE----
RAAC01377                DGELEKP
```

FIG. 44A

```
ref|NP_470039.1|        ------LISICMIVKNEAHILRQSLASFRKFTEEIIIVDTGSTDDTKEIAKEFTDFVYDF
ref|ZP_01929325.1|      ------LISICMIVKNEAHILRQSLASFRKFTEEIIIVDTGSTDETKEIAQEFTDFVYDF
ref|YP_848858.1|        ------LISICMIVKNEAHILRQSLASFRKFTEEIIIVDTGSTDETKEIAKEFTDFVYDF
ref|YP_001374688.1|     -------ISACLIVKNEEDMLRKCLESLQGGVDEIVVVDTGSTDTTKEIAKEFTDKVYDF
ref|NP_622177.1|        -------LSLCLITKNEEKNISRCINSVKDIVDEIVVVDTGSTDRTIEIAKSFGAKVIQI
RAAC02381               MRRIVVLLSACLIVKNEAHVLPRCLGSLQGVADEIVVVDTGSTDDTPRIAESFGARVYHF
                              :* *:*.***   . :  :.:  *.:    .:**::******  *  .**:.*    *  .:

ref|NP_470039.1|        EWTGNFSDARNFAAKHATGKWILAIDADECLEEESYRKLEKQLKSPIEP--IQMAQIISF
ref|ZP_01929325.1|      EWTGNFSDARNFAAKHATGKWILAIDADECLEEESYRKLEKQLKSPTEP--IQMAQIISF
ref|YP_848858.1|        EWTGNFSDARNFAAKHATGKWILAIDADECLEEESYLQKKQLKAPTEP--IQMAQIISF
ref|YP_001374688.1|     EWTNDFAEARNFAASKASGEWILAIDADECVDPKNLAAAIEEIQSHDNKFDVYAVEINSF
ref|NP_622177.1|        KWEDDFSKARNTAIESATGDWILFLDADEEIKKEDVSKIKSLLYDDTVEAYLFKFVNYAG
RAAC02381               EWTGDFAVARNESLRYALGEYVLVIDADEFLPKEDGVRLRQALQERRADAYTVDLVNYLG
                         :*   .:*: ***    * *.::*:****  :  . .

ref|NP_470039.1|        TGEKGRVTTTNQMARVYKNDGTICFRGVIHEQ-----LEAVDKHAIEAGLAEVKIYHYGY
ref|ZP_01929325.1|      TGEKGRVTTTNQMARVYKNDGTICFRGVIHEQ-----LEAIDKRPIAAGVAEVKIYHYGY
ref|YP_848858.1|        TGEKGRVTTTNQMARVYKNDGTICFRGVIHEQ-----LEGIDKHAVETGFAPVKIYHYGY
ref|YP_001374688.1|     SDKYGENLSMNHMQRIYKNNGEFHFSGAIHEQI----VEKGEGR-QELVFSALKLYHYGY
ref|NP_622177.1|        SSINSGLTEINYNYRLFRNNGKLKYIYPVHEN----LRNIEENRPPIAKKADVTILHYGY
RAAC02381               SVARFVRSPGVRVVRVFRRG--FSYMGSIHEQ----ILYDVIAKGGQIEVLDVEIHHLGY
                         :          *:::..  :  :   :**:         .   :  :   : * ** ref|NP_470039.1|        MSEIVEKQDKSDRNLRLLEKEVKNNKNSGFVHFNIGQEMNRLGNKKEALKEFSEAFRL--
ref|ZP_01929325.1|      MSEIVEKQDKSDRNLRLLEKEVKNNKNSGFVHFNIGQEMNRLGNKKEALKEFSEAFRL--
ref|YP_848858.1|        MSEIVEKQGKSDRNLRLLEKEVKNNKNSGFVHFNIGQEMNRLGDKKEALKEFTKAFRL--
ref|YP_001374688.1|     LPNVVKKKNKRKRNMDILKKALKSNNNDGFTYFNYGQELRSLGKTKEALESFIKAY----
ref|NP_622177.1|        LADIRKEKNKSERYIKLISKYLESHPEDKFQHANLAVEYFNIGDYQKALKHLLIATKGMD
RAAC02381               LAEFVALKGKSDRNLEILNQALAIDPDNFFHITNLMAEYARLGDPKKVVELGERAYDLFQ
                         :.: .*  .* :  :: .:  :.    .* :     *:    * ref|NP_470039.1|        --RDNNHYIWAKLSAYHISELLEQE-KRYDESLAIIEEAKVIWPNVPEFPLKKANILYVN
ref|ZP_01929325.1|      --RDHNHYIWAKLSAYHIAELLEQE-KRYDESLAIIEEAKVIWPNVPEFPLKKANILYVN
ref|YP_848858.1|        --RDNNQYIWAKLSAYHISELLEQE-KRYEESLAIIEEAKVIWPNVPEFPLKKANILYLH
ref|YP_001374688.1|     QNKEDVYEEWVSRCLYFIVEMLVEL-KRYEEAIVIINDAEEVFSTAPDFPFWKGEIYFKQ
ref|NP_622177.1|        VNSVN----ATRLLRYLIGCYIGLK--DYSTALKIIKDAKDYYKDIPDFSFLEGLMYMDQ
RAAC02381               RGRVNQPHLVLRMYRMMIAAHGDLG--NYDRVEALAREABLFFPNIPDVPFVHALYVMQR
                         .                 *.   :   .:*.  :     *:...  ..    .

ref|NP_470039.1|        HQLEDAKEI---YKSLLENTAIDYQPI-VLYEATNFMPHKMLGTIYLEEKDYTRAMTHFS
ref|ZP_01929325.1|      HQLEDAKEI---YQSLLENAIDYQPI-VLYEATNFMPHKMLGTIYLEEKDYTRAMTHFS
ref|YP_848858.1|        HQLEDAKEI---YHSLLDNKVIDYQPI-VLYEATNFMPHKMLGTIYLEEKDYTRAMTHFS
ref|YP_001374688.1|     KRFDDAKEV---YTHIISNNMIYQNAVFN-AGAKTFLPHVRLGEIYTQERQHQQALQHYV
ref|NP_622177.1|        KRYEKAIEA---FKESLSIGEYDGLFI-TMGGTGSYRARYMIGLCKEKLNQLNDAVKEYI
RAAC02381               GDWRKAIRL---FERSREIGEIRSEIIDTIAGAGSYVAAAKLGELWLLEGDVELAREYFV
                         .* .   :            :           : .:  .:*       :  *    :

ref|NP_470039.1|        KAYAENSSDYGVMFQMIMLL----------------------------------------
ref|ZP_01929325.1|      KAYAENSSDYGVMFQMIMLL----------------------------------------
ref|YP_848858.1|        KAYAENSSDYGVMFQMIMLL----------------------------------------
ref|YP_001374688.1|     EALNEN------------------------------------------------------
ref|NP_622177.1|        EVLKENPNYQEVFIKLFDLFIKNEP-----------------------------------
RAAC02381               QSLRENLRQEGTFFFLASLLPLNDPSVFEQLRALASHDPVCLAYLALAGAVWRVDHAWRL
                         :   **
```

FIG. 44B

```
ref|NP_470039.1|         ------------------------------------------------
ref|ZP_01929325.1|       ------------------------------------------------
ref|YP_848858.1|         ------------------------------------------------
ref|YP_001374688.1|      ------------------------------------------------
ref|NP_622177.1|         ------------------------------------------------
RAAC02381                INEIEQTPVTAPIVAKLRALGAVLGILPANDVRVDSTVEREIQWYEALFALERGDRDQAE ref|NP_470039.1|         ------------------------------------------------
ref|ZP_01929325.1|       ------------------------------------------------
ref|YP_848858.1|         ------------------------------------------------
ref|YP_001374688.1|      ------------------------------------------------
ref|NP_622177.1|         ------------------------------------------------
RAAC02381                RCLRDQPERWERLSEWLTSKQGLCISPILDELLLARVDELLLAWLPRAEDRDLALSRVLA ref|NP_470039.1|         ------------------------------------------------
ref|ZP_01929325.1|       ------------------------------------------------
ref|YP_848858.1|         ------------------------------------------------
ref|YP_001374688.1|      ------------------------------------------------
ref|NP_622177.1|         ------------------------------------------------
RAAC02381                SPLREEVWKAAWLGERGWECDFLALGAFRRRDIQASLNWLERGLTYEPTVRRAIVEIDLA ref|NP_470039.1|         ------------------------------------------------
ref|ZP_01929325.1|       ------------------------------------------------
ref|YP_848858.1|         ------------------------------------------------
ref|YP_001374688.1|      ------------------------------------------------
ref|NP_622177.1|         ------------------------------------------------
RAAC02381                LCHKNIAHAQEVASQASRLFPESKLLEGIAGSLGVSPRPMRSLDDLLGGGSGLNPHRAYQ ref|NP_470039.1|         ------------------------------------------------
ref|ZP_01929325.1|       ------------------------------------------------
ref|YP_848858.1|         ------------------------------------------------
ref|YP_001374688.1|      ------------------------------------------------
ref|NP_622177.1|         ------------------------------------------------
RAAC02381                SSVNSMPLKVKIMKLHERAVECVDQVKALVDQGDIMGARTYIQYVQDIITFLRSNLDTST ref|NP_470039.1|         ------------------------------------------------
ref|ZP_01929325.1|       ------------------------------------------------
ref|YP_848858.1|         ------------------------------------------------
ref|YP_001374688.1|      ------------------------------------------------
ref|NP_622177.1|         ------------------------------------------------
RAAC02381                EAGKAADAAYAYFYKMLVEWFLQPSKVESEYKEMRDFWQSWADTWAKVEA
```

FIG. 45

```
ref|NP_831314.1|           ----------------------LKIGITCYPSVGGSGVVGTELGKQLAERGHEIHFITSG
ref|NP_844008.1|           ----------------------LKIGITCYPSVGGSGVVGTELGKQLAERGHEIHFITSG
ref|ZP_01172765.1|         ----------------------LKIGITCYPTVGGSGVVATELGKLLAERGHEIHFISSS
ref|YP_001487207.1|        ----------------------LKVGITCYPSVGGSGIIATELGKRLAEKGHDVHFITSS
ref|ZP_02327412.1|         ----------------------LKIGITCYPSLGGSGVVATELGKLLAEQGHEVHFIAHS
RAAC00991                  ---------------------MRVGISCYPTVGGSGAVATELGKALARRGHEVHFIVTD
                                                 :::**:***::****  :.***** **.**::***  .

ref|NP_831314.1|           LPFRLNKVYPNIYFHEVTVNQYSVFQYPPYDLALASKMAEVAQRENLDILHVHYAIPHAI
ref|NP_844008.1|           LPFRLNKVYPNIYFHEVTVNQYSVFQYPPYDLALASKMAEVAQRENLDILHVHYAIPHAI
ref|ZP_01172765.1|         LPFRLNRMYHNIFYHQVEVSQYSVFQYPPYDIALASKMAEVINREKLDLMHVHYAVPHAV
ref|YP_001487207.1|        IPFRLNKVYPNIYFHEVDVNQYAVFQYPPYDLALASKLAEVARREKLDIIHAHYAVPHAV
ref|ZP_02327412.1|         MPFRLGRFDKNVFYHEVEVSDYYVFKYPPYDLSLASKLAQVARMQELDLLHVHYAIPHAV
RAAC00991                  VPFRLGAFVEHVYIHQIEPITYPVLKTPPYDFALASLMARVADEYQLDVLHAHYALPFAV
                            :****.  .  ::: *::   * *:: ****::*** :*.*     :**::*.***:*.*:

ref|NP_831314.1|           CAYLAKQMIGERIKIVTTLHGTDITVLGSDPSLNNLIRFGIEQSDVVTAVSHSLINETHE
ref|NP_844008.1|           CAYLAKQMIGERIKIVTTLHGTDITVLGSDPSLNNLIRFGIEQSDVVTAVSHSLINETHE
ref|ZP_01172765.1|         CAILAKQMSGRDVKIATTLHGTDITVLGYEPSLKDSIRFGIEKSDRVTAVSKSLISQTNE
ref|YP_001487207.1|        CAYLAKQMTGHSVKVVTTLHGTDITVLGYDPSLKEVIRFAIESSDRVTAVSHSLAAQTYD
ref|ZP_02327412.1|         CALLAKQMVGDHLKVVTTLHGTDITVLAQDASISNMIRFAINESDAVTAVSEDLIRETRQ
RAAC00991                  CAHLAREMAKHPIRVVTTLHGTDITVLAQDPSLKSIIKLGIERSDAVTAVSQSLVRDTAR
                            ::*        :::.***********  :..*:..  *::.*:  ***..*   :* ref|NP_831314.1|           LVKPSKEIQTVYNFIDERVYFKRNMSQLKKEYGISESEKVLIHISNFRKVKRVQDVVQAF
ref|NP_844008.1|           LVKPNKDIQTVYNFIDERVYFKRDMTQLKKEYGISESEKILIHISNFRKVKRVQDVVQAF
ref|ZP_01172765.1|         LIHPEKEIQAVYNFIDHRVYQKTGSDHLKKEYGITEDEKTVIHVSNFRAVKRVQDVVKVF
ref|YP_001487207.1|        LIKPNKKIETIHNFVDERVYLRDDHNVLKRHYGLLDHEKVVIHVSNFRKVKRVHDVIHVF
ref|ZP_02327412.1|         TLDIQKPIHKIYNFVDKRMYYPRPVEDLKREVTRP-GEKLFIHISNFRPVKRVHDVVQIF
RAAC00991                  LFETDKPIRCIYNFVDPDVFRPGCGGELKRHFAPN-GERVLLHISNFRPVKRLHDVIAVF
                            ..  . *  *.  ::**:* ::           **:.      *:  .:*:**  *:***:  * ref|NP_831314.1|           AKIVKEVDAKLLLVGDGPEFCTILQIVKNLHIEDRVLFLGKQDNVAELLAMSDLMLLLSE
ref|NP_844008.1|           AKIVTEVDAKLLLVGDGPEFCTILQLVKNLHIEDRVLFLGKQDNVAELLAMSDLMLLLSE
ref|ZP_01172765.1|         ARIESEMPAKLLLVGDGPEMSNVCKLVKELGLKEKVLFLGKQDKVEELYSISDLMLLLSE
ref|YP_001487207.1|        KKISEQVNAKLLLLIGDGPEKSVVCELVKKLGLTDRVLFLGKQEKVEELYSISDLKLLLSE
ref|ZP_02327412.1|         ARVHREIPSRLLLVGEGLELSRIVSEVRELGLQDFVEFWGKQDDVAQVISLADVMLLPSE
RAAC00991                  ERVARRMPAKLLLVGEGPDLGAAKRQVEEAGLGDRVHFLGRQDEVAPLFAAADLFLLPSE
                            ::   .:  ::***:*:* :       *.:  : : * *:*::.*    :  :  :*: ** **

ref|NP_831314.1|           KESFGLVLLEAMACGVPCIGTRVGGIPEVIQHGETGYLCEVGDTTGVANQAIQLLKDEEL
ref|NP_844008.1|           KESFGLVLLEAMACGVPCIGTRVGGIPEVIQHGDTGYLCEVGDTTGVADQAIQLLKDEEL
ref|ZP_01172765.1|         KESFGLVALEAMACGVPCIGTNIGGIPEVISDGETGYICKLGDIGSMAEKAAGLLADADK
ref|YP_001487207.1|        KESFGLVLLEAMACGVPCIGTDVGGIPEVITHGETGFLVPLGDIDAAAKHAVSILKDKAL
ref|ZP_02327412.1|         KESFGLVALEAMACGVPTVGSNAGGIPELITHGETGFMAEVGDVDTMSKYTIRLLEDEEL
RAAC00991                  SESFGLVALEAMSCGVPVVGSTAGGIPEVVHGETGFLAPVGRVDDMADLACKLLQDEAT
                           .**** :**  :*:  *****::  .*:**::   :*    :.  :  :* * ref|NP_831314.1|           HRNMGERARESVYEQFRSEKIVSQYETIYYDVLRDDK----------
ref|NP_844008.1|           HRNMGERARESVYEQFRSEKIVSQYETIYYDVLRDDK----------
ref|ZP_01172765.1|         HTSFSHRAVQTAREKFSAEQIVSEYERLYFDML--------------
ref|YP_001487207.1|        HEQVSAAAQSSVQAHFSSEKIVSEYEELYLELIEGD-----------
ref|ZP_02327412.1|         LKRVSEACVQRARKKFCNDSLRARYEQVYYEVL--------------
RAAC00991                  YRAFSARARERAVRAFHVDEKVSEYEALYREVMAAERGEHAHPRPGA
                            ..   ...   *   :.  :.**  :*  :::
```

FIG. 46

```
ref|YP_001647987.1|    -----------AGAEDGGGKTHIISLLDQFPDGEVE-------LAVFEDGIVAKEARELG
ref|NP_835081.1|       -----------AGAEDGGGKTHIISLLDQFPTGEVE-------LAVFEDGIVAKEARELG
ref|YP_001377114.1|    -----------AGAEDGGGKTHIISLLDQFPTDEVE-------LAVFEDGIVAREAREIG
ref|YP_001127183.1|    ------VLHVISGGETGGSRKHVVTLLSKFAPGTAT-------LVVFQDGPLAAEARQAG
ref|ZP_02038504.1|     ------VIHLISGGDSGGAKTHVHMLLQNLSRTPGVEVT----MVCFMEGPFSQEARELG
RAAC00650              MASERTVIVFFAGNEVGGAATHLATWAKALKGAQVDYRYR---FVSLGDGPLADELRQMG
                            :*  :  **. .*:           . :            :. . :* .: * *: * ref|YP_001647987.1|    IKVHVFSQKSRYDLSILKNISEFINKEKFDVVHTHGPRANFFVSLMKKKFAAKWVTTIHS
ref|NP_835081.1|       IKVHVFSQKSRYDLSILKNISEFINKEKFDVVHTHGPRANFYVSLMKKRIKAKWVTTIHS
ref|YP_001377114.1|    IKVHVFSQKSRYDLSILKNISRFINEEQFDIVHTHGPRANFYVSLMKKRIAAKWVTTIHS
ref|YP_001127183.1|    IDVRLLAQSSRYDLSVLSKLVALIRRERPFDILHTHGPRANLYGALIKRKIAIPWMTTVHS
ref|ZP_02038504.1|     ISTVVLPGKN--IFRTFHTLKNMIREGGYEIIHCHGARGNMMGALLRKATGLPVVTTVHS
RAAC00650              MLHGAVAGTVG----AIRDLARVLRRERAWILHSHGPRMNMLASFAASSAGAIWTATIHS
                       :     .. .        :    :  .:..      ::* **.* *:   ::        :*:**

ref|YP_001647987.1|    DPFQDFTKQGLKGWIFTKLNLKALKNIDLFFVVTNRLKKSLAALGISNEKMHVIYNGIEY
ref|NP_835081.1|       DPFQDFTKQGLKGWIFTKLNLKALKNIDLFFVVTNRLKKSLAALGISNEKMHVIYNGIEY
ref|YP_001377114.1|    DPFQDFTKQGLKGWIFTKLNLKALKDIDLFFVVTNRLKKSLEQLGISSEKMRVIYNGIEY
ref|YP_001127183.1|    DPRLDFMKSGWKGKWFTRLNVWALQKVDYFFAVSERFKESLMELGIAAERIQTIYNGIDF
ref|ZP_02038504.1|     DYRLDYMGRPISRITYGTINTLALRLLDYRIGVSDAMTDLLISRGFDPDKLFTIYNGIDF
RAAC00650              HPRYDFEGHPLKAALFPSLHLWRLSRARGLFVVQPALGDALPCR-TILEVPNAFFPRLPR
                       .  *:         . :  ::       *       : *   :  . *     :      .::  :

ref|YP_001647987.1|    DQEKADGYN--------KKEMFNIDEDVFTAIQVARLHPVKGHEVLFDALQQTKL--EKI
ref|NP_835081.1|       DKEKAEGYN--------KKEMFNIDEDVFTAIQVARLHPVKGHEVLFDALQQTKL--EKI
ref|YP_001377114.1|    DKEKAQGYD--------KKEKFHIEEDVFTAIQVARLHPVKGHEVLFDALNNTSL--TKI
ref|YP_001127183.1|    DDAPRPHM--------LQRADLGLREDDLVIAMVARLHPIKGHALVFEALASLSD--PDM
ref|ZP_02038504.1|     TPRTPSMTR----SEYLKSVGANWPEDCVVAGIAARLNPVKDIPTLIRGFAQARQSCPKL
RAAC00650              ASRDVCAAE-------WRRRLGLNPESRLIGIAARLDPVKQIDVAIAALALLSD--LDV
                                              :             .***.*:*      :   .:          ..

ref|YP_001647987.1|    KVLLVGDGPLERELKALATEKGINDKVEFLGHRQDVKQLFASSHVNLLTSHSEGFPLVLL
ref|NP_835081.1|       KVLLVGDGPLEENLKSLATEKGINDKVEFLGHRQDVKQLFASSHVNLLTSHSEGFPLVLL
ref|YP_001377114.1|    KVLLVGDGPLEEDLKALAKEKGIDDKVQFLGHRQDVKQLFASAHINLLTSHSEGFPLVLL
ref|YP_001127183.1|    KLLVVGDGPLASELREKATQSGIGRQVQFLGFRRDVADIYALSDVALMASYSESFPLALL
ref|ZP_02038504.1|     RLLIAGDGEQMNELKALAADLGVAEDVCFAGWVSDVDSFYGALDINTLTSLSETFPYSLT
RAAC00650              HLLVAGDGRDRIRLEAAAEDCGVRHRVHFLGHLQDVRDLYCAIDVHVLPSKSEGAPTSML
                       ::*:.***       *.  * *:  * *   ** .::   .:   :.* **   *   :

ref|YP_001647987.1|    EAANQRVPSIVTRAGEIEPLIADETYGWIVPTGDGKALASAL------------------
ref|NP_835081.1|       EAANQRVPSIVTRAGEIEPLIVDETYGWIVPTGDGKALALAL------------------
ref|YP_001377114.1|    EAANQRVPSIVTRAGEIEPLIVDDTYGWVVPVGDGKALANALEQ----------------
ref|YP_001127183.1|    EAANERLPVISTDVGGVSQLIASSDMGWIVPVGDRAALAQAMREARSRRHELKTMGKRLY
ref|ZP_02038504.1|     EGARAGLPTVASRVGGVPYLIDHGVNGLLFEAGDYETLAKHLTALASDETMRTHMGQRLY
RAAC00650              EAGYYGAANIGSDVPGIRRMLLDGEAGALVPSGDVQALAHAVRRLLTDTKARDAYVERFQ
                       *..      .  :   . :   : ::       *  :.  **  :**    :

ref|YP_001647987.1|    ------------------------------------------
ref|NP_835081.1|       ------------------------------------------
ref|YP_001377114.1|    ------------------------------------------
ref|YP_001127183.1|    EHASTHFSLQRLYEETM-ATYER-------------------
ref|ZP_02038504.1|     QKGKNDYSLESTLQRQLEIYSVI-------------------
RAAC00650              RLVLPRYRPERMVVAYERGYTVIEEDAVRSGWRLPANSEQTR
```

FIG. 47

```
ref|YP_001486101.1|      --QFIVSQEDWSLHRKGYDDQQRHQKKVKEAIKNNLPDLVTEESIIMSNGKDVVKIPIRS
ref|ZP_01170532.1|       --QFVISEEDWSLHRKGHDDQQRHQEKVQDAIRNNLPDLITEESIIMSNGREVVKIPIRS
ref|NP_241897.1|         ---FVVSQENWTLHRKGYQDQRRHQEKVKEAIRKNLPDLVSEENIIMSNGREVIKIPIRS
ref|ZP_01721811.1|       ---FVISQENWSLHRKGHQDQQRHMEKVKDAIKNNLPDLVSEESIVMSNGREVIKIPIRS
ref|ZP_02327994.1|       ---FIVSRENWSLHRKGYQDQTRHQQKIKDAIKQNLPDLVTEENIILSNGKQIIKIPIRS
RAAC02421                MVEFTLQREDWSLHRKGHIDQERHREKVREAIREHLADLVSDESLIMSDGKQIIKIPIRS
                              *  :..*:*:***:  ** :*:::**:::*.**:::*.:::*:*:::****** ref|YP_001486101.1|      LDEYKIRYNYDKNKHVGQGDGDSEVGDIVARDG--SDSKQGQGKGQSAGDQAGE--DYYE
ref|ZP_01170532.1|       LDEYKIRYNYDKNKHVGQGDGDSQVGDVVARDG--SSGQKGPGKGQGAGDQPGE--DYFE
ref|NP_241897.1|         LDEYKIRYNYDKNKHVGQGDGDSQVGDVIARDP--SAGQQGPGKGQGAGDQPGE--DYFE
ref|ZP_01721811.1|       LDEFKIRYNYDNSKHVGQGQGDSNVGDVVARDG--SKANQTQGKGKEAGDKPGQ--DYYE
ref|ZP_02327994.1|       LDEYRFRFNYNKSKHVGQGDGDSQVGDVLG-----IDPYTQQGKGQAGAGDQAGE--DYYE
RAAC02421                LEEYRIRYNFQKGKHVGSGSGDTAVGDLVARGKPDADGQPGPGQGEGAGSEPGV--DYAE
                         *:*:::*:*:::.****.*.: *::.         *:*  **.:.*    ** * ref|YP_001486101.1|      AEVSLMDLEEALFRELELPNLKQKELDDIIVEQIEFNDIRKTGLTGNIHKKRTMLSAFKR
ref|ZP_01170532.1|       AEVSMMELEEALFKQLELPNLKRKEQEEHLVENIEFNDIRKTGLMGNIDKKRTMMTAFKR
ref|NP_241897.1|         AEVSILELEEELLFRELELPNLQQKEEDHLVVEHIEFNDIRKKGLMGNIDKKRRTILSAIKR
ref|ZP_01721811.1|       AEVSLEEIQNVLFHELELPNLQQKEKAEIVTEKIEFNDIRKKGLMGNVDKKRTILNALKR
ref|ZP_02327994.1|       AEVDMEELQSLLFEELELPYLNPKERLDISTQDIIFNDIRKKGIMSNIDKKRTILENIRR
RAAC02421                AEVTLEDIQQELFRELELPDLAEKDEADMVVDTVEFRDVRKKGITANIDKKRTLLQALRH
                         ***   :  ::.. **.:**** *   *:    .:  *.*:**.*: .*:.*:**::   :::

ref|YP_001486101.1|      NAMTGSPSFYPIYPEDIKYKTWNEVTKPESKAVVLAMMDTSGSMGLWEKYMARSFFFWMT
ref|ZP_01170532.1|       NAMTGKPAFYPIYQEDLKFKTWNEIVKPDSKAVVLAMMDTSGSMGLWEKYMARSFFFWMT
ref|NP_241897.1|         NALEGRPGLIPIYNDDLRFKTWNEVVRPESKAVVLAMMDTSGSMGRWEKYMARSFFFWMT
ref|ZP_01721811.1|       NAMHGKAEITPIHNDDLRFKIWDEVVKPESKAVVLAMMDTSGSMGAFEKYCARSFFFWMT
ref|ZP_02327994.1|       NASSGTPGIHGISPDDLRFKTWDEIEKPHSNALILAMMDTSGSMGSFEKYIARSFFFWMT
RAAC02421                AKKDDR---VVITPDDLRYKTWETIVKPDSNAVILAMMDLSGSMGLFEKYCARTFFFWMT
                         .    *  :*:::*  *:  : :*.*:*::*** *  :* :**** ref|YP_001486101.1|      RFLRTKYETVDIEFIAHHTEAKVVDEEHFFSRGESGGTICSSVYRKALELIDERYPPSRY
ref|ZP_01170532.1|       RFLRTKYETVEIEFIAHHTEAKVVDEEFFSKGESGGTICSSAYRKALELINEKYNPRRF
ref|NP_241897.1|         RFLRTKYETVDIEFIAHHTEAKVVSEEDFFSKGESGGTICSSAYRKALELINEKYDPARY
ref|ZP_01721811.1|       KFLRSKYETVEIEFIAHHTEAKVVTEEEFFTKGESGGTICSSAYKKALELIKEKYSPSRY
ref|ZP_02327994.1|       RFLRSKYEHVDIVFIAHHTEARIVSEEEFFTKGESGGTICSSAYQAALDVIDRSYPPSKY
RAAC02421                RFLRTKYANVQIRYIAHHTEAHEVDEEYFFTKGESGGTICSSAYQYALDMVNREYPPERY
                         :***:**  *:* :*******:  *  **:: ********** .*:  **:::..  * *  ::

ref|YP_001486101.1|      NIYPFHFSDGDNLTSDNARCVKLVSEIMKKANLFCYGEVNQYNRHSTLMSAYKHIQDEKF
ref|ZP_01170532.1|       NIYPFHFSDGDNLTSDNARCVKLVEELIAVSSMFGYGEVNQYNRHSTLMSAYKNIKNEHF
ref|NP_241897.1|         NIYPFHFSDGDNLTSDNARCLKLVHELMESSSMFGYGEVNQHNRFSTLMSAYKNLKDPRF
ref|ZP_01721811.1|       NIYPVHFSDGENISMDNEKCLKLVAELMDVSSMFGYGEVNQHNRFSTLMYTYKKIDDPKF
ref|ZP_02327994.1|       NIYPFHFSDGDNLTSDNERCVKLIQRLMERSNMFGYGEVNQYNRSSTLMQTYRHIQDPKF
RAAC02421                NIYSIHFSDGDNLTSDNEKCVQLVKELSSVSRMFGYAEVNQYSRSSTLMSAYGKLQIPRF
                         *..***:*::  ** :*::*:  .:    : :* *.****:.* ****  :*  :::  :* ref|YP_001486101.1|      KHYILKQKSDVFLALKKFFQQEE-----
ref|ZP_01170532.1|       RYYILKQKADVFHAMKSFFQNEE-----
ref|NP_241897.1|         RSYVLKEKGDVYRAMKTFFKKEE-----
ref|ZP_01721811.1|       RHHILRKKGDVYDALKSFFKKNE-----
ref|ZP_02327994.1|       LYYIIREKGEVYKALKTFFAKPEG----
RAAC02421                RTYVIRDKSEIYGALRHFFSQQQGVKSA
                         :::::.*.::: *::  **  ::  :
```

FIG. 48A

```
ref|ZP_01860158.1|         ------------------------------------------------------------
ref|YP_001421751.1|        ------------------------------------------------------------
ref|YP_148164.1|           ------------------------------------------------------------
ref|YP_001126336.1|        ------------------------------------------------------------
ref|NP_242401.1|           ------------------------------------------------------------
RAAC02142                  MTLRGIGCVVPLRLAHTNADFDSVDSERGGCRMKRHSRALGLGLGALCLVATSAAPQVAR ref|ZP_01860158.1|         ----------------PFASAEEKKT-ELAAGAKSAILIERDTGTVLYDKNSHEKLPPAS
ref|YP_001421751.1|        ----------TASAPSAFAKPDGKHTSELAHEAKSAVLIERDTGSILYNKNSRERLAPAS
ref|YP_148164.1|           ------------------------AKVKLADEAKSAILIERDTGKVLYEKNAHEPLPPAS
ref|YP_001126336.1|        -------------------------ELADEAKSAILIERDTGKVLYEKNPHEKLPPAS
ref|NP_242401.1|           ----------------PVGLAAEKQPNLAKEASSAIVIERDTGQVLFEKNSDEKLPPAS
RAAC02142                  AASAPGIVQIREAADAGPTQSAPAASVDLAKQARSAVLMDFATGKVLYAKNAHERLPMAS
                                               .**   * **::::   ** :*: **. * *. **

ref|ZP_01860158.1|         MTKIMTMILIMEALDKGQIKWEDEVRTSEYAASMGGSQIFLEPGEVMTVKEMLLGISIGS
ref|YP_001421751.1|        MTKIMTMLLIMEALDKGKIKMSDKVRTSEHAASMGGSQIFLEPGEEMTVKEMLKGIAIAS
ref|YP_148164.1|           MTKIMTMLLVMEAIDEGKLSYDEKVRASEYAASMGGSQIFLEPGEEMTVDELLRGIAIGS
ref|YP_001126336.1|        MTKIMTMLLIMEAIDEGKLSYDEKVRTSEYAASMGGSQIFLEPGEEMTVDELLRAIAIGS
ref|NP_242401.1|           MTKIMTLLLIMEAIDSGKITYDDMVRTSENAASMGGSQVFLEPGEEMSVRDMIKAIAIAS
RAAC02142                  ITKIMTLLLIFEAIDSGKLKWTDRVQASERAASMGGSQIFLEPGETMTVRDLVKGIAIAS
                           :*****::*::**:*.*::.   : *: **** :***** *:* .::  .*:*.* ref|ZP_01860158.1|         ANDASVAMAEHIAGSEEGFVEKMNNKVKDLGLKDTNFKNPTGLPASEHYSSAHDMAMMAK
ref|YP_001421751.1|        GNDASVAMAEYIAGSEEDFVSRMNKKAKELGLKDTSFKNPTGLPEKDHYSSAYDMAKMAK
ref|YP_148164.1|           ANDASVAMAEQIAGSEEAFVEMMNEKAKQLGLKNTHFANATGLPAEHHYSSAYDMAMMAR
ref|YP_001126336.1|        ANDASVAMAERIAGSEEAFVEMMNEKAKELGLKETKFANTTGLPAEGHYSSAYDMAIMAR
ref|NP_242401.1|           GNDASVAMAEHLAGTEEEFVGMMNEKARQLGLKNTNFVNTNGLPEKDHYTSAYDLAMISK
RAAC02142                  ANDACVAMAEHLDGSEEAFVARMNQRAKELGMTDTHFANCNGLPAPNHYSSAHDIAVMSR
                           .***.***** :  *:** ** **:: .:**..:*  * * .***  **:**:*:* :::

ref|ZP_01860158.1|         ELLKYQEITKYTGTYESYLREDTDKKFWLVNTNKLVRFYPGVDGLKTGFTNEAKYCLTAT
ref|YP_001421751.1|        ELLKYDKITQFTGTYEDYLRENTDKKFWLVNTNRLIKFYPGVDGVKTGFTGEAKYCLTAT
ref|YP_148164.1|           ELLKYEDITKYTSKYEDYLRENTDKKFWLVNTNRLVKFYPGVDGLKTGYTAEAKYCLTAT
ref|YP_001126336.1|        ELLKYEGITKYTSKYEDYLRENTDKKFWLVNTNRLVKFYPGVDGLKTGFTSEAGYCLTAT
ref|NP_242401.1|           ELLKYEDITEFTSVYEDYLRKGTDKEFWLVNTNRLVKFYPGVDGLKTGFTKEAKYCLTAT
RAAC02142                  ALLMHPEITAFTSVYSDYLRKDTDHPLWLVNTNKLVRFYDGVDGLKTGYTQEAKYCLSAT
                           **  :   **  :*.   *.***:.**:  :*******:*:** **** ***:** ***:**

ref|ZP_01860158.1|         AKKDNMRVIAVVFGEPTPKDRNAEISKMFDYAFSQYQTQPLFEKGASVGKAEISKGKAKE
ref|YP_001421751.1|        AKKGNMRVIAVVFGASTPKERNAQVTKMLDYAFSQFKTHPLYKRDQIVGTVKVKKGKQKL
ref|YP_148164.1|           AKKNGMRVIAVVFGAPTPKSRNAQITKMLDYAFSQYRTHPVYKRNETVARVNISKGKRSS
ref|YP_001126336.1|        AKKNGMRVIAVVFGAPTPKSRNAQITKMLDYAFHHYQAHPVYKRNETVARVDVSKGKQKS
ref|NP_242401.1|           AVKNGMRVITVVMGAPTPKERNSQITEMLDFAFSQYQTHQVYERDTYMMDLNVRKGNKKS
RAAC02142                  AKRDGFRVIAVVMGEPKPTVRNAEIAAMLNYAFAHYKSVQVYPRGHVVGQVAVKRGTRDR
                           * :...:***:**:* ..*. **::::  *:::**  :::    :: :.   :  :*.  .

ref|ZP_01860158.1|         VEAMTNEPISLLAKKGEKLDGIEKKVKLQK--LKAPVKKGDTIGKLVVEKDGKTLSETPL
ref|YP_001421751.1|        IKLTTSEPISLLAKKGENMDKVKKEVKING-NVTAPVKKGEVLGSLVLKKDGKVLVESPV
ref|YP_148164.1|           VEAVTSEPVSVLTKKGQSVEQIEKVIKVKD-NVKAPVRKGDELGVLILKQDGKEILHSPI
ref|YP_001126336.1|        VAAVTSEPVSVLTKKGQSVEQIEKVVKVKD-GVKAPVRKGDELGVLILKQDGKEILRSPL
ref|NP_242401.1|           VPIFTSESVSLVTKKGESIDNVTERVEWKE-SLLAPVHKGDVVGTLYLERDGEILSETPL
RAAC02142                  VEAVTAEPVAFVTERS-SKTAYTTEIQWMT--LKAPVSRGQVVGHVLVKSGGQIVANVPV
                           :    * *.::.:::. .          ::         : *** :*: :*  : :: .*:
```

FIG. 48B

```
ref|ZP_01860158.1|      IAKEDVPQASFWQ----------------
ref|YP_001421751.1|     TAKDDMEKAGFLTFLKRTM----------
ref|YP_148164.1|        VAKQTVEEASFWDLFKRVFGRFVQAG---
ref|YP_001126336.1|     VAKQTVAEASFWDLFKRVFGRFVQAG---
ref|NP_242401.1|        IAGEDVASASFWQMFKRIVGK--------
RAAC02142               VAKDDVPKATFFQSLGKTVKKVITFGQAQ
                         *  :  :  .*  *
```

FIG. 49A

```
emb|CAA04971.1|     ------------------------VQLLRPLPDPVLTLRDSASSTTLGGDRISIPWPKEG
gb|AAC32488.1|      ------------------------VQLLRPLPDPVLTLRDSASSTTLGGDRISIPWPKEG
ref|NP_824958.1|    ------------------------VAQAVRPLPTPTLGLTADETYTFEGG-KLDLPWPGQG
ref|NP_628606.1|    ------------------------VVQSMRPLPAPTLDLTAQDSFSFDGG-KPQIPWPESG
ref|ZP_02061285.1|  ----------------------------------------------------ISWPTDI
RAAC03015           MVVRSLRGFVIAIVIAIIVIGVPVLQLVRPIPQAASDVAAPLPRAIPGE-KPVIHWPSQG
                                                                          : ** .

emb|CAA04971.1|     QGAVTVAGSGVYETFGP-EKSVPTASTAKIMTAYVLLRKHPLKRGEPGPTITV---DAQT
gb|AAC32488.1|      QGAVTVAGSGVYETFGP-EKSVPTASTAKIMTAYVLLRKHPLKRGEPGPTITV---DAQT
ref|NP_824958.1|    QSAVEVEGVGTVGTAGK-QAPKPIASVAKIMTAYVILEEHPLKGTAAGDKITV---DQQA
ref|NP_628606.1|    QAALDVQGIGSFGSSGD-QKPVPIASVAKVMTAYLVLRDHPLKSGAEGPKIKI---DQAA
ref|ZP_02061285.1|  RYGVIGTLQSGIISKNPNQGQWPLASVAKIMTAYIILKDHPLPIGQDGPTITVTQKEVNE
RAAC03015           EAALMADGVGSFGSSGP-QVPVPIASVTKVMTAYLVLQKHPLQLGQQGPSITITPDDVKV
                     ..:      .    :  :     *  **.:*:****::*..***    * .*.:    :

emb|CAA04971.1|     VAEGKAKDESRIEGLTEGQTFSQQDMLKMLMIPSGNNIGRLLARWSTKTDDQTAFVREMN
gb|AAC32488.1|      VAEGKAKDESRIEGLTEGQTFSQQDMLKMLMIPSGNNIGRLLARWSTKTDDQTAFVREMN
ref|NP_824958.1|    EDESKNEDES-TAAMTKGQKFTERQMLQMLMIPSGNNAARLLARW---DSDSETFVGKMN
ref|NP_628606.1|    EDQSQAGQES-TVDVFAGDSISQREALQAILIASANNVARLLARWD--AGSEKAFVEKMN
ref|ZP_02061285.1|  YEAFKKDGQS-VVKVALGEKLTERQLLEGLMIPSANNFAYILARWD--AGSVKAFVDKMN
RAAC03015           YERDKALGQS-VVKVAAGEQITEYQALEGLLLPSGNNMGTLLAKWC--DGSVQAFVQEMN
                     :     :*    : *: ::: : *: :::.*.**  . :**:*    .. :** :**

emb|CAA04971.1|     EAAKDLGMKNTVYTDPSGLDKGTVSTAVDQLKLAEAVMEYDVFRDVVALPNAEIPG-HGR
gb|AAC32488.1|      EAAKDLGMKNTVYTDPSGLDKGTVSTAVDQLKLAEAVMEYDVFRDVVALPNAEIPG-HGR
ref|NP_824958.1|    AAAKKLGMTNSTYTDPSGLEKTTVSTATDQLKLAKAVMQKEVFRSIVGMAKADIPGLKGT
ref|NP_628606.1|    GAAKDLGMTNTTYTDPSGLNNTTVSTAVDQVKLAKAAMKEPAFREVAAMMSYNDYK--GE
ref|ZP_02061285.1|  KTAQSLGLKDTRYEDPSGASAGTVSTPKDQFKLTQLAMQIPTFRHMVAMPQVNLPI-AGI
RAAC03015           ATAKRLGMTETHYADPTGYSPASQSDAVDQMKLFALAMQNPVFRQIVGEAQAELPV-AGL
                     :*: **:.:: * **:* . :  * . .. .*: .** :..  . :     * emb|CAA04971.1|     IYNNNDRLILAGLG-IVGIKTGSNTPAGGTLSWAAYKTFDGEDRLILGTMMAQHAPGPDI
gb|AAC32488.1|      IYNNNDRLILAGLG-IVGIKTGSNTPAGGTLSWAAYKTFDGEDRLILGTMMAQHAPGPDI
ref|NP_824958.1|    IYNNND-LLVKQVG-VIGLKTGSSTPAGGNLVWAATKTVNGKVRTIYGAVLNQDAGTG--
ref|NP_628606.1|    NHGNWN-QLVGHNG-VVGIKTGTTTSALGNLVFAAKKEVGGETRTIVGAVVRQPDVGG--
ref|ZP_02061285.1|  QYNVNY---DLGKDNIVGVKTGSSLPAGANFVFDSKQ--GNIDIL--GVIFGASGKSS--
RAAC03015           VYNVDS---VVGHGTIIGGKTGSTLEAGGCFVFAARKVIGNREVLIIGAVLGQKGPQP--
                     :.           . ::* ***:.  *  .:  : :   ..     *.: .

emb|CAA04971.1|     NGGDSLVLVQDNSRKVVASVREMLTSANVVKKGEVVGHVDDRFGR-RIPVVTTKSLDLVG
gb|AAC32488.1|      NGGDSLVLVQDNSRKVVASVREMLTSANVVKKGEVVGHVDDRFGR-RIPVVTTKSLDLVG
ref|NP_824958.1|    RVWDSLQLALTNSQKLIDKVQGGLISAPVVKKGQVVGYVDDQLGG-RTPVVATENMTAVG
ref|NP_628606.1|    ---GILDAALDASDELIRAAQDTLKSSTIIKKGSVVGYVDDGLGG-RTPVVASQDVKAVG
ref|ZP_02061285.1|  -----LMTALKDAIILIDTTKTQISTEKLISKNQQIGFIKVSWMKKEIPMLASQDFSTVV
RAAC03015           -----LAEALTAAVAMSQDAQKALRSVQLVSAGQTVGTLSAPWAK-PVSLVATEPVQVIG
                         *   .   :  :    .: : :   ::.   ...:*  :.      .::::: :

emb|CAA04971.1|     LSGQKVTLTYGRKGDGALSRTARAGAVVGELTVGNGPDAHRIPLALKEGLTEPSLGTRLT
gb|AAC32488.1|      LSGQKVTLTYGRKGDGALSRTARAGAVVGELTVGNGPDAHRIPLALKEGLTEPSLGTRLT
ref|NP_824958.1|    WPGLKTKISIG-AGDTTVPHEAKAGKVVGELTVGDGS-----------------------
ref|NP_628606.1|    WGGLTVKLTFTAD-----------------------------------------------
ref|ZP_02061285.1|  YPGMKI--TYSLYPIKDMKFPIKSNEVIGTLVINYG------------------------
RAAC03015           WGGLPVQQTYRAD-VLDPKKPIAADQVVGQLQIQVGAQTVRVPVAAASSVPAPTLSWRMK
                       *     :
```

FIG. 49B

```
emb|CAA04971.1|        RL
gb|AAC32488.1|         RL
ref|NP_824958.1|       --
ref|NP_628606.1|       --
ref|ZP_02061285.1|     --
RAAC03015              RL
```

FIG. 50A

```
ref|YP_001663198.1|        ------------------------------------------------------------
ref|YP_001665129.1|        ------------------------------------------------------------
ref|YP_430213.1|           ------------------------------------------------------------
ref|YP_001212426.1|        ------------------------------------------------------------
ref|YP_360920.1|           ------------------------------------------------------------
RAAC02227                  MHVYESRFWRWLGRMTSRLIRLGCAALAAAASLAVYQPAVRAERSTSPPVATESLIPRED ref|YP_001663198.1|        ---------------AESYPSISAKAAIVMDQETGRVLYEKNPHEKLPMASTTKIMTLL
ref|YP_001665129.1|        ---------------AESYPSISAKAAIVMDQETGRVLYEKNPHEKLPMASTTKIMTLL
ref|YP_430213.1|           -------------------PDIQAESYVLMDFRTGQVLMAKNPHERRPQAITTKITTAI
ref|YP_001212426.1|        ---------------ASSGPEIVGEAAVVIDIKNGQVLFEKNPDRRVYPASTTKIMTAV
ref|YP_360920.1|           -------------------PQIIGRAAAVINVNSGKFVYLKNADQKMYPASTTKIMTTL
RAAC02227                  VLNVQSGPIPYVVGEDASSWPSIVSQAAVVMDMDTGAVVYAKHSTAPHYPASITKIMTAL
                                          *.*  ..:  :::  .* .: *:.    *  *** * :

ref|YP_001663198.1|        VALEKGNLNDIVTVSKRAASVGGSSIWLSPGEKIDMESLLYGLMLNSGNDAATAIAEHIG
ref|YP_001665129.1|        VALEKGNLNDIVTVSKRAASVGGSSIWLSPGEKIDMESLLYGLMLNSGNDAATAIAEHIG
ref|YP_430213.1|           LALERGNLNDQVIASKNAAETPESSIYLQEGETLTLEELLYALLLRSANDAAVAIAEHIG
ref|YP_001212426.1|        IALENGRLDAAVAVPGEACNIEGSSIGLQEGEKISLEDLLYALMLNSGNDTAVAIACHVG
ref|YP_360920.1|           IALEKGNLSDRVYIDKEACYVEGSAIWLNPGEQLSLEDLLYSIMLNSANDSAIAVAKYIG
RAAC02227                  LALRLGHLTDVLTASTDAVRQPPDKLYMRAGEKATLKDLLYGLLIDSANDAAVEIAERYG
                           :**. *.*   :    *     . :  :     ::.*.::: *.**:*  :*   * ref|YP_001663198.1|        GSVENFIEIMNQKAREIGAYNTHFVTPSGLDIGIDDHYTTAYDLALITRYAFRYPKFAEI
ref|YP_001665129.1|        GSVENFIEIMNQKAREIGAYNTHFVTPSGLDIGIDDHYTTAYDLALITRYAFRYPKFAEI
ref|YP_430213.1|           GSVENFARMMNAKVQEIGARDTHYVNPHGLTA--PDHYSSAYDLALIGRYAMMNPKFREI
ref|YP_001212426.1|        GSVEAFVSMMNKKAAELGAVNTHFNNPNGLPD--PGHYSTAYDMALISRYAMQNPEFRKI
ref|YP_360920.1|           GDVATFVQEMNDKARELGAKNTHFVNPNGLPN--DDHYTTARDLALIARAAMQNPKFREI
RAAC02227                  GSVAHFADMMNAEARALGATHTHFVNPSGLPD--PRHVTTAYDMAVIARAAMQIPEFRTI
                           *.*  *      :.  : .**:.* **        * ::* *:*:* * *:  *:* * ref|YP_001663198.1|        VSTKEKTIPWEGKEWDRYLRNKNKLLW---IYEGADGVKTGFTNKAGRCLVSSATRDGRR
ref|YP_001665129.1|        VSTKEKTIPWEGREWDRYLRNKNKLLW---IYEGADGVKTGFTNKAGRCLVSSASREGRR
ref|YP_430213.1|           VATRQRIIPWAGKPWPRLLINENRLLWGYYAYPGADGVKNGYTTPAGQVLVASATRDNWR
ref|YP_001212426.1|        VSTRVKTIRRSVPDAQVYLENHNRLLW---LYEGATGVKTGYTVEAGQCLVSSAARQGRE
ref|YP_360920.1|           AATKTKVINR-DPKYLRFLQNHNKLLW---RYEGANGIKTGYTVKARQCLVASAARDGEE
RAAC02227                  VDTRS--FDWKGTAWQATLTNLNRMLF---TYPGAIGVKTGFTSVAHETLVVAATRGGTT
                           . *:    :         * * *::*:    * ** *:*.*:* *  . ** :*:* .

ref|YP_001663198.1|        FIAVVLNSP---PMWEDSMKILDYAFSKYKPYKVLEKG----------------------
ref|YP_001665129.1|        FIAVVLNSP---PMWEDSMKILDYAFSKYKPYKVLEKG----------------------
ref|YP_430213.1|           LIAVVMKSP---NMYRETSAILDYGFNNFHQVKLMPAGQQVALAGVRGGIAANIPAVTAD
ref|YP_001212426.1|        LLAVVMK-SEGSNIWSDSTSLMDYCFKEFRPVCLVEAGAFVADVPVKFGEPAAVAVQTGS
ref|YP_360920.1|           FIAVVLG-SEGRNVYDDATKLLDYAFNNFKTVKLVSKGQEFGKVEVAGGK----------
RAAC02227                  FLAVLMDCPTDAEIRQDATNLLNYAFLHDETQRILPAGYRAGFVLARDGED---PVVTSE
                           ::**::   .     :  :: :::*  * . .   ::  * ref|YP_001663198.1|        ------------------------------------------------------------
ref|YP_001665129.1|        ------------------------------------------------------------
ref|YP_430213.1|           DVLVVEPKNETWTWQQRVELNPDLNAPV---KKGDRIGR--IIFTSHDQEV-SVDLIAAG
ref|YP_001212426.1|        SFTYNFPADKPLEIKKEVLLEKEFCAPV-RA--GEKLGEMAFYDGE--RELGRVDLV---
ref|YP_360920.1|           -------------------------EPV------KLIAAEDLYDTV--------------
RAAC02227                  PVLATVPIGHPLDVIERVR----VSAPLDRAPKGAAAGELDLVDAATGRKLGSVPLVLAA
```

FIG. 50B

```
ref|YP_001663198.1|     ------------------------------------------------------------
ref|YP_001665129.1|     ------------------------------------------------------------
ref|YP_430213.1|        DVAPRP------------------------------------------------------
ref|YP_001212426.1|     ------------------------------------------------------------
ref|YP_360920.1|        ------------------------------------------------------------
RAAC02227               PFEPVPKPIPWPRLAAPAAAVILMAALVLGWRRRRRSRMAPRARVVRVQPWQESWQSARR ref|YP_001663198.1|     ---
ref|YP_001665129.1|     ---
ref|YP_430213.1|        ---
ref|YP_001212426.1|     ---
ref|YP_360920.1|        ---
RAAC02227               GRR
```

FIG. 51

```
ref|NP_622598.1|          ------------------------RTDLALEAREL---YKEREIPGVSIREEGEEGIKI
ref|YP_001665389.1|       ------------------------SIRTDLAVEAREL---YKGREIPGVRVDEKHLEGIKV
ref|YP_001320854.1|       ------------------------RTDLALEVRELYQEEKQQEIPGVKVDQEEDTDVLV
ref|YP_001512768.1|       ------------------------PNTDLAIEARELYSEKTSGEIPGVTMDNEEIEDVLI
ref|YP_001037463.1|       ------------------------------------------------------------
RAAC00872                 MVISWNAARRVRLKPCHLPISRSSPRTDLAVEARELA--LREGHIRGVEEEREEHEGVVI ref|NP_622598.1|          TRVKILDERGEKAMGKPVGDYITIEAPGLLERDLDLEERVAKVLANIISELAQLKKDSHV
ref|YP_001665389.1|       TKVKILNEEGEKAMGKPVGDYITIEAPGLIERDLDLEEEVAKVLADIIKEIANLTENTQV
ref|YP_001320854.1|       TRVDVMDQQGAEIMGKKQGMYITLESPGLRKADADLKDHISQVLAKELKALLPERKNLKA
ref|YP_001512768.1|       TRVEVFNETGVSIIGKPIGKYITLESNSLRKADADFKDEMSKLLAKELRRIIPQKDDIKV
ref|YP_001037463.1|       TRVRVTSPTGEAAIGKPMGNYITLEVPRLKENDQELYEETCKALAKELTRVLNLKDDSTI
RAAC00872                 TRVRVSTQVAARRLGKRKGTYVTIEAPGMRRRDFDLEDRLTRILADELKRLLPER-AETA
                          *:*  :       . :** * *:*:*    :  .  * :: :.   :  **.  :   :

ref|NP_622598.1|          LVVGLGNWNVTPDALGPRVVSNIVVTRHLKEYAPLQFGDE-----IRSVSAFSPGVLGIT
ref|YP_001665389.1|       LVVGLGNWNVTPDALGPRVVSNIVVTRHLKEYAPQQFGDE-----IRSVSAISPGVLGIT
ref|YP_001320854.1|       LVVGLGNWNVTPDALGPKAVAKIHVTRHLFK-MYQKESDDH----MIEVSAISPGVMGTT
ref|YP_001512768.1|       LVVGLGNWDVTPDALGPKVVSKIFVTRHLFQ-MYNKEGDVD----LSEVSAISPGVMGTT
ref|YP_001037463.1|       LVIGLGNWNVTPDALGPKVVSRLMVTRHLLE--YVPDQVD--E-GVRPCAVSPGVLGIT
RAAC00872                 LVIGLGNEHVTADALGPMVVNRLFVTRHLFSYMPEVLGDGE---GYRSIAALAPGVLGLT
                          :  ..***** .*  .: *****  .         :.*.:***:* * ref|NP_622598.1|          GIETAEILKGVVDRVKPDLVITIDALASRRLERLSTTIQISNTGISPGSGVGNRRLSITS
ref|YP_001665389.1|       GIETAEILKGVVDRIKPDLIITIDALASRRLERLSTTIQISNTGISPGSGIGNRRLSITE
ref|YP_001320854.1|       GLETGEIIKGIVEHSRPDVVVVVDALASRKMERVNATIQISTTGISPGSGVGNKRMALDE
ref|YP_001512768.1|       GLETGEVIKGIVDNSKPDLVIVVDALASRKMERVNATIQISTTGITPGSGVGNKRKALNR
ref|YP_001037463.1|       GIETGEIVRGIVDRVKPDVVIAIDALASRKMERVNTTIQIADTGISPGSGVGNKRMELSR
RAAC00872                 GIETSEVVLGVVERIKPDVVLAVDALAARSLERLHRTIQLSDVGIQPGAGVGNHRKAIDK
                          *:**.*::  *:*:. :**::::.:****:*  :**:   ***::  .** **:*:**:*   :

ref|NP_622598.1|          ESLGVPVIAIGVPTVVDAVTIAHDTIEYLVKELSEQTSKESVFYKVLENMNKQEKYSLIE
ref|YP_001665389.1|       QSLGIPVIAIGVPTVVDAVTIANDTIEYLTEELLKHTKEESPFYEVLKNMSQQEKYSLIQ
ref|YP_001320854.1|       ESLGVPVIVAVGVPTVVDAATLTNDTIQLVIKAFSKQAQAGSEFYSMLEKLKEEEKYGLIR
ref|YP_001512768.1|       ETLGVPVIAIGVPTVVDAATLTNDTIDKVIDAFSRQAKVGSQFYNMLRELKEEEEKYSLIT
ref|YP_001037463.1|       ETLGVPVIAIGVPTVVDAATMANDTIDLVIDNLIREAKEDSHFYNMLKNIDRNEKYQLIQ
RAAC00872                 ETLGVPVIAIGVPTVVDAATIASDAIELVFRELGRQVP-GNAANRLLDQLTGQEKWQLVR
                          ::**:****:********.*:: *:*:     :   ...  .     :* ::  :**: *:

ref|NP_622598.1|          EVLSPYVQNLVVTPKEIDLLIKNIALVISRGINLALQPGLTEKEMNQLLH
ref|YP_001665389.1|       EVLTPYVHNLVVTPKEIDLLVRNIASIISRGINLALQPGLTEREMNQLLH
ref|YP_001320854.1|       EVLEPYNANVMVTPKEIDDIILDLSQIIANGINIALHPGIDLKDVNRYIH
ref|YP_001512768.1|       EVLEPYSANIIVTPKEVDEVIVNLSQIIANGINIAVHPGIDLKDVN----
ref|YP_001037463.1|       EVLQPYVGNLVVTPKEIDDVVDRIAKVIANGLNIALHQGITLNDVN----
RAAC00872                 EVLEPIEQNLVVAPKEVDEFMENVAYLIAKSMNVALHPAMTLEDADLVTH
                          *** *    *::*:***:* .: ::  :*:...*:*:::  .:  .: :
```

FIG. 52

```
ref|ZP_02172045.1|         ---------MKKVTVSGKTVEEAVQNGLDRLEVTAEQVDYTVLEEPEKGFLGFLGNKPAL
ref|NP_244931.1|           ---------MTKRRVSGKTVEEAVEQAIIELGTTRERITYTVVEEPKSGLFGILGSKPAV
RAAC00045                  MRRVGGLGEMRKVVATGKTIEEAVMSALVRLGVPRSQAQVRVIREPARGFLGWLSGREAE
ref|YP_001213468.1|        ---------MKAIEKSGKTVEEAVELALKDLGVTRKDVEVEVIEEPSKGIFGILGVKPAR
ref|YP_358877.1|           ---------MREIEVTGKTVEEAVSLGLEQLGVDRSLVEIEILEQPSKGILGLFGQKPAK
ref|ZP_01189194.1|         ---------------GKTVEDAVEQALQKLNITRDEAEIKVIDEGSKGIFGLIGGKNAV
                                          ***:*:**  .: *   .       ::  :  *::* :. : * ref|ZP_02172045.1|         VEVRLKPDPLKEALVFLRDTIDKMGITASVEAEER----KEG-MYLTISGAE--IGVLIG
ref|NP_244931.1|           IEVVVKPDPVDRAKAFLEELLQEMDMEVEVTIEKD-----PATVLFNISGEQD-LGTLIG
RAAC00045                  VEVTVIETPLDAAKEFLRTAISKMGLGQAVIVADDVD--EEGHVKLSISADEDALPILIG
ref|YP_001213468.1|        VRVLLREGPLQKAEKFLKSVFEAMNIQVEMSLQEN-----EREVVINLRGPE--MGVLIG
ref|YP_358877.1|           VKLTIKSKVMEKARKFLDDVISAMGVNVGYEVLERDD-----HLLINLYGSD--VGILIG
ref|ZP_01189194.1|         VEVKPKVNPASIALDFLEDVLEKIPVATRVEVIEEKT--DYDQVYLNISGDN--LGIIIG
                           :.:         . *  **   :. :  :       .       : :.:  . :   :**

ref|ZP_02172045.1|         KRGQTLDSLQYLVNLVANRQSDNYMKFYLDAEGYRDRRREALETLAKRLSEKAVRTGREV
ref|NP_244931.1|           KRGQTLDSLQYLVNLVANKEEGEFIRIKLDAENYRARRKEALVQLAERLASKALRTKRPV
RAAC00045                  RRGATLDALQYLVNIVANRDASEKMRFTLDAAGYRDRRLESLRRLADEAADKAVRLGRPV
ref|YP_001213468.1|        RRGETMEALQYLVNLSANKNQEVRKKIIIDIEGYRSRREETLQKLALKLADKAKQRGRNV
ref|YP_358877.1|           YRGETLDALQYITNLAANKNEITPRRIILDAQGYRERREKTLIRLAEKVAEKVRQKGRPF
ref|ZP_01189194.1|         YRGETLDALQYLTSLVVNRELKKYTRVLLDAEGYRERRKKTLERLANKLARKAIRVGRKV
                             ** *:::***:..: .*::      :. :*  .** ** ::*  **  .: *. :  * .

ref|ZP_02172045.1|         KLEPMNAHERKIIHTALQHIHTVSTYSEGREPHRRIVVVP-------
ref|NP_244931.1|           SLEPMSAHERKIIHTALQELGDVETYSEGQGIGRHVVIAPKR-----
RAAC00045                  ALDPMPRKDRKWVHAHLQSRGDVVTVSEGQEPYRRVKIIPKRHDWIE
ref|YP_001213468.1|        VLEPMNSQERRIIHTALQGRDDIYTFSEGEEPYRKIVISPKK-----
ref|YP_358877.1|           ALEPMTQERRIIHTALQNFEGVYTYSEGEDPNRKVIIAPKR-----
ref|ZP_01189194.1|         VLEPMPPHERRIIHMTLKDSEQVYTYSEGQEPYRRVLIAPR------
                            *:**  ::*: :*  *:    : * ***.   *:: : *
```

FIG. 53A

```
dbj|BAB83769.1|            ----EFKLPDIGEGIHEGEIVKWFVKPGDEVNEDDVLCEVQNDKAVVEIPSPVKGKVLEI
ref|YP_146913.1|           ----EFKLPDIGEGIHEGEIVKWFVKPGDEVNEDDVLCEVQNDKAVVEIPSPVKGKVLEI
sp|P11961|ODP2_BACST       ----EFKLPDIGEGIHEGEIVKWFVKPGDEVNEDDVLCEVQNDKAVVEIPSPVKGKVLEI
ref|YP_001125047.1|        ----EFKLPDIGEGIHEGEIVKWFVKPGDEVNEDDVLCEVQNDKAVVEIPSPVKGKVLEI
ref|ZP_01696305.1|         ----EFRLPDIGEGIVKWFIKPGDKVSEDDVLCEVQNDKSVVEIPSPVEGTVEDI
RAAC02428                  MAVVEFRLPELGEGLHEGRISKWLVQPGDTVQEDDPIAEVENDKSLVELPSPVSGKVKEI
                               ::*:*.* :::* *.* :.:*::****.*.* :* dbj|BAB83769.1|            LVPEGTVATVGQTLITLDAPGYENMTF---------KGQEHEE-VKKEEKAETVS----K
ref|YP_146913.1|           LVPEGTVATVGQTLITLDAPGYENMTF---------KGQEHEE-VKKEEKAETVS----K
sp|P11961|ODP2_BACST       LVPEGTVATVGQTLITLDAPGYENMTF---------KGQEQEE-AKKEEKTETVS----K
ref|YP_001125047.1|        LVPEGTVATVGQTLITLDAPGYENMTF---------KGQEHEEEAKKEEKTETVS----K
ref|ZP_01696305.1|         LVEEGSVAVVGDVLVKFDAPGYENLKFKG------DHGQDQKEEAAESAKPEPAKPEPAK
RAAC02428                  KVPEGTTCVVGDVLLTFEVEGDAPAEA----------GADEKPTDKSAQKAEADAHQNAK
                            * :...:.*:.::. *              * .:.   . *.*.     * dbj|BAB83769.1|            KEMVETAAPSAPAAE------AEADPNRRVIAMPSVRKYAREKGVDIRLVQGTGKNGRIL
ref|YP_146913.1|           KEMVEIAAPSAPAAE------AEADPNRRVIAMPSVRKYAREKGVDIRLVQGTGKNGRIL
sp|P11961|ODP2_BACST       EEKVDAVAPNAPAAE------AEAGPNRRVIAMPSVRKYAREKGVDIRLVQGTGKNGRVL
ref|YP_001125047.1|        EESVGATAPAAAAEAA-----AEADPNRRVIAMPSVRKYAREKGVDIRLVQGTGKNGRIL
ref|ZP_01696305.1|         QETAETAKPAEKEAEH-----GSESADRRVIAMPSVRKYAREKGVDIQLVSGTGKNGRVL
RAAC02428                  ADEAPAAKPAPDAAKAD----TQESAAHEVLATPAVRKYAREQGVDIRTVKGTGNHGKVT
                            :   . .  *         .  ..:.*:* *:*******:****: *.***:*::

dbj|BAB83769.1|            KEDIDAFLAGGAKAAAEPTPQAAEEKAAPQAPAAKPVVPEGEFPETRE-KMSGIRRAIAK
ref|YP_146913.1|           KEDIDAFLAGGAKAAAEPTPQAAEEKAAPQAPAAKPVVPEGEFPETRE-KMSGIRRAIAK
sp|P11961|ODP2_BACST       KEDIDAFLAGGAK----PAPAAAEEKAAP--AAAKPATTEGEFPETRE-KMSGIRRAIAK
ref|YP_001125047.1|        KEDIDAFLAGGAKAAAQPAPAAEAEEKAAPQAAATPVVPEGEFPETRE-KMSGIRRAIAK
ref|ZP_01696305.1|         REDIDAYVNGPQQP------EAETGKTEAQAPASQNAIPEGEFPETRE-PMSGIRKVIAK
RAAC02428                  KEDIDRAKSGTQAP-----QQAAEDKEQRPAQAQQAPAAYGEEYEERV-PMPMIRQAIAR
                           :****     *       *   :   *   *      .  ** * * *.  **:.**:

dbj|BAB83769.1|            AMVHSKHTAPHVTLMDEADVTKLVAHRKKFKAIAAEKGIKLTFLPYVVKALVSALREYPV
ref|YP_146913.1|           AMVHSKHTAPHVTLMDEADVTKLVAHRKKFKAIAAEKGIKLTFLPYVVKALVSALREYPV
sp|P11961|ODP2_BACST       AMVHSKHTAPHVTLMDEADVTKLVAHRKKFKAIAAEKGIKLTFLPYVVKALVSALREYPV
ref|YP_001125047.1|        AMVNSKHTAPHVTLMDEDVDVTKLVAHRKKFKAIAAEKGIKLTFLPYVVKALVSALREYPT
ref|ZP_01696305.1|         AMVNSKQTAPHVTLMDDVDVTALVAHRKKFKEIAAEKGIKLTFLPYVVKALVSTLREYPV
RAAC02428                  AMVKSKYTAPHVTLMDEVDVTELVKLRNEVKPLAQERGIKITYLPFIVKALIAALRTKPQ
                           *: *******:.* **  *::.*  :* *:***:*::::::  * dbj|BAB83769.1|            LNTSIDDATEEIIHKHYYNIGIAADTDRGLLVPVIKHADRKPIFALAKEINELAEKAREG
ref|YP_146913.1|           LNTSIDDATEEIIHKHYYNIGIAADTDRGLLVPVIKHADRKPIFALAKEINELAEKAREG
sp|P11961|ODP2_BACST       LNTSIDDETEEIIQKHYYNIGIAADTDRGLLVPVIKHADRKPIFALAQEINELAEKARDG
ref|YP_001125047.1|        LNTSIDDQTEEIIHKHYYNIGIAADTDRGLLVPVIKHADRKPIFALAQEINELAVKARDG
ref|ZP_01696305.1|         LNSSIDDETNEIIHKHYYNIGIAADTERGLLVPVVKHADRKPVFAVSKEINELAEKARDG
RAAC02428                  LNASYDEEKQELVIKHYYHIGIATDTERGLLVPVVRHADRKNIWTIAQEINDLATRGRAG
                           **:* *:  .:*:: ****:****:**:******::*****::::::***:** :.* *
```

FIG. 53B

```
dbj|BAB83769.1|         KLMPNEMKGASCTITNIGSAGGQWFTPVINHPEVAILGIGRIAEKPIVRDGEIVAAPMLA
ref|YP_146913.1|        KLMPNEMKGASCTITNIGSAGGQWFTPVINHPEVAILGIGRIAEKPIVRDGEIVAAPVLA
sp|P11961|ODP2_BACST    KLTPGEMKGASCTITNIGSAGGQWFTPVINHPEVAILGIGRIAEKPIVRDGEIVAAPMLA
ref|YP_001125047.1|     KLAPNEMKGASCTITNIGSAGGQWFTPVINHPEVAILGIGRIAEKPIVRDGEIVAAPVLA
ref|ZP_01696305.1|      KLAPNEMKGASITISNIGSAGGQWFTPVINRPEVAILGIGRIAEKPVVKNGEIVAAPVLA
RAAC02428               KLKPEEMKGSTISITNIGSAGGLFFTPIINYPEVAILGVGRITEKPIIKNGEFAVGQMMS
                        ** * ****:: :*:******* :***:** *******:***:***:::**:... :::

dbj|BAB83769.1|         LSLSFDHRMIDGATAQKALNHIK-------------
ref|YP_146913.1|        LSLSFDHRMIDGATAQKALNHIK-------------
sp|P11961|ODP2_BACST    LSLSFDHRMIDGATAQKALNHIK-------------
ref|YP_001125047.1|     LSLSFDHRMIDGATAQKALNHVK-------------
ref|ZP_01696305.1|      LSLSFDHRIIDGATAQNALNHIK-------------
RAAC02428               LSLSFDHRVIDGALGQQFINDIKRLLENPRLLLLEV
                        ********:****  .*:  :*.:*
```

FIG. 54A

```
ref|ZP_02326222.1|      MEFKLPDVGEGIHEGEIGKWLIKEGEQVNCDQPIVEVMTDKVNAELTAPAKGVVRRLMFA
ref|NP_241081.1|        VEFRLPDVGEGMHEGEIISWFVQEGDHVKQDEPVVEVQTDKMNAELTAPVSGKIKRVYYK
RAAC01659               MEFKLADIGEGIHEGEILRWLVKEGDQVEQDAPLVEVQTDKVTAELPSPVAGVIERIMAR
ref|YP_074242.1|        -EFKLPDVGEGLHEAELLRWLVKEGDTVTEDQPIMEVQTDKATVEITSPVNGRVVKLLGQ
ref|YP_001153408.1|     IEFKFPDLGEGLVEGEIVKWHVKEGDFVKEGDPLVDVMTEKANVTLPAPATGKVVKIFAK
ref|NP_560158.1|        MEFKFPDLGEGLVEGEVIKWHVKEGDFVKEGDPLVDVMTEKATVTLPAPTTGRVVKILVR
                         **::.*:***: *.*:   * ::**: *   . *:::* *:*  .. :.:*. * : ::

ref|ZP_02326222.1|      EGDKVEVGQVLFLL----------DVEEHETLGRTGEAEQAATASPPASPPAGESSFAPV
ref|NP_241081.1|        VGEVAEVGSLLFTID-----------ENLSTFKSETHERTKRENSTEQTRPISNISLTSQ
RAAC01659               EGQVVPVGTVLAVIR----------EAGAKAAAAASGAPGAQASLQEKPAAQAHSEAQP
ref|YP_074242.1|        PGDILKVHSVVVIFDDGSPGALPTAGEVASGVAAAAPAGAQPQASLDVPAPAAQPAPAPA
ref|YP_001153408.1|     EGEIVKVGQVLCVIEEV--------------------AAQEASPKAPAEEASTSQKV-
ref|NP_560158.1|        EGEVVKVGQTLCVIEP---------------------AEGPAAGPQTEAPARP-REVA
                        *:    *    : :                                        :    .

ref|ZP_02326222.1|      H-----TP-----------RRVR-------AAPYVRQLARQLKIDIEQVTVSGADGRISE
ref|NP_241081.1|        Q----KAP----------VRKGL-------ATPYVRQLAREMNINLEDVVGTGPGGRVLE
RAAC01659               GRE-AAAPQASGAAHRGGRRRAL-------ATPHVRALARKLGVDIDEIDGTGPVGRVTE
ref|YP_074242.1|        APPAPAPAPAAGAGPADRPRRA-------LATPATRRLARELGVDINQVPGTGPAGRVTS
ref|YP_001153408.1|     ---------------------------VAMPAARRLARELGIDLSKVKGTGPGGVITV
ref|NP_560158.1|        ---------------------------AMPAARRLAKELGIDLSKVKGTGPGGVITV
                                                    * * .* **::: :::..: :*. *  :

ref|ZP_02326222.1|      EDLRRYADS-------------------RETAEPVVPALASEAAESDHNGSAGGSKLL
ref|NP_241081.1|        QDLQNDTN-------------------LQKVKTVPSGVANVQESIERTGSS------
RAAC01659               EDVRRFAEGG------------------REPAVEPARAHAEHAAEAQPTAALR-----
ref|YP_074242.1|        DDVRAFAARR------------------TAPAPAQAPTQAPTEAAAPTPATPAP----
ref|YP_001153408.1|     EDVRRAAEEL------------------ARQEKAPPAPPPAAVQPPPAIAQPQA---
ref|NP_560158.1|        EDVKRYAE--------------------ETAKATAPAPAPKAVEK-----------
                        :*::  :                     .

ref|ZP_02326222.1|      YSPPEAKGNFVNATHMNSEAPSCAEERIPLRGVRLKIAERMVKAVTVIPHVTQVDELEAD
ref|NP_241081.1|        -------------------AEKRIPLKGIRKAIAEKMIKSVATIPHVTHVDEIEMD
RAAC01659               --------------VATPAASGEPVEQVPLRGLRRRIAEHMVQAKRIIPHATHIDEVEMD
ref|YP_074242.1|        ---------------AAPAEADD--ERIPLRGIRKVIAERMVKSKYTAPHVTTVEEVDMT
ref|YP_001153408.1|     -----------PAAAQLPQPVAEEERIPVRGIRRAVAEKMAKSASAIPHAYHFEEVDVT
ref|NP_560158.1|        --------------------AEEAEVVPVRGIRRAVAEKMSKAKRLIPHAYHLEEVDFT
                                                : :*::*:* :**:* ::    **. .:*::

ref|ZP_02326222.1|      ALQALRERLQSIAAERQLKLTYLPFFIKALIIALKEFPVFNASLDDERKEILLKRYYHIG
ref|NP_241081.1|        ALKELREQLKHYSEQKGIKLTFLPFFIKAIVSALKEFEYFNASIDEETNEIVLKKDYHIG
RAAC01659               GIEALRERLRPYAEARGVKLTSLAFFVKAVAIALKEFPYVNASVDEAQENVLLRRYYHIG
ref|YP_074242.1|        ELMAFRAQAKELAARKGIKLSFMPFIIKAVVAALREFPYLNASIDDEAQEIVLHKRYHIG
ref|YP_001153408.1|     ELVSLRERLRQEAERLGVKLTYLPFVAKAVAVALREFPMLNSSFDEERGEIVVKRRIHLG
ref|NP_560158.1|        ELIKLRERVKAEAEKRGIRLTLLPFIAKAVAMALREYPMLNSEYDEEKNAIVVKKEVNLG
                        :  :*  :  :     ::*:  :.*. :  :*:  .*:. *:    ::::: ::* ref|ZP_02326222.1|      IAVDTPDGLIVPVIRHADRKTVFQLAEEISQLTMQAWEGKLTLNQITGGTFTISNVGPIG
ref|NP_241081.1|        IATDTEKGLIVPVIQNADQKSLLELAGEITQLSTQARKGTLNVQQMTGSTFTISNVGPIG
RAAC01659               IAVDTEQGLIVPVVKHADEKSVPEIAREVSDLARRARENRLSLDEVTGSTFTISNAGALG
ref|YP_074242.1|        FALDTDAGLLVPVIKDADRKPVFAIAQEMNDLIARGREGKLAPDEMRGSTFTISNQGSIG
ref|YP_001153408.1|     FAVDTEQGLMVVVVRDADKKSVLEIARELNALAERARAGKASVDEVRGSTFTITNIGAIG
ref|NP_560158.1|        IGVDTEQGLVVVVVKNADKKGLLEMAKEINELAQKAREGKLELQDVRGSTFTISNIGAVG
                        :. **  **:*  *::.** . :: :* *:. *    .   ::: *.****:* *.:*
```

FIG. 54B

```
ref|ZP_02326222.1|        SLLATPIINHPEAAILTLHKMEPRMVVRNREGVIRLMMNMALSFDHRIIDGADAIRFTNR
ref|NP_241081.1|          GLHATPIINYPEVAILALHKMEPRNVVREWESVIKLMMNMSLSFDHRLVDGATAVRFTNR
RAAC01659                 GLYATPIINYPESAILGIHKMEPRPVVRNNEIVIRNIAHVSLSFDHRIIDGGMAIRFTNR
ref|YP_074242.1|          GLFFTPVINYPEVAILGIGKTQPRPVVRDGEIVIRQMAHLALSFDHRLIDGGMATRFLNR
ref|YP_001153408.1|       GVGGLPIINYPEAAIMALGKIRKIPRVVNGAVVPRDVMNVVVGFDHRVVDGAYVARFTNR
ref|NP_560158.1|          GLGGLSILNYPEAGILAVGQARKKPWAVGDRIEIRDIALLAVSFDHRVVDGAYVARFMNR
                          .:    .::*:**  .*: : .     .     : :   : :.****::**. . ** **

ref|ZP_02326222.1|        MRQLLENPDLLWAEM-
ref|NP_241081.1|          MKELIENPNLLLMELR
RAAC01659                 VRELLEEPDRLWAELR
ref|YP_074242.1|          LAELLSDPTLLMME--
ref|YP_001153408.1|       VKELLEDVGKL-----
ref|NP_560158.1|          VKELLENP--------
                          : :*:.:
```

FIG. 55

```
ref|YP_001127228.1|        ----------------QILDENGN--GDEAKIAAFSDE---WLLDAYRAMRRARVVDERL
ref|YP_149070.1|           FDPDKLP-----VEIVRILDENGN--GDEEKLAAFSDE---WLLRAYREMRRARVIDERL
RAAC01745                  MDDVQVYRFTGDTKPDQVLNEAGE---MVGELPENAAD---LALEWYPFMIFCRKFDERA
ref|ZP_02326224.1|         ----------GLQEPYQVLKPDGE-LRHR-IGGEVDEA---LMIKMYENMMHVRMFDRKA
ref|NP_241079.1|           ----------------QVLTPKGE-CQYE-GSEFLDKT---FVLSMYKQMINCREFDEKA
ref|ZP_00539127.1|         ----------------RILDDAGQ-VTDTSKTDLLTKD---LSLALFTHMNRIRTFDRKA
                                            ::*    *:             : : *    * .*.:

ref|YP_001127228.1|        LRMQRQGRIGTYAPFSGQEAAQIGSVLALQKDDWIFPSYREVAVCLTHG-MPLEQFFHYV
ref|YP_149070.1|           LRMQRQGRIGTYAPFSGQEAAQIGSALALHKDDWIFPSYREVAVCLMHG-MPLEQFFHYV
RAAC01745                  QLLQRQGRLGTYAPFRGQEAAQIASFAVLRPSDWVFPTYRELAGMMYHG-LEPVHALLKS
ref|ZP_02326224.1|         VNLQRQGRIGTYAPYEGQEAAQVGSAMALSPEDWLFPSYRDHAATITHG-QSLSRVLLYW
ref|NP_241079.1|           LKLQRQGRIGTYASFKGQEACQIGGALALRPTDWLFPTYRDHAAISTHG-QPWHRIFLYW
ref|ZP_00539127.1|         INLQRQGRLGTYAPFEGQEAAQVGSAYALQDKDWVFPTYRDHGATLTFG-ADMVRTFLYW
                            :*****:****.: ****.*:..  .*   **:**:**: .    .*      : :

ref|YP_001127228.1|        RGRLSGKRMPEELNIFPTQIIIAAQTLHAVGCAWATKLKGESHVSVAYFGDGATSEGDFH
ref|YP_149070.1|           QGRLSGKRMPEGVNIFPTQIIIAAQTLHAVGCAWASKLKGEPHVSVAYFGDGATSEGDFH
RAAC01745                  RGHPDAGRMPEEIHMAPPQIAIAAQILHAVGAGWACKLQEKDDIAVAYFGDGATSEGDFH
ref|ZP_02326224.1|         MGHMEGSVSPEGLKIMPPCVPIATQLVHAVGTSWAAKLKGEKQASIAYFGEGATSEGDFH
ref|NP_241079.1|           MGHMDGSLSPDDRNILPPAVPIATQMLHAVGTAWADKLKGNPHVSLVFFGDGATSEGDFH
ref|ZP_00539127.1|         NGRVEGCVATDELHIFPPAVPIATQIPHAVGAAWAEKRKGSTQVAVAYFGDGATSEGDFH
                            *: ..   .:  ::  *. :  **:*   **  .   *  :  . ::.::******* ref|YP_001127228.1|        EAMNFAAVYNVPVIFFCQNNQYAISVPYAKQTASRTIAQKALAYGMKGVLVDGNDVLAVY
ref|YP_149070.1|           EAMNFAAVYNVPVIFFCQNNQYAISVPYRKQTASRTIAQKALAYGMKGVLVDGNDVLAVY
RAAC01745                  EGMNFASVMRLPVVFFCQNNQYAISVPVHRQMASPTIAQKAIAYGMEGLRVDGNDAFAVY
ref|ZP_02326224.1|         EALNFAGVYQTATIFFCQNNGYAISVPFHAQSASRTIAQRAAAYDIVGVRVDGNDIFAVW
ref|NP_241079.1|           EALNFAGVYQTPTIFFCQNNGYAISVPFEKQSASKTIKQRSVAYDMRGERVDGNDIFAVY
ref|ZP_00539127.1|         EGMNFASVFQAPVILFNQNNGYAISVPIQKQMHSETIAQKALAYGMPSVRIDGNDVFAVY
                           *.:***.*  . ..:::* *** ******    *  * ** *::  **.:     :**** :**:

ref|YP_001127228.1|        ETMKQAVEAARRGEGPMLIEALTYRLGPHTTADDPTKYRHPEE-VETW-RRKDPLHRLRV
ref|YP_149070.1|           ETMKQAVEAARRGEGPMLIEALTYRLGPHTTADDPTKYRRPEE-VETW-RAKDPLRRLRL
RAAC01745                  QAMCYAVERARRGDGPTLIEAVTYRLGPHTTADDPGRYRDAVD-VERWAAAAKDPLVRLRL
ref|ZP_02326224.1|         LTVREAIKRGLAGGGPTLVEAVTFRYGAHTTSDDPRKYRDQERLASEWREQRDPVHRLRL
ref|NP_241079.1|           LTVKRAIEGARRGAGPTLVEAVTTRFGSHTTADDAKKYRDQEEIERTWKEMQDPLTRLKA
ref|ZP_00539127.1|         FTMQKALERARSGGGPTLIEAVTWRFGAHTTADDPSKYRDQ----ERSRDRVDPLERLEA
                            ::  *::  .  * **  *:**:*   * *.***:**.  :**         **: **.

ref|YP_001127228.1|        LLERRGLWTDAKEEEFVAKVNEEVTAAYEAAVASESGSIADVFDYVYSEAPKLLA-----
ref|YP_149070.1|           LLERRGLWTEAQEDALVAQVNDEVTAAYEAAIASKSGSIVDAFDCVYSEAPKLLA-----
RAAC01745                  WLTRQGLWDDERQAACEEEAEARVRQAVADMEAYPHKSLEEAARHVYAEVPEALALHLAK
ref|ZP_02326224.1|         FLQKRGLWNEKDEERMLERLTGLIEDAVSEAESYPKSRPADMFKHVFADVP---------
ref|NP_241079.1|           YIQAKGWLSEEEEAQMKAKIRETIDEELSMAEQYPKPSISQMFEHVYENQP---------
ref|ZP_00539127.1|         FMKEQGFYDEQEIETIRSRHQEEVEAAVKTMESFPPPDVNDLFDHTFATLPDDL------
                            :   :*    :          .   :                  :   .:   * ref|YP_001127228.1|        ------
ref|YP_149070.1|           ------
RAAC01745                  RGKEAR
ref|ZP_02326224.1|         ------
ref|NP_241079.1|           ------
ref|ZP_00539127.1|         ------
```

FIG. 56

```
ref|ZP_00539126.1|        ----TLVQAVTDALRTKLTDDETTLVLGEDVGKNGGVFRATDGLQEEFGEDRIIDTPLSE
RAAC01746                 MPKWTMIEAIRDALAIALRDDPRVLVFGEDVGKNGGVFRATDGLQAEFGEARVADTPLAE
ref|YP_149069.1|          MAELTMIEAINEAMRQEMERDPRIIVLGEDVGENGGVFRATDGLLAQFGEGRVFDTPLAE
ref|YP_001127227.1|       MAELTMIEAINEAMRQEMERNSRVIVLGEDVGENGGVFRATDGLLEQFGSGRVFDTPLAE
ref|YP_001125046.1|       MAQMTMVQAITDALRIELKNDPNVLIFGEDVGVNGGVFRATEGLQAEFGEERVFDTPLAE
ref|NP_833691.1|          MAQMTMIQAITDALRVEMKNDPNVLVFGEDVGVNGGVFRATEGLQAEFGEDRVMDTPLAE
                              *::::*:  :*:   :   :    ::::***  ****:  :**.  *:  ****:* ref|ZP_00539126.1|        AGIVGTSIGLAVNGFKPIVEIQFLGFIYPAYEQIMTHVSRIRMRTMGRYGVPMVIRAPYG
RAAC01746                 KAIVGTAVGLAMAGMKPVAEIQFLGFAYEAMDQIAAQLARIRFRTQGRFTAPAVIRAPYG
ref|YP_149069.1|          SGIIGTSIGLAINGMRPIAEIQFLGFVYQAMDQLAAQAARIRFRSAGRFSCPIVVRSPYG
ref|YP_001127227.1|       SGIIGTSIGLAINGMRPIAEIQFLGFVYQAMDQLAAQAARIRFRSGGRFSCPIVVRSPYG
ref|YP_001125046.1|       SGIGGLAVGLALQGFRPVPEIQFFGFVYEVMDSISGQMARIRYRTGGRYHMPITVRSPFG
ref|NP_833691.1|          SGIGGLAVGLALEGFRPVPEIQFFGFVYEVMDSISGQLARMRYRSGGRWTAPVTVRSPFG
                            .*  *  ::***:  *::*:  **:  *  .  :.:    :  :*:*  *:  **:    *  .:*:*:* ref|ZP_00539126.1|        AGIRAPEIHSDSTEALFTSMPGLKVVCPSTPYDAKGLLIAAIEDPDPVLFLESMRSYRAF
RAAC01746                 GGVRTPELHSDSLEALFAHTPGLVVVTPSRPYDAKGLLLSAIRSPDPVVFLEPIRLYRAF
ref|YP_149069.1|          CGVRTPELHSDALEALFTHSPGLKVVMPSNPYDAKGLLISAIRDEDPVLFLEPMKLYRAF
ref|YP_001127227.1|       GGVRTPELHSDALEALFTHSPGLKVVMPSNPYDAKGLLISAIRDDDPVLFFEPMKLYRAF
ref|YP_001125046.1|       GGVHTPELHSDSLEGLVAQQPGLKVVIPSTPYDAKGLLISAIRDNDPVIFLEHLKLYRSF
ref|NP_833691.1|          GGVHTPELHADSLEGLVAQQPGLKVVIPSTPYDAKGLLISAIRDNDPVIYLEHMKLYRSF
                            .*:::**:*:*:  *.*.:   *     ****::..  ***:::*  ::  **:* ref|ZP_00539126.1|        KEPVPSEAYTIEIGKANCITEGQDVTLIAWGAMVQVAQKAATEAATRGISCEVIDLRTLY
RAAC01746                 REEVPEGDYQVPLGRAAVRREGSDVTLVAWGPTVPVAESAAAQVASRGISCEVLDLRTLA
ref|YP_149069.1|          RMEVPEEPYTIPLGQARVVKEGDDVTIIAWGATVPLAAKVAAEMQAKGVNAEVIDLRCLQ
ref|YP_001127227.1|       RMEVPEEPYTIPLGQARIVKEGDDVTILTWGATVPLVAKLADEMRMRGVDAEVIDLRCLQ
ref|YP_001125046.1|       RQEVPEGEYTIPIGKADIKREGKDITIIAYGAMVHESLKAAAELEKEGISAEVVDLRTVQ
ref|NP_833691.1|          RQEVPEGDYTIDLGKADIKREGTDVSVIAYGAMVHAALKAAEELEKEGISLEVVDLRTVQ
                            :  **.   *  :  :*:*       **  *:::::*.  *    .  *  :  .*:. **:***  :

ref|ZP_00539126.1|        PLDRETISASVQKTGRAVIIHEAQATGGLGNDLLALINDTSFLYLRAPVARVTGFDVPVP
RAAC01746                 PLDRSALKASVEKTGRAVIVHEAVRYAGLGAEIAASIMDLAFYHLRAPIERVAGLDTPYP
ref|YP_149069.1|          PLDIDTIITSVEKTGRVMIVHEAVKTGGFGAEVAALISERALFSLSAPIVRIAGYDTPYP
ref|YP_001127227.1|       PLDIDTIIASVEKTGRVMIVHEAVKTSGFGAEVAALISERALFSLSAPIVRIAGYDTPYP
ref|YP_001125046.1|       PLDIETIIGSVEKTGRAIVVQEAQRQAGIAANVVAEINERAILSLEAPVLRVAAPDTVYP
ref|NP_833691.1|          PLDIETIIASVEKTGRVVVVQEAQKQAGIAANVVAEINDRAILNLEAPVVRVAAADTVFP
                            *  .::  :**.:::    .*:.  ::  *  *  :  ::    *  **:  *::.  *.    * ref|ZP_00539126.1|        LFALEDHYIPTPTRVLEAIQRTVD-
RAAC01746                 PPALEDAWLPSVTRVVEAIERVMED
ref|YP_149069.1|          VPSVEDDWLPNAERIAEGIETLL--
ref|YP_001127227.1|       VPSVEDDWLPNPARIVEGIETLM--
ref|YP_001125046.1|       FAQAESVWLPNFKDVIETAKKVM--
ref|NP_833691.1|          FSQAESVWLPNHKDIVEAVNKVM--
                            *.  ::*.         : *   :  :
```

FIG. 57

```
pdb|1W85|A              --------------------------------QFPT--FQILNEEGEVVNEEAMPELSDE
sp|P21873|ODPA_BACST    --------------------------------QFPT--FQILNEEGEVVNEEAMPELSDE
ref|YP_146911.1|        --------------------------------QFPT--FQILNEEGEIVNEEAMPELSDE
ref|YP_001421036.1|     --------------------------------------QILNAEGEVVNKDAMPDLSDD
ref|NP_243521.1|        ------------------------LEKVEGQFET--FQILNEEGEVVNEAAMPDLSDE
RAAC02426               ----------------------MTMLSQVVARFEIPYVQIVDENGNVVNPDLVPELSDD
                                                        **::  :*::**      :*:***:

pdb|1W85|A              QLKELMRRMVYTRILDQRSISLNRQGRLGFYAPTAGQEASQIASHFALEKEDFILPGYRD
sp|P21873|ODPA_BACST    QLKELMRRMVYTRILDQRSISLNRQGRLGFYAPTAGQEASQIASHFALEKEDFILPGYRD
ref|YP_146911.1|        QLKELMRRMVYIRILDQRSISLNRQGRLGFYAPTAGQEASQIASHFALEKEDFILPGYRD
ref|YP_001421036.1|     QLKELMRRMVYIRILDQRSISLSRQGRLGFYAPTAGQEASQIASHFALEQDDFILPGYRD
ref|NP_243521.1|        QLQELMKRMVYTRIWDQRAISLNRQGRLGFYAPVAGQEASMLGSQFALDKEDWILPGYRD
RAAC02426               DLRELMKRMVFTRIWDQRAIRLSRQGRLGFYAPVSGQEASMIGSEFATKKEDFLLPGYRD
                        :*:*:*:   *:*  *.********.:***  :..*.**  .::*::****** pdb|1W85|A              VPQIIWHGLPLYQAFLFSRGHFHGNQIPEGVNVLPPQIIIGAQYIQAAGVALGLKMRGKK
sp|P21873|ODPA_BACST    VPQIIWHGLPLYQAFLFSRGHFHGNQIPEGVNVLPPQIIIGAQYIQAAGVALGLKMRGKK
ref|YP_146911.1|        VPQIIWHGLPLYQAFLFSRGHFHGNQIPEGVNVLPPQIIIGAQYIQAAGVALGLKMRGKK
ref|YP_001421036.1|     VPQLIWHGLPLHQAFLFSRGHFKGNQMPEGVNALSPQIIIGAQIIQTAGVALGLKKRGKK
ref|NP_243521.1|        IPQIVFHGLPLYQAFLYSRGHFEGGQIPDGVNVLMPQIIIGAQIVQAAGVAMGLKRKGKQ
RAAC02426               IPQLYFHGYPLHQLFLYSRGHQLGGKVPEGVNCMVPQIIIGAQIVQAAGVGLAFKLRGEK
                        :**: :** **:* **:****    *.::*:*** : ******** :*:***.::.:* :*::

pdb|1W85|A              AVAITYTGDGGTSQGDFYEGINFAGAFKAPAIFVVQNNRFAISTPVEKQTVAKTLAQKAV
sp|P21873|ODPA_BACST    AVAITYTGDGGTSQGDFYEGINFAGAFKAPAIFVVQNNRFAISTPVEKQTVAKTLAQKAV
ref|YP_146911.1|        AVAITYTGDGGTSQGDFYEGINFAGAFKAPAIFVVQNNRFAISTPVEKQTIAKTLAQKAV
ref|YP_001421036.1|     AVAITYTGDGGASQGDFYEGMNFAGAFKAPAIFVVQNNRYAISTPVEKQSSAQTIAQKAV
ref|NP_243521.1|        NVAITYTGDGGASQGDFYEGMNFAGAYNSPAIFVVQNNRFAISVPVEKQSAAKTIAQKAV
RAAC02426               RVAVTYTGDGGTSQGDFYEGMNFAGAMNLPVVFFVQNNQYAISVPRELQTRAQTLAQKAI
                         **:*******:*******:*****  :  *.:*.****:***.* * *: *:*:****:

pdb|1W85|A              AAGIPGIQVDGMDPLAVYAAVKAARERAINGEGPTLIETLCFRYGPHTMSGDDPTRYRSK
sp|P21873|ODPA_BACST    AAGIPGIQVDGMDPLAVYAAVKAARERAINGEGPTLIETLCFRYGPHTMSGDDPTRYRSK
ref|YP_146911.1|        AAGIPGIQVDGMDPLAVYAAVKAARERAINGEGPTLIETLCFRYGPHTMSGDDPTRYRSK
ref|YP_001421036.1|     AVGITGVQVDGMDALAVYAATAEARQRAINGEGPTLIETLTFRYGPHTMSGDDPTKYRTK
ref|NP_243521.1|        AAGIEGIQVDGMDVLAVYAATKQARERALAGDGPTLIETLCYRYGPHTMAGDDPTRYRSS
RAAC02426               AAGIPGVQVDGMDVLAVYHVMHEALERARNGEGPTMIEAVTFRYGPHTMSGDDPTRYRTK
                        *.** *:****** **** .    *  :**  *:**::**:: :********:*****:**::

pdb|1W85|A              ELENEWAKKDPLVRFRKFLEAKGLWSEEEENNVIEQAKEEIKEAIKKADETPKQKVTDLI
sp|P21873|ODPA_BACST    ELENEWAKKDPLVRFRKFLEAKGLWSEEEENNVIEQAKEEIKEAIKKADETPKQKVTDLI
ref|YP_146911.1|        ELENEWAKKDPLVRFRKFLEAKGLWSEEEENRVIEQAKEDIKEAIKKADETPKQKVTDLI
ref|YP_001421036.1|     EIENEWEQKDPLVRFRKFLENKGLWSEEEENKVIEQAKEEIKQAIKKADGESKPKVTELI
ref|NP_243521.1|        DLDDEWEKKDPLVRFRKFLEGKGLWSEEQENEVVEKAKEDIKAAIKKADAAPKQKVTDLI
RAAC02426               DVQEEWEKKDPLIRFRKYLEEKGLWSQEEEEAYIEEAKETVNNALKEADAAEKMTIPGLI
                        :::*:** :****:****:** *****:*:*:  :*:***  :: *:*:**    * ...  **

pdb|1W85|A              SIMFEELPFNLKEQYEIYKEKES-
sp|P21873|ODPA_BACST    SIMFEELPFNLKEQYEIYKEKES-
ref|YP_146911.1|        SIMFEELPANLKEQYEIYKEKES-
ref|YP_001421036.1|     ENMFEEPTFNLKEQLEIYKAKES-
ref|NP_243521.1|        GFMFEEAPQHLREQLEEYTAKES-
RAAC02426               DSMFEELTPTLKRQRAEFAGEEAN
                          ****  .  *:.*    :   :*:
```

FIG. 58

```
sp|P21874|ODPB_BACST   ------------------------------------------MAQMTMVQAI
pdb|1W85|B             ------------------------------------------SAQMTMVQAI
ref|YP_001125046.1|    ------------------------------------------MAQMTMVQAI
ref|YP_146912.1|       ------------------------------------------MAQMTMVQAI
ref|ZP_01696304.1|     ------------------------------------------MAQLTMIQAI
RAAC02427              -----------------------------MPARRRTDMAQMTMIQAI
                                                                 ::*** sp|P21874|ODPB_BACST   TDALRIELKNDPNVLIFGEDVGVNGGVFRATEGLQAEFGEDRVFDTPLAESGIGGLAIGL
pdb|1W85|B             TDALRIELKNDPNVLIFGEDVGVNGGVFRATEGLQAEFGEDRVFDTPLAESGIGGLAIGL
ref|YP_001125046.1|    TDALRIELKNDPNVLIFGEDVGVNGGVFRATEGLQAEFGEERVFDTPLAESGIGGLAVGL
ref|YP_146912.1|       TDALRIEMRNDPNVLVFGEDVGVNGGVFRVTEGLQAEFGEERVFDTPLAESGIGGLAIGL
ref|ZP_01696304.1|     TDALRTELKNDENVLVFGEDVGVNGGVFRATEGLQKEFGKDRVIDTPLAESGINGLAIGL
RAAC02427              THALDLELARDERVLVFGEDVGKNGGVFRATEGLQQKYGPNRVFDTPLAESGIIGLANGL
                       *.**   *:  .*  .:** ** .***  ::*  ::***** * ** sp|P21874|ODPB_BACST   ALQGFRPVPEIQFFGFVYEVMDSICGQMARIRYRTGGRYHMPITIRSPFGGGVHTPELHS
pdb|1W85|B             ALQGFRPVPEIQFFGFVYEVMDSICGQMARIRYRTGGRYHMPITIRSPFGGGVHTPELHS
ref|YP_001125046.1|    ALQGFRPVPEIQFFGFVYEVMDSICGQMARIRYRTGGRYHMPITVRSPFGGGVHTPELHS
ref|YP_146912.1|       ALQGFRPVPEIQFFGFVYEAMDAICGQMARIRYRTGGRYHVPITIRSPFGGGVHTPELHS
ref|ZP_01696304.1|     ALQGFRPVPEIQFFGFVFETMDSIHGQMARYRFRTGGDLKMPITIRAPFGGGVHTPEMHA
RAAC02427              AIQGFRPVPEIQFFGFVFEAFDQIAGQLARTRYRTGGRYTAPVTIRSPFGGGVHTPEMHA
                       *:***************:*..:*  **:**  *:****    *:*:*:**********:*:

sp|P21874|ODPB_BACST   DSLEGLVAQQPGLKVVIPSTPYDAKGLLISAIRDNDPVIFLEHLKLYRSFRQEVPEGEYT
pdb|1W85|B             DSLEGLVAQQPGLKVVIPSTPYDAKGLLISAIRDNDPVIFLEHLKLYRSFRQEVPEGEYT
ref|YP_001125046.1|    DSLEGLVAQQPGLKVVIPSTPYDAKGLLISAIRDNDPVIFLEHLKLYRSFRQEVPEGEYT
ref|YP_146912.1|       DSLEGLVAQQPGLKVVIPSTPYDAKGLLISAIRDNDPVIFLEHLKLYRSFRQEVPEGEYT
ref|ZP_01696304.1|     DSLEGLMAQTPGIKVVIPSTPYDAKGLLISAIRDNDPVVFLEHMKLYRSFREEVPEEEYT
RAAC02427              DSLEGLFVQTPGIKVVIPSTPYDAKGLLLSAIRDPDPVIFLEHMKLYRSFRQEVPEDDYT
                       ******..* **:**************:***** ***:****:*******.**** :**

sp|P21874|ODPB_BACST   IPIGKADIKREGKDITIIAYGAMVHESLKAAAELEKE-GISAEVVDLRTVQPLDIETIIG
pdb|1W85|B             IPIGKADIKREGKDITIIAYGAMVHESLKAAAELEKE-GISAEVVDLRTVQPLDIETIIG
ref|YP_001125046.1|    IPIGKADIKREGKDITIIAYGAMVHESLKAAAELEKE-GISAEVVDLRTVQPLDIETIIG
ref|YP_146912.1|       IPIGKADIKREGKDITIIAYGAMVHESLKAAAELEKE-GISAEVVDLRTVQPLDIETIIG
ref|ZP_01696304.1|     IPLGKADVKREGKDISIIAYGAMVHESLKAADELEKE-GYSAEVVDLRTVSPLDVETIVA
RAAC02427              IPLGVANVVREGKHATVIAYGAMVHVALKAAEQWSKEKGLEAEVIDLRTVNPIDIDTIVA
                       **:*  *::  ****.  ::******** :****  :  .**  *  .***:*****.*:*:.:**:.

sp|P21874|ODPB_BACST   SVEKTGRAIVVQEAQRQAGIAANVVAEINERAILSLEAPVLRVAAPDTVYPFAQAESVWL
pdb|1W85|B             SVEKTGRAIVVQEAQRQAGIAANVVAEINERAILSLEAPVLRVAAPDTVYPFAQAESVWL
ref|YP_001125046.1|    SVEKTGRAIVVQEAQRQAGIAANVVAEINERAILSLEAPVLRVAAPDTVYPFAQAESVWL
ref|YP_146912.1|       SVEKTGRAIVVQEAQRQAGIAANVVAEINERAILSLEAPVLRVAAPDTVYPFAQAESVWL
ref|ZP_01696304.1|     SVEKTNRAIVVQEAQRQAGVAANVVAEINERAILSLEAPVLRVTAPDTVYPFSQAEGVWI
RAAC02427              SVKKTNRAIVVQEAQRSAGAAAEIVAQINENAIYYLEAPVLRATPPDTVYPFGMIEDEWL
                       **:**.**********.** **::**:***.**   *******.:*******.   *. *:

sp|P21874|ODPB_BACST   PNFKDVIETAKKVMN-
pdb|1W85|B             PNFKDVIETAKKVMN-
ref|YP_001125046.1|    PNFKDVIETAKKVMN-
ref|YP_146912.1|       PNFKDVIETAKKVIN-
ref|ZP_01696304.1|     PTYKDILEKAKETLT-
RAAC02427              PTPEYVLKTLDKVMSL
                       *.  :  :::.  ..:.
```

FIG. 59

```
dbj|BAB40585.1|         ----------------EHQFPKIQIVDENGNIVDSKYEDKLTPEFIKELYERLMFVRTF
ref|ZP_01171269.1|      ------------------------MIDENGNEVSG--TSGFDTELALEFYRQLVRIRVF
ref|YP_001126012.1|     ------------------------VLNEEGTVVQPEYRERITKELTMVMYRHLIRTRTF
ref|ZP_02326224.1|      -----EKEEMAMKHDKLHGLQEPYQVLKPDGE-LRHRIGGEVDEALMIKMYENMMHVRMF
ref|NP_241079.1|        --------------------------------------------VLSMYKQMINCREF
RAAC01657               MLAEHDRAERLMEIAKAEGLYEEIHLLKEDGT-LAGAVD-DIPPEVMVAMYRHMVFARAF
                                                                    :*..::   *  * dbj|BAB40585.1|         DRKAISLQRQGRLGTYAPFEGQEAAQVGSALALEKDDWLFPTYRDHAATITFGHKLSTVF
ref|ZP_01171269.1|      DRKAVSLQRQGRIGTYAPFEGQEAAQIGSAMALEESDWMFPTYRDHGAALAFGHSMRNVL
ref|YP_001126012.1|     DRKCVSLQRQGRIGTYVPYEGQEACQVGSALALNDEDWMFPTYRDHGAMMTFGRSLVNTL
ref|ZP_02326224.1|      DRKAVNLQRQGRIGTYAPYEGQEAAQVGSAMALSPEDWLFPSYRDHAATITHGQSLSRVL
ref|NP_241079.1|        DEKALKLQRQGRIGTYASFKGQEACQIGGALALRPTDWLFPTYRDHAAISTHGQPWHRIF
RAAC01657               DRKAIALQRQGRIGTYAPFEGQEAAQVASAMALAPEDFVFPSYRDHAATMVLGQSPANVL
                        *.*.: ******:***..::****.*:..*:**    *::**:****.*   .*:    :

dbj|BAB40585.1|         LYWNGRVEGCVPPEGKKIFPPAVPIATQLPHATGAAMAEKYKGTKNAAIVYFGDGATSEG
ref|ZP_01171269.1|      LFWNGRNEGCIPPEGKNIFPPGIPIATQIPHAAGAAYAEKRKGTKKAAIVYFGDGATSEG
ref|YP_001126012.1|     LYWKGRTEGCVPPEGKKIVPPSVPIATQLPHAAGAACAEKWKGTKNAVIVYFGDGATSEG
ref|ZP_02326224.1|      LYWMGHMEGSVSPEGLKIMPPCVPIATQLVHAVGTSWAAKLKGEKQASIAYFGEGATSEG
ref|NP_241079.1|        LYWMGHMDGSLSPDDRNILPPAVPIATQMLHAVGTAWADKLKGNPHVSLVFFGDGATSEG
RAAC01657               LYWSGRVEGIRSPEGRHILPPSVPIATHVLHAVGAAWASRYRKESAVSIAYFGDGATSEG
                        *:* *: :*  .*:. :*. ::: .*:: * : :      . :.:****** dbj|BAB40585.1|         DFHEGLNFASVFKAPVVFFNQNNSFAISVPIHKQMNSKTIAQKSVAYGIPGIRLDGNDIF
ref|ZP_01171269.1|      DFHEGLNFASIVKAPVVFFNQNNQYAISVPLSKQMNTKTIAQKSLAYDIPGVRVDGNDVF
ref|YP_001126012.1|     DFHEGLNFASVFNAPVVFFNQNNQYAISVPITRQMRSKTIAQKALAYDIPGVRIDGNDVF
ref|ZP_02326224.1|      DFHEALNFAGVYQTATIFFCQNNGYAISVPFHAQSASRTIAQRAAAYDIVGVRVDGNDIF
ref|NP_241079.1|        DFHEALNFAGVYQTPTIFFCQNNGYAISVPFEKQSASKTIKQRSVAYDMRGERVDGNDIF
RAAC01657               DFHEALNFAGVFHLPVLFFCQNNGYAISVPFSRQSASRTIAQRAIAYDIVGVRVDGNDAF
                        **...: :  ..: * :***:    *   ::** *:: **.: * *:**** * dbj|BAB40585.1|         AVYFYTKEALDRARNGEGPTLIEAVTWRYGAHTTADDPTKYRNQE-ESLERREKYDPILR
ref|ZP_01171269.1|      AVYRETKKALERAREGGGPTLIEAVTWRYGAHTTADDPAKYRDQQ-ESSVLRGKIDPILR
ref|YP_001126012.1|     AVYFQTAEALERARHGGGPTLIEAVTWRYGAHTTSDDPSRYRDQE-ESKKRRETTDPIKR
ref|ZP_02326224.1|      AVWLTVREAIKRGLAGGGPTLVEAVTFRYGAHTTSDDPRKYRDQERLASEWREQRDPVHR
ref|NP_241079.1|        AVYLTVKRAIEQARKGRGPTLIEAVTTRFGSHTTADDAKKYRDQEEIERTWKEMQDPLTR
RAAC01657               AVYRAVKEARSRALHGLGPTLIEAVTFRMGAHTTADDPTRYRDQKAVVEAWQK-RDPIVR
                        **:    . .*   .:.  * ** :***  * *:* :. :**:*:       :    **: * dbj|BAB40585.1|         VERLMKNKGIWDEKWAASVEEKASQTIEEAVKEMEAFPAPDVNDLFDHVFEKPTW-----
ref|ZP_01171269.1|      MERWLKNKDLYDENWAKRAESEAAAEIDLAIAEMEAYPPADPADIFDHVFAELIWPL---
ref|YP_001126012.1|     VVRLMQREGWWNEQWANQVQEEVNAEIEQAVAEMERYPKANASDMFDYVFAEPTWTIA--
ref|ZP_02326224.1|      LRLFLQKRGLWNEKDEERMLERLTGLIEDAVSEAESYPKSRPADMFKHVFADVPWSI---
ref|NP_241079.1|        LKAYIQAKGWLSEEEEAQMKAKIRETIDEELSMAEQYPKPSISQMFEHVYENQPWYV---
RAAC01657               LRLYLESQKLWSESDEAKLQDEVKARVEAAVEEALSIAPPDMEMMFDHVYAEEPWHLAAE
                        :      :: .*.       ::   :       ..  :*.:*:..  * dbj|BAB40585.1|         -------------
ref|ZP_01171269.1|      -------------
ref|YP_001126012.1|     -------------
ref|ZP_02326224.1|      -------------
ref|NP_241079.1|        -------------
RAAC01657               REEYRRTREGVSV
```

FIG. 60

```
dbj|BAB40586.1|         ----LTLVQAVTDGLRTMLKEKKEVIVLGEDVGKNGGVFRATDGLQEEFGEDRVIDTPLS
ref|NP_693798.1|        -TKQLTLIQAITDGMRTMLHEREEVVVLGEDVGKNGGVFRATDGLQEEFGEKRVFDTPLS
ref|YP_001126011.1|     -TKSLTLVQAVNDALRIMLKERDDVVLLGEDVGRNGGVFRATDGLLQEFGEERVIDTPLS
ref|ZP_02326223.1|      MSRSLTILQAVTEALDQKLAHDHRVVLLGEDIGVNGGVFRATDGLFVKYGEERVLDTPLA
ref|NP_241080.1|        -SQQQTMLQAINQTLDDLLATNDDVMLLGEDIGINGGVFRATDGLYEKYGKDRVVDTPLA
RAAC01658               MSRMLNLVQAINEALDLKLADDPRVVLLGEDIGKNGGVFRATDGLLEKYGEERVIDTPLA
                           .::**:.:  :    *   *::****:* **********   ::*:.**.****:

dbj|BAB40586.1|         EAGIVGVSIGMAINGMLPVAEIQFLGFIYPAYEQIMTHASRIRMRTMSKFHVPLVIRAPY
ref|NP_693798.1|        EAGIIGSSIGMAINGLLPVAEIQFSGFIYPAYEQIMTHATRMRYRTKGVFTVPLVIRAPY
ref|YP_001126011.1|     EAGFTGAAIGMALNGFRPVVEIQFLGFIYPAYEQIMTHAARMRSRTRGHFTVPLVIRAPY
ref|ZP_02326223.1|      ESGIIGSAIGFALNGLLPVIEIQFLAFIYPGFEQLVSHAARMRYRTRGQFSVPIVIRTPY
ref|NP_241080.1|        ESGIIGSAIGLAMNGKRPIVEIQFLAFIYPGFEQLISHAARMRYRTRGQYNVPMVIRTPY
RAAC01658               ESAIIGTSIGMAVNGLIPVPEIQFLAFIFPALDQLFSHVARMRYRSQGQFPVPMTIRTPY
                        *:.:  * :**:*:**   *:  **** .**:*. :*::*.:*:*  *: . . **:.**:**

dbj|BAB40586.1|         GAGVRAPEIHSDSVETLFTHMPGIKVVCPSTPYDAKGLLIAAIEDPDPVLFMESMKLYRS
ref|NP_693798.1|        GAGVRAPEIHSDSMEALFTHMPGIKVVCPSSPYDAKGLLISAIEDPDPVLFLEPLKLYRA
ref|YP_001126011.1|     GAGVRAPEIHSDSTEALFTHMPGVKVVCPSSPYDAKGLLIAAIEDPDPVLFLEPMRNYRA
ref|ZP_02326223.1|      GTGIRGPELHSDSIEAFFVHTPGIKVAVPSNPYDAKGLLISAIEDPDPVIFLEPAQIYRA
ref|NP_241080.1|        GAGIRGPELHSESVEAFFAHTPGLKVVAPSNPYDAKGLLTAATSDPDPVIFLEDTKLYRA
RAAC01658               GAGIHGPELHAESVESFFAHTPGLKVVVPSGPYDAKGLLISAIEDPDPVVFLEPTKLYRA
                        *:*::..**:*::*  *::*.*  **:**. ** ********  :* .*****:*:*    : **:

dbj|BAB40586.1|         SREDVPEGKYTVEIGKARKVRDGKDVSIFAWGAMVPVATKAAEEMEK-KGVTCDVIDLRT
ref|NP_693798.1|        VRGEVPEEKYEIEIGKGKYLREGDDVTVIAWGAMVPVAMKAAEQ-AAEKGITCEVIDLRT
ref|YP_001126011.1|     FREDVPEGKYTVDIGKGKKLREGEDVTVIAWGAMVPVAMKAAEAAAK-KGIDADVIDLRT
ref|ZP_02326223.1|      FKTKVPEDMYRVPLGKASIVQEGNDVTIISWGAMMRVALTAAQQMERENGWSCEVIDLRS
ref|NP_241080.1|        FKEDVPNTLYEIPLGQAKVVQEGEDVTVIAWGGMVREALQAAKEAEKAHGWSCEIIDLRT
RAAC01658               FREEVPEGLYRVPIGKAKRVREGEDVSVFAWGSMLHTALKVAEAIERERGWTCDVIDLRT
                           : .**:    *  : :*:.    :::*.**::::**.*:  *    .*     .::****:

dbj|BAB40586.1|         LYPLDKDAIAESVQKTGRVVIVHEAHATGGVSNDVMAVINDTAFLYLKAPIERVTGFDVP
ref|NP_693798.1|        LYPIDRAIIAESVQKTGRCVVHEAPATGGLGNDIISIVNDTSFLYMKSPIERVTGADVH
ref|YP_001126011.1|     LYPLDKDMIAESVQKTGRTVIVQEAHATGGLANDILAVINDTSFFYQKAPAERVTGFDVP
ref|ZP_02326223.1|      LYPLDRDTIVASVQKTGRALIVHEAHKTAGVGAEIISLINEEALMYLRAPVKRITGFDVP
ref|NP_241080.1|        IAPIDRETIIESVKKTGRAIIIHEAHKTAGLGGEITALINEEALIYLKAPVKRIAGFDIP
RAAC01658               LYPLDRDAIVESVQKTGRAVVVHEAHKTAGLGAEIVSLINEEALLYLRAPIKRIAGFDVP
                        : *:*:  *  **:****  :::**  *.*:.  ::  :::**:    ::: *  :**::*  *:

dbj|BAB40586.1|         VPFFTLEEHYLPNTGRVVKAIEKVIHF
ref|NP_693798.1|        VPFWALEEHNIPTPARVMDAINQVINF
ref|YP_001126011.1|     VPFFAHEDDYLPTPARVLHAIEKVM--
ref|ZP_02326223.1|      VPQFSLENFYVPTVKRVKDGIADTIRF
ref|NP_241080.1|        VPQFLSENQYLPTIERMFRGIEETVSF
RAAC01658               VPFFALEDEYMPTEARIRAGIEETITF
                        ** :  *:  :*.  *:  .*  ...:
```

FIG. 61A

```
ref|YP_001125466.1|      ------------------------------------------------------------
ref|YP_147353.1|         ------------------------------------------------------------
RAAC00484                MCGEGRECLAGTAGGRVLGLPRYLAPARAGARRRAGAVSNHPRRGEGRALAPDQGRPPAL
ref|ZP_01697095.1|       ------------------------------------------------------------
ref|YP_077737.1|         ------------------------------------------------------------
ref|ZP_01886631.1|       ------------------------------------------------------------ ref|YP_001125466.1|      ------------------------------------------------------------
ref|YP_147353.1|         ------------------------------------------------------------
RAAC00484                VPGRRGDVRRADGARSRPHGAPRRSLAHTGLRRGQVAGSRPSRLREGAAGPRRDAICPGV
ref|ZP_01697095.1|       ------------------------------------------------------------
ref|YP_077737.1|         ------------------------------------------------------------
ref|ZP_01886631.1|       ------------------------------------------------------------ ref|YP_001125466.1|      ------------------------------------------------------------
ref|YP_147353.1|         ------------------------------------------------------------
RAAC00484                CGRGGRPRARDLRPDLRGRRRAVGRSRLSVGPPILSAGGLARDEIGHIEPPLRVRLPHNL
ref|ZP_01697095.1|       ------------------------------------------------------------
ref|YP_077737.1|         ------------------------------------------------------------
ref|ZP_01886631.1|       ------------------------------------------------------------ ref|YP_001125466.1|      ------------------------------------------------------------
ref|YP_147353.1|         ------------------------------------------------------------
RAAC00484                VGISPLAHHPLVHRLLDGVEARPLLGPREIRRVQADVVQHAIHVQESADGGELEEDEFVL
ref|ZP_01697095.1|       ------------------------------------------------------------
ref|YP_077737.1|         ------------------------------------------------------------
ref|ZP_01886631.1|       ------------------------------------------------------------ ref|YP_001125466.1|      ------------------------------------------------------------
ref|YP_147353.1|         ------------------------------------------------------------
RAAC00484                VVAALAVRIALKTSDAQDGLRAVKARHEIRSVAKNVELVRKRTPAQDVIAHQAAAVFSPV
ref|ZP_01697095.1|       ------------------------------------------------------------
ref|YP_077737.1|         ------------------------------------------------------------
ref|ZP_01886631.1|       ------------------------------------------------------------ ref|YP_001125466.1|      ------------------------------------------------------------
ref|YP_147353.1|         ------------------------------------------------------------
RAAC00484                LGVGGGDDRVGGSLVHGGGQFGEGRWREPVVAVQGDEVRRSHVRQRRLQRVAKALVFPER
ref|ZP_01697095.1|       ------------------------------------------------------------
ref|YP_077737.1|         ------------------------------------------------------------
ref|ZP_01886631.1|       ------------------------------------------------------------ ref|YP_001125466.1|      ------------------------------------------------------------
ref|YP_147353.1|         ------------------------------------------------------------
RAAC00484                QHAHARVPQVAPRDLARSVRRSVIHDDEIPCRRGLCEHACDGHRQIARPVVHGEHHRHAR
ref|ZP_01697095.1|       ------------------------------------------------------------
ref|YP_077737.1|         ------------------------------------------------------------
ref|ZP_01886631.1|       ------------------------------------------------------------
```

FIG. 61B

```
ref|YP_001125466.1|     ------------------------------------------------------------
ref|YP_147353.1|        ------------------------------------------------------------
RAAC00484               LSPGAHGEPLLCAEHDAKIRYNECKSSRKAWESAVIEDKVRLEFMGVQALLLRLPEEVPI
ref|ZP_01697095.1|      ------------------------------------------------------------
ref|YP_077737.1|        ------------------------------------------------------------
ref|ZP_01886631.1|      ------------------------------------------------------------ ref|YP_001125466.1|     -----------------------EGIKEIVPAFSSLTVY--YDPVVAGNYADVCAWLREN
ref|YP_147353.1|        -----------------------EGIEEIVPAFSSLTIY--YDPLVID-YIGIGAWLRKN
RAAC00484               ETGEALDRLLSLRAALLRELEGVDGIEDITIGYRSVAVYARFEDVSPD---DVLARARRA
ref|ZP_01697095.1|      ----------------------------VTVLYDPFKVYAKFG-------EYPYRYVSRY
ref|YP_077737.1|        ----------------------VPAFTSVTVFYQPFEVYRKMESGKAV--DSPYEKVKAL
ref|ZP_01886631.1|      --------------------------------PTEV------------------------
                                                        . :

ref|YP_001125466.1|     I-GSTGQA---ARHSTR---TIVIPVCYGGEFGPDLADVARFHGMTEDEVVALHSSGRYR
ref|YP_147353.1|        I-RRSEQA---VRRSAR---TVVIPVCYGGEFGPDLPDVARFHGMTEDEVIALHSAGRYR
RAAC00484               IQGSQGSP-VPATRPEA---VVTLPVVYGGSFGPDLDAVAERAGLSPQDVIRLHQEAVYR
ref|ZP_01697095.1|      FTRLLEKAQPAFIPEPR---TVDIPVCYGGEFGPDLENVARINDLTPEEVIRIHASGDYT
ref|YP_077737.1|        LDHHLQELTMEEETDQR---TVEIPVCYGGRFGPDLEEVADINGLTAQEVIDIHTSGEYL
ref|ZP_01886631.1|      --------------------VEIPVIYGGEYGPDLDVVAQHTGLSVAEVIRRHSDVEYL
                                            : : * :**      .:: :*:   *       * ref|YP_001125466.1|     VYMIGFSPGFAYLGGLSPRLATPRRPVPRTTVPAGSVGIAGGQTGVYPLATPGGWQLIGR
ref|YP_147353.1|        VYMIGFSPGFAYLGGLSPRLATPRRSVPRTKVPAGSVGIAGGQTGVYPLATPGGWQLIGR
RAAC00484               VAMIGFSPGFAYLIGLPEPLRVPRRETPRSRVERGSVGIAGFQTGVYSFATPGGWQIIGR
ref|ZP_01697095.1|      VYMIGFAPGFPYIGGMPEKIAAPRKKTPRLKIPERSVGIAGKQTGIYPIETPGGWQIIGR
ref|YP_077737.1|        VYMIGFAPGFPYLGCMSEKIAAPRRSSPRTSIPAGSVGIAGMQTGVYPLSTPGGWQLIGN
ref|ZP_01886631.1|      VYMIGFTPGFPYLGGMDPALAVPRKDSPRAKIASGAVGIAGQQTGIYPMESPGGWQIIGR
                        *  ****:***.*:  *:      :  .**:  **    :    :*****  ***.*: : :*****:**.

ref|YP_001125466.1|     TPLRLFDPHREKPSLLSAGDIVEFRRITAEEF--------
ref|YP_147353.1|        TPLKLFDPHREKPSLLAAGDIVAFQPIGADEF--------
RAAC00484               TPVALFDVHRPSPSLLSPGDEVRFEAVTEEEYHGRFGAYT
ref|ZP_01697095.1|      TPVKLFRPDRDGPSLLQAGDKIRFRPVSLEEY--------
ref|YP_077737.1|        TPLELFKPYEQPPSLLRAGDIVKFVSVTEEEYH-------
ref|ZP_01886631.1|      TAADLFDRNRNPPALLKAGDRLRFVSITEDNYH-------
                        *.  **   .  *:** .** : *  :   :::
```

FIG. 62

```
ref|YP_001420062.1|      ---------------MKVVKPGLLTTVQDTGRTGYQKYGVLGSGAMDTISLRIANLLAGNQ
ref|NP_242684.1|         ---------------IFRPGLLTTIQDLGRTGYLKYGVIVSGPMDEYAHRMANLLVGND
ref|NP_886151.1|         ---------------VIKPGMLSTFQDGGRHGYQHQGIPVAGAMDPRAHRLANLLAGNA
ref|YP_147354.1|         ---------------IDVIEAGLFTTVQDGGRFGYRHAGVPAGGAMDAWAYRLANALVGNN
ref|YP_001125467.1|      ---------------VIDGGFFTTVQDGGRIGYRNAGVPVGGVMDAWAYRLANALVGNE
RAAC00483                MAALARTHEPGIARVRVLAPGLFTTVQDGGRPHHRHLGVPLGGALDVLAFRSANRLVGNA
                                         :.  *:::*.** **   :  :   *:     .* :*    :  * ** *.**

ref|YP_001420062.1|      EKEAGLEITLMGPGPSFEFSEPAVIAVTGADFALHINGEPAPLWKPVLIKENSVVSFGPC
ref|NP_242684.1|         EKAALLEMTFIG--PTIQFTSDQLIAMTGGDLSPTIDGHSVPMYRPVFVKKGAVLSFGRC
ref|NP_886151.1|         ADTATLEITVAG--PTLRFEAPACVALGGADLGATLGGLPAPVLRPLVARAGDVLSFARP
ref|YP_147354.1|         GDEAVLEATMAG--PTLRFRVEAVVAVCGGDFPCTLNGQPISLWKPEIVKSGDVLEVGVC
ref|YP_001125467.1|      GDEAVLEATMSG--PTLRFHVETVIAVCGGDFPCTLNGEPMAMWKPVIIRPGDVLKVGVC
RAAC00483                EDCAALEVTGAG--PKLAFEAPAAVALCGADFLAYVDGEPLPVQRPVWLGGGAVLEIRNA
                           .  * **  *   *.: *         :*: *.*:      :.*  . .: :*        . *:..

ref|YP_001420062.1|      KMGSRAYLAVAGGFDVPAVMESKSTYVRAGIGGFCGRALQKDDELPLG-----RMTPCSE
ref|NP_242684.1|         KTGCRSYLAIGGGIDVPKVMNSRSTYLRAKIGGFQGRALVEGDELICG-----APPEQTE
ref|NP_886151.1|         GQGARAYLAVHGGYDLPMVMGSQSTYLRSAFGGYHGRALAKGDQVGLR-----RPLADDA
ref|YP_147354.1|         RTGFRAYIAVSGGIDVPPVMGSRSTYVPAQLGGLSGRPLQRGDAL----------PVGV
ref|YP_001125467.1|      QAGWRAYIAVSGGIGVPSVMGSRSTYVPAQLGGLSGRPLQPGDVL----------PIGT
RAAC00483                RRGFRGYLAIRGGFLVEQVLDSRSALPRYGIG----KLLAAGDEMTYQ-----PGPAAPP
                           *  *.*:*: ** :   *: *:*:     :*       :  *  .*  :

ref|YP_001420062.1|      SIAYCLSDSFGQHGFSAPDWSVSSRGFLP-LKKNPVIRVLEGAQFHAFTEEAKLRFYQES
ref|NP_242684.1|         RLVKTCQKGI-VHSFATTKWSVVSSQRSR-DGAEKVVRVTVGSHYEQFSEASQHKFFSET
ref|NP_886151.1|         ARLDALAQQLWQLRFY-----LAATLSSP-PRD--VLRILPGPHWEAFDAASRQALLDQA
ref|YP_147354.1|         THGRRVIG-RMRWGLASAARRYIGG-------KTKTVRAVPGPEYDEFTPASRRQFFAAR
ref|YP_001125467.1|      AREHNIRK-PFRWGLSSDAGRYIDG-------KTKTVRAVPGPEYSEFTPESRRQFFAAR
RAAC00483                AGFRAISPRAAVAPFQVGGWLDQIED------EIVILRVVRGEQADWFEKGSRRAFFDRT
                                           :                               :*   *.    *    ::  :

ref|YP_001420062.1|      YTVTPQSDRMGYRLKGAPLELREP-LEMVSEAVTFGTVQVPPDGNPIILLADRQTTGGYP
ref|NP_242684.1|         FQVTSKSDRMGYRLKGPTLERLEE-QELISEPISVGTIQVPADGNPIILMADRQTTGGYP
ref|NP_886151.1|         FRIGAQSDRMGYRLEGPRLRLSER-REMLSEATCFGTVQVPADGAPIVLMADRQTTGGYP
ref|YP_147354.1|         YEVTTQSDRIGYRLSGRALALVRE-REMVSEAVVFGTVQVPASGQPIVLMADSQTTGGYP
ref|YP_001125467.1|      YHVTPQSDRIGYRLSGPALVLGRE-REMVSEAVVFGTVQVPTSGQPIVLMADSQTTGGYP
RAAC00483                WQVAPRSDRMGLRLRGEPLRAPSR--QLASEPVVPGSVQVPQDGLPIVLMRECQTTGGYP
                            : :  ..***:* ** *  *       :: **.   *::*** .* **:*:  : ******* ref|YP_001420062.1|      RMAHIISADLPLVAQTMPGEHITFRAVSLEEAELLLLEKEQQLKE-LKARL----KMEWL
ref|NP_242684.1|         RIAHVIAVDLPIIAQAKPGAAIRFQQASLKEAERL------------------------
ref|NP_886151.1|         KLAQVATVDLPSLAQAMPGQALRFALIELEQAQRL------------------------
ref|YP_147354.1|         RIAQVASVDLPILAQARPGDFIQFQPIEPEEAMWLYREQQQRLAR-WIAAI----RRQWE
ref|YP_001125467.1|      RIAQVAAADLPVLAQARPGDRIQFQPVAPEEAVQLYIEQQRRLGC-WIAAI----RRQWG
RAAC00483                KLATVISADLDKLAHLRPGSSVRFVEVSFEEAFRLRRVHDR-LARVWLRFVAERARQAWG
                          ::*  : :.** :*:  **   :*       ::*    * ref|YP_001420062.1|      -----
ref|NP_242684.1|         -----
ref|NP_886151.1|         -----
ref|YP_147354.1|         GE---
ref|YP_001125467.1|      EK---
RAAC00483                SEGGD
```

FIG. 63

```
ref|ZP_01860800.1|         ------MAQKTVVLDQPAIRRALTRIAHEIIERNKGIQDCVLVGIKTRGIHLAKRLANRI
ref|ZP_01695960.1|         ------MAQKAVVMDEIMIRRALTRIAHEIIERNKGIEDTMLIGIKTRGIYLADRLAERI
ref|YP_147000.1|           --------QKAVVMDEQAIRRALTRIAHEIIERNKGIDGCVLVGIKTRGIYLARRLAERI
ref|YP_001125127.1|        --------QKAVVMDEQAIRRALTRIAHEIIERNKGIDGCVLVGIKTRGIYLARRLAERI
ref|YP_806677.1|           ------MAQSKQVVDEVTMKRALTRISYEIIEQNKGLNDLVLVGIKTRGIYLAHRIAKRL
RAAC00134                  ------MAQKTQIMDEAAMRRSLTRMAHEILERNKGLDDLVLVGIVTRGAILAERLGRKL
                                  *.   ::*:   ::*:***:::**:*:***::. :*:** ***  ** *:..::

ref|ZP_01860800.1|         EEIEGAKMPVGEIDITLYRDDLTVKTANEEPEVKGSDLPVDVTDKKVILIDDVLFTGRTV
ref|ZP_01695960.1|         ERIEGRKVEVGELDITLYRDDLSKKTVDGEPEVKGANLPSSITGKKIVLVDDVLYTGRTV
ref|YP_147000.1|           EQIEGASVPVGELDITLYRDDLTVKTDDHEPLVKGTNVPFPVTERNVILVDDVLFTGRTV
ref|YP_001125127.1|        EQIEGTSVPVGELDITLYRDDLTMKTEDHEPLVKGTNVPFPVSEQKVILVDDVLFTGRTV
ref|YP_806677.1|           EQLEGLQVPVGELDIQFYRDDVHKIDHDHQPDVEGAQLPVNITGKHVILVDDVIFTGRTI
RAAC00134                  FEIEGQVVPCHRLDPRPYRDDRDRTVSPEAPAPN-----IDVADRKVILVDDVLYTGRTV
                            .:**   :    .:*   ****   *  :        ::  :::*:***::****:

ref|ZP_01860800.1|         RAALDALMDVGRPSNIQLAVLVDRGHRELPIRADFVGKNIPTSSSEKIVVELTEVDDEDQ
ref|ZP_01695960.1|         RAAMDALMDIGRPSRIQLAVLVDRGHRELPIRPDFIGKNIPTSQSERIVVQLTDVDGRDL
ref|YP_147000.1|           RAAMDAVMDLGRPARIQLAVLVDRGHRELPIRADFVGKNVPTSRSELIVVELSEVDGIDQ
ref|YP_001125127.1|        RAAMDAVMDLGRPARIQLAVLVDRGHRELPIRADFVGKNVPTSSAEVIVVELAEVDGVDQ
ref|YP_806677.1|           RAALDALMDEGRPRKISLAVLVDRGHRELPIRPDFVGKNIPTSLDEQIQVQVSELDGKDG
RAAC00134                  RAALDAMMRAGRARCVQLATLVDRGHRELPIRPDFVGKNVPTARDEQVIVRLAEVDGLDG
                           *::*   .   :..*********.:*::   * :  *.:::::*. * ref|ZP_01860800.1|         VTI-----
ref|ZP_01695960.1|         VTI-----
ref|YP_147000.1|           VSIHE---
ref|YP_001125127.1|        VSIHE---
ref|YP_806677.1|           ISI-----
RAAC00134                  VWIAEGRA
                           : *
```

FIG. 64

```
ref|YP_145879.1|         ----------MYTVVGVRFKKAGKIYYFDPGDAVIPVGEFVIVETVRGIEYGKVVIANKQ
ref|YP_001124157.1|      ----------MYTVVGVRFKKAGKIYYFDPGDFVIPAGEFVIVETARGIEYGKVVIANKQ
ref|ZP_01174007.1|       ----------MYDVVGVRFKKAGKIYYFDPGDLSIQKDDFVIVETVRGVEYGKVVIARKQ
ref|YP_001642924.1|      ----------MYDVVGVRFKKAGKVYYFDPNQFDISENEFVIVETVRGIEYGKVVITKKQ
ref|ZP_01697513.1|       ----------MFNVVGIRFKKAGKVYYFDPGDFPVKKNDAVIVETARGIEYGFVVTNPKV
RAAC00215                MRPFAGGYNLMVTIVGVRFKPAGKIYYFDPGDLPIEKGADVIVETTRGIECGRVVVGPKQ
                                   * ::* *:*.:   :   . *.:* * **   * ref|YP_145879.1|         VDENDIVLPLKKVIRVANEKDKWVVEENKKAAREAYDICLRKVEEHGLEMKLVDVEYTFD
ref|YP_001124157.1|      VDENDIVLPLKKVIRVANEKDKWVVEENKKAAREAYDICLRKVEEHGLEMKLVDVEYTFD
ref|ZP_01174007.1|       VDENDVVLPLKKVLRIADQKDRMIVEENKEAAHEAYEVCCEKVSTHQLDMKLVDVEYTFD
ref|YP_001642924.1|      VDENDVVLPLKKVIRIANENDRTIVEENRHAAKEAYQVCQQKVGEHNLDMKLVDVEYTFD
ref|ZP_01697513.1|       VGEHDVVLPLKKIIRIADQKDHMTVDENKAAAKEAYGICMKKIAEHQLEMKLVDVEYTFD
RAAC00215                VAEDDVVLPLKEVMRIATEADRAVVEENRRRAKQAMGVFREKVAKHGLEMKLVDAEYTFD
                         * *.*.*****::*:* : *: *:**: *::* :  .*: * *:***.*** ref|YP_145879.1|         RNKVIFYFTADGRVDFRELVKDLASIFRTRIELRQIGVRDEAKMLGGIGPCGRMLCCSTF
ref|YP_001124157.1|      RNKVIFYFTADGRVDFRELVKDLASIFRTRIELRQIGVRDEAKMLGGIGPCGRMLCCSTF
ref|ZP_01174007.1|       RNKVIFYFTADGRVDFRELVKDLAAIFRTRIELRQIGVRDEAKMLGGIGPCGRMLCCSTF
ref|YP_001642924.1|      RNKIIFYFTADGRIDFRELVKDLAAIFRTRIELRQIGVRDEAKMLGGIGPCGRMLCCSTF
ref|ZP_01697513.1|       RNKIIFYFTADGRVDFRELVKDLASIFRTRIELRQIGVRDEAKMLGGIGPCGRMLCCSTF
RAAC00215                RNKLIFYFTADGRVDFRELVKDLASVFRVRIELRQIGVRDEAKILGGIGPCGRLLCCSTW
                         ***:*********:**********:.**.**************:********:*****:

ref|YP_145879.1|         LGDFEPVSIKMAKDQNLSLNPTKISGLCGRLMCCLKYENEEY-------
ref|YP_001124157.1|      LGDFEPVSIKMAKDQNLSLNPTKISGLCGRLMCCLKYESEEY-------
ref|ZP_01174007.1|       LGDFDPVSIKMAKDQNLSLNPTKISGLCGRLMCCLKYENDEY-------
ref|YP_001642924.1|      LGDFEPVSIKMAKDQNLSLNPAKISGLCGRLMCCLKYENDEY-------
ref|ZP_01697513.1|       LGDFEPVSIKMAKDQNLSLNPAKISGLCGRLMCCLKYENDEY-------
RAAC00215                MGEFDPVSIRMAKDQSLSLNPSKISGLCGRLMCCLKFENDAYHDQDAMA
                         :*:*:****:*****.*****.**************:**: *
```

FIG. 65

```
pdb|1M2N|A              ------------------------YLVALTGAGVSAESGIPTFRGKDGLWNRYRPEELAN
pdb|1M2K|A              ------------------------YLVALTGAGVSAESGIPTFRGKDGLWNRYRPEELAN
ref|ZP_02127016.1|      ------------------------VVFTGAGVSAESGIPTFRGAGGLWERYRAEDLAT
ref|YP_359129.1|        ------------------------HAIAFTGAGVSTESGIPDFRGNSGLWEQYPVEKVAS
ref|YP_001540277.1|     ------------------------HAIAFTGAGISTESGIPDFRGPQGLWRRFDP-ALAS
RAAC02164               MLYYCSGKPPAKRVHRHLWTWPKSHLVAITGAGISVESGLPTV---DDMVAGVPLRSLFQ
                                                :.:****:*.***:*  .    .:         :

pdb|1M2N|A              PQAFAKDPEKVWKWY----AWRMEKV----FNAQPNKAHQAFAELERLGVLKCLITQNVD
pdb|1M2K|A              PQAFAKDPEKVWKWY----AWRMEKV----FNAQPNKAHQAFAELERLGVLKCLITQNVD
ref|ZP_02127016.1|      PEAFARDPKLVWEWY----RWRQTLA----YNARPNPAHYAIAQLEEAGLVKAVITQNVD
ref|YP_359129.1|        RRALMENPAFFLNFY----RERFKSY----ANVKPNRAHEALARMEKAGIIKGIVTQNID
ref|YP_001540277.1|     IDYLNTDPKGFWEFY----IERFRVL----NNARPNKAHLALAELEKLGIIKYVITQNID
RAAC02164               PNIWREQPLEAFHAFR--VIAREWQ------RKRPNRAHLALAQAEIP-----IITQNID
                         :*    .  :         *             .:  *:*. *        ::***:* pdb|1M2N|A              GLHERAGSRNVIHLHGSLRVVRCTSCNNSFEVESAP----KIPPLPKCDKCGSLLRPGVV
pdb|1M2K|A              DLHERAGSRNVIHLHGSLRVVRCTSCNNSFEVESAP----KIPPLPKCDKCGSLLRPGVV
ref|ZP_02127016.1|      GLHQRAGSRRVVELHGSLWRARCVQCGAVYKLEKPV----EETP-PRCPRCRGLLRPDVV
ref|YP_359129.1|        GLHQKAGSKNVIEIHGTLKRVRCDRCG-KYYLPEKL----DEEEVPRC-NCGGVIRPDVV
ref|YP_001540277.1|     NLHQSAGSINVIELHGNYTTVYCMRCKTQYPFTLALRKYEEGENPPRCPKCGGILRPNVV
RAAC02164               GLHRAAGSTRVIELHGNLRELRCDACGGIFQSELAWR-----EQLPKCPTCGELLRPGFV
                         .. *  .*:..**.       *  *   :            *:*  *  ::**..* pdb|1M2N|A              WAGEMLPPDVLDAAMREVERADVIIVAGTSAVVQPAASLPLIVKQR--------------
pdb|1M2K|A              WAGEMLPPDVLDRAMREVERADVIIVAGTSAVVQPAASLPLIVKQR--------------
ref|ZP_02127016.1|      WFGEPLPREAWEEAVQLASSADVVLVVGTSGAVYPAAAIPQIAKRRGAAVVEV-------
ref|YP_359129.1|        LFGEALPRREWQIALELAERSDLVLVVGSSLVVTPANQI---------------------
ref|YP_001540277.1|     LFGEPVN--EINRALEIAALSDVALVVGSSLTVYP-------------------------
RAAC02164               LEGEEVR--HIARALDWVTEARGLLVVGTELQMTPVRELYEVARRRNVPIAWVRDHAEDW
                         ** :       *:    .  :    :*.*:. : * pdb|1M2N|A              --------------------
pdb|1M2K|A              --------------------
ref|ZP_02127016.1|      --------------------
ref|YP_359129.1|        --------------------
ref|YP_001540277.1|     --------------------
RAAC02164               VPYLLGQEGGSDSLFCPGEV
```

FIG. 66A

```
ref|YP_173587.1|         ---------GLQQLVGSVKEVRAVAKGIENDMNEQLLTGLTGSARTVVSAALF----RET
ref|NP_240935.1|         ---------GLQRFIQEQEDTQAIVQGLEVNMKEQLVSGLSGSARPAVMAALY----KET
ref|YP_892975.1|         ------KMIGLLEQFYKNEEIQSVINGLEDGLKEQLVSGMATSSRSLLMAALY----KKT
ref|NP_976379.1|         ---------GLLEQFYKNEEIQSVINGLEDGLKEQLVSGMATSSRSLLMAALY----KKT
ref|YP_001373418.1|      ---------GLLEQFYKNKEVQSIINGLEEGLKEQLVSGMATSSRSLLMAALY----KKT
RAAC01438                MCWEGDKVKGLVELMAADGALSSLADGMGPRRNDILITGVTGAGRQLVMAALYH--LRNR
                                  **  .      ::  .*:    ::  *::*::  ..*    : ***:     ::

ref|YP_173587.1|         GRSQ--LVVTHNLYQAQKIYEDLVELLDEDTVYLYPVNELISAEIAVASPEMKAQRLDLL
ref|NP_240935.1|         RRPQ--LVITYNLYQAQKIFEDLVELVGADHVLLYPVNDLISSEIAIASPEMKAQRIDVL
ref|YP_892975.1|         KKSQ--LIVTHNLYQAQKVHEDLVALLGEKDVWLYPVNELIASELGVASPELKAQRIEVL
ref|NP_976379.1|         KKSQ--LIVTHNLYQAQKVHEDLVALLGEKDVWLYPVNELIASELGVASPELKAQRIEVL
ref|YP_001373418.1|      KQSQ--LVVTHNLYQAQKIYEDLVSLLGEKDVWLYPVNELIASEVGVASPELKAQRIEVL
RAAC01438                RLPESMIVVTHTASHAQTIWEDLKEYLPDARVYLPERDNALVDYLASSSDVLADRLHVL
                           .:   :::*:.   :.:  *     :    * ***  .:     :    :*.:: *:*:..:* ref|YP_173587.1|         NALVQDFKGIVVAPLAGIRRLLPPKALWQSSQLHLKTGEDIGDLEEFIKNFVTMGYRRSD
ref|NP_240935.1|         NQLVAGFSGIVVVPLAGMRRLLPPSSLWKESQIRLSVGDDIGDLESLIRRLVRNGFTRVD
ref|YP_892975.1|         NRLAAGEHGIIVAPVAGLRRFLPMKELWKQRQIEISLGQEI-DLDTFLHTLHHIGYERKS
ref|NP_976379.1|         NRLAAGEHGIIVAPVAGLRRFLPMKELWKQRQIEISLGQEI-DLDTFLHTLHHIGYERKS
ref|YP_001373418.1|      NRLAAGENGIIVAPVAGLRRFLPMKELWKQKQIEINLGQEV-DLDALLHTLHHIGYERKS
RAAC01438                EALAQEGPVVVVTTLLAAWQPVTKKSHFLHSLVNLAVGESK-PIDDVVAQLVRGGYERVS
                          : *.      ::*..: .   :   :. .         :.:  *:.   ::  .:  :   *: *  .

ref|YP_173587.1|         MVSAPGEFSVRGGIVDLYPLTKEHPLRIELFDTEVDSMRYFSLETQRSEGMIDEVTIGPA
ref|NP_240935.1|         MVTTPGECSVRGGIIDLYPLTEEDPIRIELFDTEIDSIRTFTIEDQRSKDSLSEVVIGPA
ref|YP_892975.1|         MVEAPGEFSLRGGILDIYPLTEELPFRIEFFDTEVDSIRLFDVDEQRSQDKKESVRFGPA
ref|NP_976379.1|         MVEAPGEFSLRGGILDIYPLTEELPFRIEFFDTEVDSIRLFDVDEQRSQDKKESVRFGPA
ref|YP_001373418.1|      MVEAPGEFSLRGGILDIYPLTEELPFRIEFFDTEVDSIRLFDVEEQRSQDKRESVKFGPA
RAAC01438                LVESRGQFSVRGGILDVFPMGHDLPYRIEWFDTDIDSIRTFDPATQRSQDKRDRVSFGPA
                          :* : *: *:****:*::*: .: * * *:*:*:* *      ***:..  . *  :*** ref|YP_173587.1|         QEVLLHHSHYSHGAKLLEEKYEATLKKVASKQTRDKLQEHIPFEIAQLKQSATFEGMYKY
ref|NP_240935.1|         AEIIMDEEHFIQGASRLEDRLSQTLKKVKKKEVKEKLTEQISFDISELKQHPFPSMYKY
ref|YP_892975.1|         TEFLFSQEELKSGIKHLEEGLTKTMQKLSDDKLKTTVLETVSHEIEMLKNGQSIEQMFKY
ref|NP_976379.1|         TEFLFSQEELKSGIKHLEEGLTKTMQKLSDDKLKTTVLETVSHEIEMLKNGQSIEQMFKY
ref|YP_001373418.1|      TEFVFSPEELRVGIEHLEKGLMKTMQKLSDDKIKTAVLETVSHEIELLKNGQNIEQMFKY
RAAC01438                FDLMLPQPVADKVADELEARLEARLKTVTDAALRDRLEQSISADIRKLREGQPFAGVARY
                          :..::     .  **    ::::.   :    : : :::. :*  *::    :   :   :* ref|YP_173587.1|         MSLYYETPQSLLSYMPEDAFVWVDEMNRVKEMAEHLQKEEAEWHTAMLEQGSIVHGTHLS
ref|NP_240935.1|         ISLFYDDTYSLFSYVPSNGVIFVDEMSRVKEMSESLEKEEAEWHTTLIEQGEIVHDVTLA
ref|YP_892975.1|         LSIFYNEPASLIDYLPEDGVVILDEISRIQETASHLESEEAEWYISLLGEGTIIQDLSFS
ref|NP_976379.1|         LSIFYNEPASLIDYLPEDGVVILDEISRIQETASHLETEEAEWYISLLGEGTIIQDLSFS
ref|YP_001373418.1|      LSIFYKEPASLIDYLPENGVVILDEISRVQETASHLETEEAEWYTSLLSEGAIIQDLVFS
RAAC01438                QLLYPEHADTLFDHVPQPAFVCFDETARILERADVLEKEFREWLSGAMMRGEVLSGTVDA
                          ::  . .  :*:..:*.   ...: .**   *: *  :.   *:.*  **          :  .*  ::  .     :

ref|YP_173587.1|         LDALARLQQAPQPVLYTSLFQKQVPSTKPEQIINLSCKSMQNFHGQMDLLTSEVNRWLSN
ref|NP_240935.1|         HSVLEQMKQGVLPIVYLSLFVRHVPSTNPQNIISFQCKSMQNFHGQMPLLQSEVKRWISS
ref|YP_892975.1|         HSFEEFLHHKKRSFVYLTLFLRHIAHTHPQNIVNVTCKTMQDFHGQMQLLKTEIDRWNEG
ref|NP_976379.1|         HSFEEFLHHKKRSFVYLTLFLRHIAHTHPQNIVNVTCKTMQDFHGQMQLLKTEIDRWNEG
ref|YP_001373418.1|      HSFEEFLRHKKRSFVYLTLFLRHIAHTHPQNIVNVTCKTMQDFHGQMQLLKTEIDRWNEG
RAAC01438                IHYEAKFQELNRPKVHFATFAHTRGSQRYQQVLNISARSMQNFHGQMNVLKQELARWEKA
                                ::.     . :: .: * :       . .:::::..  .::**:****** :*  *:  **  .
```

FIG. 66B

```
ref|YP_173587.1|         DYTVLFIAGTEDRANRLALNLEDEKIDAHLIEAITDLTPSKV--QIYTGHLHTGFELSEQ
ref|NP_240935.1|         QFATVFIAATRERAKRLNHVLAEEGIEALVVDGEAPLTPGQA--QIMVGALTSGFELTLH
ref|YP_892975.1|         HFTTVVLGTDDERVKKLQHILSDYDIDADIVEGTDILLPGRL--QIAVGDLHAGFEMPMQ
ref|NP_976379.1|         HFTTVVLGTDDERVKKLQHILSDYDIEADIVEGTDILLPGRL--QIAVGDLHAGFEMPMQ
ref|YP_001373418.1|      QFTTVILGTDEERAKKLQHILSDYDIEADIIESTDILLPGRL--QIAVGDLHAGFEMPMQ
RAAC01438                HTQVVFAAATKERADHLARVLDDYRIQADQVE---VFTPGSKVPQIVVANLSSGFELPMH
                         .  .:.    :*...:*     *  :  *:*   ::     :  *.    **  .. * :***:. :

ref|YP_173587.1|         KLVVVTEEEVFSKRAKRPKRRQKLSNAERIKSYSELAVGDLVVHTNHGVGKYLGVETLEI
ref|NP_240935.1|         KLVVITEEEIFAKKVKRPQRKQKLSNAERIKNYSELKVGDLVVHTNHGIGKYLGIETLEI
ref|YP_892975.1|         KLVVITEKELFHKKVKKSQRKQKLSNAERIKSYSELKVGDYVVHVNHGIGKFLGIETLEI
ref|NP_976379.1|         KLVVITEKELFHKKVKKSQRKQKLSNAERIKSYSELKVGDYVVHVNHGIGKFLGIETLEI
ref|YP_001373418.1|      KLVVITEKELFHKKVKKSRRKQKLSNAERIKSYSELKVGDYVVHVNHGIGKFLGIETLEI
RAAC01438                RIAVIVETEVFTAKRKHRQTRAQVSDAERIKSYQELNVGDYVVHVNHGIGRYMGIKTLEV
                         ::. *:.*  *:*    : *: :  : ::*:*****.*.**  *** ***.***:::*::***:

ref|YP_173587.1|         NGVHKDYLNLRYAGNDKLYVPVEQIDQVQKYVGTEEKDPKIYALGGSDWKKVKKKVQTSV
ref|NP_240935.1|         NGVHKDYLHIRYAGNDKLYVPVEQIDQVQKYVGAEDKDPKLYSLGKSDWKKVKRRVQSSV
ref|YP_892975.1|         NGVHKDYLNIKYQGNDKLYVPIEQIDQVQKYVGSEGKDPKVYKLGGNDWKKVKTKVEKSV
ref|NP_976379.1|         NGVHKDYLNIKYQGNDKLYVPIEQIDQVQKYVGSEGKDPKVYKLGGNDWKKVKTKVEKSV
ref|YP_001373418.1|      NGVHKDYLNIKYQGNDKLYVPIEQIDQVQKYVGSEGKDPKVYKLGGNDWKKVKTKVEKSV
RAAC01438                DGRRNDYLYLSYAGGDSLYVPVDQIDQIQRYIGSGEKEPKLHSLGSSSEWQKTKNRVKKSV
                         :*  ::***  :    * *.*.****::****:*:*:*:   *:**:: **    .:*:*.*  :*:.**

ref|YP_173587.1|         EDIADDLIKLYAEREASVGHRFSSDGPEQAEFESSFPYQETEDQLRAIKEIKEDMEKQRP
ref|NP_240935.1|         EDIADDLIKLYAEREASKGFAFAPDGPEQAEFEASFPYQETEDQLRAIQEIKEDMEKERP
ref|YP_892975.1|         QDIADDLIKLYAEREASKGYAYTPDTAEQQEFESSFPYQETEDQLRSIEEIKKDMERGRP
ref|NP_976379.1|         QDIADDLIKLYAEREASKGYAYTPDTAEQQEFESSFPYQETEDQLRSIEEIKKDMERGRP
ref|YP_001373418.1|      QDIADDLIKLYAEREASKGYAFTPDTAEQREFESSFPYQETEDQLRSIEEIKKDMERSRP
RAAC01438                RDIAGDLLLKYAKREATPGHAFSPDTPWQADFENMFPYEETPDQLRAIAEIKRDMEKPRP
                         .***.**:****:***:  *. ::.* . * :** ***:** ****:* ***.***:  **

ref|YP_173587.1|         MDRLLCGDVGYGKTEVAIRAAFKAIMDGKQVAILVPTTILAQQHFETISDRFSDFPITVG
ref|NP_240935.1|         MDRLLCGDVGYGKTEVAIRAAFKAIMNGKQVAILVPTTILAQQHFETIQERFADYPINIG
ref|YP_892975.1|         MDRLLCGDVGYGKTEVAIRAAFKAIMDEKQVAILVPTTILAQQHYETIRERFQDYPINIG
ref|NP_976379.1|         MDRLLCGDVGYGKTEVAIRAAFKAIMDEKQVAILVPTTILAQQHYETIRERFQDYPINIG
ref|YP_001373418.1|      MDRLLCGDVGYGKTEVAIRAAFKAIMDEKQVAILVPTTILAQQHYETIRERFQDYPINIG
RAAC01438                MDRLLCGDVGYGKTEVAMRAAFKAVMDGKQVAVLVPTTVLAQQHYETFKERFAGFPVKIE
                         *****************:******:*:  ****:*****:****:**:  :** ..:*:..:

ref|YP_173587.1|         VLSRFRSRKEQTEVLKGLKAGSVDLVVGTHRLLSKDVQFRDLGLLIVDEEQRFGVTHKEK
ref|NP_240935.1|         VLSRFRSRKEQSQTLKGLKAGSVDLVVGTHRLLSKDVQFKDLGLLIVDEEQRFGVTHKEK
ref|YP_892975.1|         LLSRFRTRKQQNETIKGLKDGTVDIVIGTHRILSKDVTYKDLGLLIIDEEQRFGVTHKEK
ref|NP_976379.1|         LLSRFRTRKQQNETIKGLKDGTVDIVIGTHRILSKDVTYKDLGLLIIDEEQRFGVTHKEK
ref|YP_001373418.1|      LLSRFRTRKEQNETIKGLKDGTVDIVIGTHRILSKDVTYKDLGLLIIDEEQRFGVTHKEK
RAAC01438                MLSRFRTRKETQEVLKGLKEGTIDIVIGTHRLLQNSVQFKDLGLLIVDEEQRFGVTHKEK
                         :***::    :****   *:*:*:****:*:*:****.:.  *  :: ****:********* ref|YP_173587.1|         IKRMKANIDVLTLTATPIPRTLHMSMLGVRDLSVIETPPENRFPVQTYVVEFNPAIVREA
ref|NP_240935.1|         IKQLKANIDVLTLTATPIPRTLHMSMLGVRDLSVIETPPENRFPVQTYVVEYNSPLVREA
ref|YP_892975.1|         IKQLKANVDVLTLTATPIPRTLHMSMLGVRDLSVIETPPENRFPVQTYVVEYNPALMREA
ref|NP_976379.1|         IKQLKANVDVLTLTATPIPRTLHMSMLGVRDLSVIETPPENRFPVQTYVVEYNPALMREA
ref|YP_001373418.1|      IKQLKANIDVLTLTATPIPRTLHMSMLGVRDLSVIETPPENRFPVQTYVVEYNPALIREA
RAAC01438                LKQLRANVDCLTLTATPIPRTLHMSMLGVRDLSIIETPPENRFPVQTYVVEYNEGLVKEA
                         :*::::**:* ***************************:******************.*  :::**
```

FIG. 66C

```
ref|YP_173587.1|       IERELSRGGQVYVLYNRVEDIERMTEQISTLVPDARVSYAHGQMNERELESIILDFLEGE
ref|NP_240935.1|       IERELSRGGQVYFLYNRVENIERMANEISMLVPDARVSFAHGQMKESELESIMLAFLEGE
ref|YP_892975.1|       IERELARGGQVYFLYNRVEDIERKADEISMLVPDARVTYAHGKMNESELESVMLSFLEGQ
ref|NP_976379.1|       IERELARGGQVYFLYNRVEDIERKADEISMLVPDARVTYAHGKMNESELESVMLSFLEGQ
ref|YP_001373418.1|    IERELARGGQIYFLYNRVEDIERKADEISMLVPEARVTYAHGKMNESELESVMLSFLEGQ
RAAC01438              IERELARGGQVYFVYNDVQTIHRMAERVQSLVPDARVSVAHGQMAEAELERVMLDFLEGE
                       ****:****:*.:**  *: *.*  ::.:. ***:***: ***:* * ***  ::* ****:

ref|YP_173587.1|       SDVLVTTTIIETGVDIPNVNTLIVCNADKMGLSQLYQIRGRVGRSNRVAYSYFTYQPDKV
ref|NP_240935.1|       SDVLVTTTIIETGVDIPNVNTLIIHGADKMGLSQLYQIRGRVGRSNRVAYAYFTYQRDKV
ref|YP_892975.1|       HDVLVSTTIIETGVDIPNVNTLIVFDADRMGLSQLYQLRGRVGRSNRVAYAYFAYKRDKV
ref|NP_976379.1|       HDVLVSTTIIETGVDIPNVNTLIVFDADRMGLSQLYQLRGRVGRSNRVAYAYFAYKRDKV
ref|YP_001373418.1|    YDVLVSTTIIETGVDIPNVNTLIVYDADRMGLSQLYQLRGRVGRSNRVAYAYFAYKRDKV
RAAC01438              YDVLVTTTIIETGLDIPNVNTLIVYDADKFGLSQLYQLRGRVGRSNRIAYAYFTYQPAKV
                       ****:*******.******:*****:  .**::*******.**********:**:**:*:   **

ref|YP_173587.1|       LTEVAEKRLQAIKEFTELGSGFKIAMRDLTIRGAGNLLGSQQHGFIDSVGFDLYSQMLKE
ref|NP_240935.1|       LSEVAEKRLQAIKEFTELGSGFKIAMRDLAIRGAGNLLGAQQHGFIESVGFDLYSQMLKE
ref|YP_892975.1|       LSEVAEKRLQAIKEFTELGSGFKIAMRDLSIRGAGNLLGAEQHGFIDSVGFDLYSQMLKD
ref|NP_976379.1|       LSEVAEKRLQAIKEFTELGSGFKIAMRDLSIRGAGNLLGAEQHGFIDSVGFDLYSQMLKD
ref|YP_001373418.1|    LSEVAEKRLQAIKEFTELGSGFKIAMRDLSIRGAGNLLGAEQHGFIDSVGFDLYSQMLKD
RAAC01438              LSEVAEKRLAAIKEFTELGSGFKIAMRDLSIRGAGNLLGAEQHGFINSVGFDMYTELLQQ
                       *:******* **************.*********:.*****:.*****:*:::*::

ref|YP_173587.1|       AIEERKGEKPKEPPFKAELNVNIDAYIPERYIPDAKQKIEMYKRFKGVETLEEIADLQDE
ref|NP_240935.1|       AIEKRKGEQPKEEPRNVEIDVQVDAYIPDSYIQDAKQKIEMYKRFRGVETIEEINDLKDE
ref|YP_892975.1|       AIEQRRGTDGVENTVNVEIDLEVDAYLPDAYISDSKQKIMMYKQFRGVSAIEDIEELQEE
ref|NP_976379.1|       AIEQRRGTDGVENTVNVEIDLEVDAYLPDAYISDSKQKIMMYKQFRGVSAIEDIEELQEE
ref|YP_001373418.1|    AIEQRKGKQGIENTIDVEIDLEVDAYLPDSYISDSKQKIMMYKQFRGVSTLEDIEELQEE
RAAC01438              AIRELRGEQ-LEKPVEPTIDVPVEAYIPDTYISDPSQKVAMYKRFRAIQAVSEADDLEDE
                       **.: :*  . *  . .  ::: ::**:*: ** *..: *:*:.:..::.: :*::* ref|YP_173587.1|       LVDRFGEYPKQVAYLFEMTKIKLIADQEKVEKI-TEGKDAVTILLTEETTNRIHVATLVD
ref|NP_240935.1|       MFDRFGEYPQEVSDLLQLTTTIKIIAYQEGVESI-VESKGQWIILLSPETTEGIDGAKLFE
ref|YP_892975.1|       MIDRFGDYPQEVGYLLQIANIKVLAMKEQIELI-KQNKFEVTILFSEQASQNIDGGKLFM
ref|NP_976379.1|       MIDRFGDYPQEVGYLLQIANIKVLAMKEQIELI-KQNKFEVTILFSEQASQNIDGGKLFM
ref|YP_001373418.1|    MIDRFGDYPQEVGYLLQIANIKVLAMKEQIELI-KQTKSEVTFLFSEQASQNIDGGKLFM
RAAC01438              LIDRYGDPPQEVRNLLDVTRLKSLAMQAHADHIATQGAD-TTVRFPNEKHAPVDYPKLLS
                       :.**:*: *::*  *::::  :* :*    : * :      . :.:    :.  .*.

ref|YP_173587.1|       AAQKIGRDVSIGSQGNQIKLVIKTKQLSDETLLAYIIELLEALIRADKSKK--------
ref|NP_240935.1|       VIHKLDQQVGLGTEGERIKLTLKTKQLGTNQLLEVTETLLASLAD--------------
ref|YP_892975.1|       LGNSFGRMIGLGMEGSQLKIVMKTNGL---------------------------------
ref|NP_976379.1|       LGNSFGRMIGLGMEGSQLKIVMKTNGL---------------------------------
ref|YP_001373418.1|    LGNK--------------------------------------------------------
RAAC01438              MAVKHKAQVTSRPNG-MIFVAFRTKGLAGDEIVRRIIAFLTDYLEMVRQSKKQEEVAGV
                       .
```

FIG. 67

```
ref|YP_117520.1|        ----------------VIAASLRRERTRAGLSLSEVAARAGIAKSTLSQLESGSGNPSL
ref|YP_707186.1|        ----------------IGPSLRRERERSGMSLTEVARRAGVAKSTLSQLESGGGNPSV
ref|YP_046943.1|        ---------------IEIVAKGLHRERQKAGLSLAELARRAGIAKSTLSQLEAAQGNPSL
ref|YP_001337847.1|     ---------------ISVIAKSLVRERARTGLSLAEVARRAGIAKSTLSQLESGNGNPSL
ref|YP_001105447.1|     ----------------MLAANLRALRERAGLSLSEVARRSGIAKGTLSQLESGAGNPTI
RAAC03184               MILFDISNILIHMNIMKIVSNNLRALRLARGWSISELERRSGVAKGTISQLESGYGNPTV
                                        :. .*    *    * *::*:   *:*:**.*:****:. ***::

ref|YP_117520.1|        ETLWALCVALDMPFSRLLD-----PPRPVVHVIRAGEGPAVAAERS-DYHATLLAAGPSN
ref|YP_707186.1|        ETLWALCVALDVQMSQLLD-----PPRPRVQVIRADEGPELTSDRS-DYRATLVASSPPS
ref|YP_046943.1|        ETLWSLCVALEIPFAKLME-----SNIPQTQVIRFGEGPSVASEIA-HYQAILLANCPTG
ref|YP_001337847.1|     ETLWSLCVALDIPFARLLE-----PQVNKTQVIRRGEGTKVVAEQA-NYQAILLAACPPG
ref|YP_001105447.1|     ETVFSLSNALSVPVSSLLT-----ERLDPEVVLVRSRGLEVLSSNAVDLRMLRRMDLTET
RAAC03184               ATLWSLASALSVPFSDLIQ-----TAKETESVHESP----VLAEFSGTTRFVDRVTM-EG
                        *:::*. **.:  .: *:          *                :  :. :    :

ref|YP_117520.1|        TRR----------DLFRITAE----------PGQPRESQPHIPGVIEHILLAAGRALV
ref|YP_707186.1|        ARR----------DLYRLAVE----------PGPARESEPHMPGVVEHVILSAGRALV
ref|YP_046943.1|        ARR----------DVYILNTQ----------PGEPRLSHPHPIGSIEHIIIMKGCAKV
ref|YP_001337847.1|     ARR----------DIYLLLTQ----------PGADRISHPHPPGSVEHIIVTQGRARV
ref|YP_001105447.1|     VFE----------LYDQRVR----------PGEVQRSEGHP--GREHVVVTSGVLRV
RAAC03184               MIE----------IYEMVLS----------KDDERVSEAHPLGIMEHILVVQGRMEV
                         .              ::                . : *. *     **:::  *   * ref|YP_117520.1|        GPTGEPVELAPGDYIAYPGDAPHVFEALEPGTWATLVIEY--------------
ref|YP_707186.1|        GVAGDPVELGPGDYIAYPGDAHVFEALEAGTRAVL------------------
ref|YP_046943.1|        GLTAEPVVLNEGDYICYPADQEHIFEALDEDTRAIL------------------
ref|YP_001337847.1|     GLTSAPEELGEGDYICYPADQEHVFQALEPDTQALL------------------
ref|YP_001105447.1|     GPPDSPFELEAGDYVCFPARQPHIYETVGGPVVSVLLLEYPA------------
RAAC03184               GPIGQEIALNPGSYTTFPGYVRHVYRSLDEEARAVLWLVYPSIRAGHEGEGATL
                        *          *  *.*    :*.    *::.::      . : *
```

FIG. 68

```
ref|NP_391246.1|              ---------- -----SFGEQ LRALREERKL TVNQLATYSG VSAAGISRIE NGKRGVPKPA
ref|NP_391246.1|              ---------- ---------Q LRALREERKL TVNQLATYSG VSAAGISRIE NGKRGVPKPA
ref|YP_001488252.1|           ---------- ----MKFGAY LRALREEKKL SVNQLAMYSE VSAAGISRIE NGKRGIPKPP
ref|NP_244416.1|              ---------- -MEGKQFGSF IRALRKKKGF TVNQLALYSG VSSAQISRIE NGLRGVPKPE
ref|YP_001488252.1|           ---------- ---------- LRALREEKKL SVNQLAMYSE VSAAGISRIE NGKRGIPKPP
RAAC02740                     MYNSDVRGGE SMDTLNFGEY LRSLRLARKL SINQLAEKTG ISAAHISRLE RNVREVPRPD
Clustal Consensus                                    :*:   :  : ::**   :   :*:* ***:* .. * :*:* ref|NP_391246.1|              TIKKLAEALK IPYEGLMYKA GYIEEVHEA- ---------R APYETKCKLL EKAEAYDLKN
ref|NP_391246.1|              TIKKLAEALK I--------- ---------- ---------- ---------- ----------
ref|YP_001488252.1|           TIKKLASALK VPYEDMMQAA GYIEE----- ---------- ---------- ----------
ref|NP_244416.1|              TIKKLSEALG HPYEDLMQAA GYIDDNTKT- ---------D LP-----ALT ERDER-----
ref|YP_001488252.1|           TIKKLASALK V--------- ---------- ---------- ---------- ----------
RAAC02740                     TLRKLALGLG VPFDELLRAA GYSEEQYEYN TKVLSRRLQR LRESKGLSLS DVAHIAGISE
Clustal Consensus             *::**: .* ref|NP_391246.1|              LAL------- ---------- ---------- ---------- ---------- ----------
ref|NP_391246.1|              ---------- ---------- ---------- ---------- ---------- ----------
ref|YP_001488252.1|           ---------- ---------- ---------- ---------- ---------- ----------
ref|NP_244416.1|              ---------- ---------- ---------- ---------- ---------- ----------
ref|YP_001488252.1|           ---------- ---------- ---------- ---------- ---------- ----------
RAAC02740                     AYLARLESAE GRLPGVTTLH RLAQVFDVTP AYLVGDTPDP KDNGPLDAWY QPKDLIQWLE
Clustal Consensus ref|NP_391246.1|              ---------- ---------- ---------- -------
ref|NP_391246.1|              ---------- ---------- ---------- -------
ref|YP_001488252.1|           ---------- ---------- ---------- -------
ref|NP_244416.1|              ---------- ---------- ---------- -------
ref|YP_001488252.1|           ---------- ---------- ---------- -------
RAAC02740                     ESEVMFEGQP LTDEDKLKIK QILAVVFMDA KRKNQRP
Clustal Consensus
```

FIG. 69

```
ref|YP_075413.1|         --EEIGRRLK AARLAKGLTL EQVEEETRIR KKYLDALESG RTVLIPGEVY VKGFLRSYGN
ref|YP_001662816.1|      --KELGEFLK SERIKMGLTL EEIQEITKIR IRYLKAIEDG DFSVMPALVY AKGFVKSYAE
ref|YP_001662816.1|      PQQNQSEAST ISEDKTNLPQ ESNVSQLTVK TSIEKVAETS KKIEYKVVPF G----ESYKV
ref|YP_001664674.1|      --KELGEFLK SERIKMGLTL EEIQEITKIR IRYLKAIEDG DFSVMPALVY AKGFVKSYAE
ref|YP_001664674.1|      PQQNQSEAST ISEDKTNLPQ ESNVSQPIVK TSIEKVAETS KKIEYKVVPF G----ESYKV
RAAC02937                MHEQLGQILR ARRESLGLTV EDIEERTKIR KRYIEALESG QWDVLPGRVY ARGFVRSYAE
Clustal Consensus                    ::  ..       .  .*.  *. .   ::    .. * .              .**

ref|YP_075413.1|         FLGLDGEGLV EEYKALKARP AAEDGAGNGG PAEAPAREPE AAIAASAPRA -SAEPRQPAF
ref|YP_001662816.1|      ALGLDGNELV KKY------- ---------- ---------- ---------- ----------
ref|YP_001662816.1|      EISVPGEKCW FSVKVDGN-- ---------- ---------- ---------- ----------
ref|YP_001664674.1|      ALGLDGNELV KKY------- ---------- ---------- ---------- ----------
ref|YP_001664674.1|      EISVPGEKCW FSVKVDGN-- ---------- ---------- ---------- ----------
RAAC02937                VLGLDGSELL EKYVDGGDAG SAEP----GV RAESPALTSE NRAADRKPAA RMVEPRSLN-
Clustal Consensus        :.: *.       .

ref|YP_075413.1|         ATPPRRSSRS RPKRRRNGPG PGVYFLRRLM VALILILPLA AAGWWFWGRQ AAAPPPQEPG
ref|YP_001662816.1|      ---------- ---------- ---------- ---------- ---------- ----------
ref|YP_001662816.1|      ---------- ---------- ---------- ---------- ---------- ----------
ref|YP_001664674.1|      ---------- ---------- ---------- ---------- ---------- ----------
ref|YP_001664674.1|      ---------- ---------- ---------- ---------- ---------- ----------
RAAC02937                ---EMERTRS RAHERHERSR RETYDRPVRS VGSWVGQGLL IVGALVVVGG LYVLLHHHHG ref|YP_075413.1|         QVAQEPGTTA QQPEPEPEPE PEPEPEPEQP PASGQPVPAK PVITVGAPQG DEVD--ITIT
ref|YP_001662816.1|      ---------- ---------- ---------- ---------- ---------- ----------
ref|YP_001662816.1|      --VVYEGLMT KDMSKIFDVK DSITILMGYP PAVKITVDGE ELPTVQTPSP VTI-------
ref|YP_001664674.1|      ---------- ---------- ---------- ---------- ---------- ----------
ref|YP_001664674.1|      --VVYEGLMT KDMSKIFDVK DSITILMGYP PAVKITVDGE ELPTVHTPSP VTI-------
RAAC02937                QATHRTNTTT SSPQKTQATK P-ATHQTAPP KRTTQPIQKA QTVVVALPYA NGMYTYKVLH ref|YP_075413.1|         ASEVQLEMDF TQGFPWLEVY SGGETLY--- WSKASGPLSF TGKD-FRIRI GFVAGFQLAL
ref|YP_001662816.1|      ---------- ---------- ---------- ---------- ---------- ----------
ref|YP_001662816.1|      ---------- ---------- ---------- ---------- ---------- ----------
ref|YP_001664674.1|      ---------- ---------- ---------- ---------- ---------- ----------
ref|YP_001664674.1|      ---------- ---------- ---------- ---------- ---------- ----------
RAAC02937                AASLQVVVTV NSGELWFSAT ADGQAVAPNV ILNQGQSKSF SAQNNVTFHL GHVQGVSITV ref|YP_075413.1|         NGEPV----- ---------- -
ref|YP_001662816.1|      ---------- ---------- -
ref|YP_001662816.1|      ---------- ---------- -
ref|YP_001664674.1|      ---------- ---------- -
ref|YP_001664674.1|      ---------- ---------- -
RAAC02937                DGQPVQLPNI TWAPVVVIER G
Clustal Consensus
```

FIG. 70

```
ref|YP_034761.1|        ----LSKLIKKLLKERALSMRQLGMLTNIDPATISRIMNGKQPPKQKHLQKFAECLQVPP
ref|ZP_00237972.1|      --------------------QLGMLTNIDPATISRIMNGKQPPKQKHLQKFAECLQVPP
ref|YP_893335.1|        --------------------QLGMLTNIDPATISRIMNGKQPPKQKHLQKFAECLQVPP
ref|YP_001373772.1|     --------------------QLGTLTNIDPSTISRIISGKQQAKQKHLQKFAECLKVPP
ref|ZP_02329595.1|      ----LGSTIKALLKERSLSMRKLSALTGIDTATISRIVNGKQAAKPDHLKVFALHLGVPV
RAAC00675               MMGHLEETVKSLLRRRSMSMRQLATATGISVSTISKMIAGKQRVNLDYLRRIADALGVPP
                            :*.     *.*. :*::: *   :  .:*:  :*   *  ** ref|YP_034761.1|        QLLFDE--MYPDSPHINKEKT-----DMYTSLDTIQQTLQSSNLFDFDYTTTRVKQELEN
ref|ZP_00237972.1|      QLLFDE--MYPDSPHINKEKT-----DMYTSLDTIQQTLQSSNLFDFDYTTTRVKQELEN
ref|YP_893335.1|        QLLFDE--MYPDSPHINKEKT-----DMYTSLDTIQQTLQSSNLFDFDYTTTRVKQELEN
ref|YP_001373772.1|     QLLYGA--LHSASSPIKKEKI-----DMYNSIDTIQDTLQSSNLFDYDYTTIRVKQELEN
ref|ZP_02329595.1|      ERLFQA-----AGYDVGTNKTS-TEIGIHTSINRIKEVLQSSNFFDYELTTELVQKELFK
RAAC00675               LTLAEA-----AGLPLIKEPIGPTDGDRQTSMNALLEYLGLGNLN---VLRTEIERELEK
                         *       .  . .:      .  .*:: : : *  .*:   ---  :::** :

ref|YP_034761.1|        YERYAQTTEGEKRIHESFASKLEQIDSAGPFIEQLTDMYQQFCNETIPKEERAVLGGALL
ref|ZP_00237972.1|      YERYAQTTEGEKRIHESFASKLEQIDSAGPFIEQLTDMYQQFCNETIPKEERAVLGGALL
ref|YP_893335.1|        YERYAQTTEGEKRIHESFASKLEQIDSAGPFIEQLTDMYQQFCNETIPKEERAVLGGALL
ref|YP_001373772.1|     YERYAQTTEGQMRIHESFSTKLKQIDSTGPFIEQLTEMYQQFCKDTISETERAVIGSALL
ref|ZP_02329595.1|      YEQYALTEEGQRVIHNEFSSKVEKVNGSGPFIDELRQMHELFCSREVSQDTRAIAGSALL
RAAC00675               YEAYAQTEEGRQFIAEKYLAKRGQIQGIGDFLRDLDDIYDRFSRPDTPEDERRILASGIL
                          * **.  *  .: :*  ::: . * *:  :*  ::::  *.    .:  * : ...:* ref|YP_034761.1|        YFILSTDIIPDYLFPIGYLDDAIAVELAKEKL--------------
ref|ZP_00237972.1|      YFILSTDIIPDYLFPIGYLDDAIAVELAKEKL--------------
ref|YP_893335.1|        YFILSTDIIPDYLFPIGYLDDAIAVELAKEKL--------------
ref|YP_001373772.1|     YFVLSTDIIPDYIFPIGYLDDAIAVELVKEKLAHFRK---------
ref|ZP_02329595.1|      YFILSADIIPDYVFPIGYLDDAIAVQMVRNRLS-------------
RAAC00675               YFLLATDAIPDYLFPAGYLDDAIAMQMVRERLARRREMKDQGAEGS
                        **:*::* ****:** *******:::.::::*
```

FIG. 71

```
gb|AAB91591.1|        MSPFGQQLRELRRARKLTVNQLAVYSGISSATISKIENGKRGTPKPATIKKLAAVLKVPY
ref|NP_391247.1|      MSPFGQQLRELRRARKLTVNQLAVYSGISSATISKIENGKRGTPKPATIKKLAAVLKVPY
ref|YP_001422657.1|   MNTFGKQLRELRRARKLTVNQLAVYSGVSSATISRIENGHRGIPKPATIRKLADTLKIPY
ref|YP_093160.1|      MTNFGHHLRQLRERKKLTVNQLAMYSGVSSAGISRIENGKRGVPKPATIRKLADALKVPY
ref|NP_391246.1|      MESFGEQLRALREERKLTVNQLATYSGVSAAGISRIENGKRGVPKPATIKKLAEALKIPY
RAAC02292             MSQFGQYLRKLRKERNLTINQLALYSGVSSALISRIENGQRGRPKPDTLKKLASALKVPY
                      *  **. ** **.  ::**:****  ***:*:* **:****:** *** *::*** .**:**

gb|AAB91591.1|        ENLMAAAGHIRAFPEEIREASES---------------------------------
ref|NP_391247.1|      ENLMAAAGHIQAFPEEIREASE----------------------------------
ref|YP_001422657.1|   EELMARAGHIKAFQEEIRETSES---------------------------------
ref|YP_093160.1|      EELMASAGYISAS--TVQEARS----------------------------------
ref|NP_391246.1|      EGLMYKAGYIEE--------------------------------------------
RAAC02292             EDLLLHAGVLNEQISRTSESRDLKPVDPSWYKRQVPIPVLGSIRAGTPVEMLALNSSEFV
                      * *:   **  :

gb|AAB91591.1|        ------------------------------------------------------------
ref|NP_391247.1|      ------------------------------------------------------------
ref|YP_001422657.1|   ------------------------------------------------------------
ref|YP_093160.1|      ------------------------------------------------------------
ref|NP_391246.1|      ------------------------------------------------------------
RAAC02292             LVDSDLLGNHEGFALEVVGDSMIGDYIFPGDLVIVKYTSNFSPQDICVVAINGEEATLKR gb|AAB91591.1|        -------------------------------------------
ref|NP_391247.1|      -------------------------------------------
ref|YP_001422657.1|   -------------------------------------------
ref|YP_093160.1|      -------------------------------------------
ref|NP_391246.1|      -------------------------------------------
RAAC02292             VKCQGDICILTPSNPSMEPMVYNSVDVHVIGVVVEVRRRLRNK
```

FIG. 72

```
ref|NP_845841.1|         ---------------------------MYIPKYFAIQDEKMKYEIMEQNSFATLFSQH
ref|ZP_02260616.1|       ---------------------------MYIPKYFAIQDEKMKYEIMEQNSFATLFSQH
ref|ZP_02256143.1|       ---------------------------MYIPKYFAIQDEEMKYEIMEQNSFATLFSQH
ref|ZP_00235680.1|       ---------------------------MYIPKYFAIQDEEVKYEIIEQNSFAILFSQH
ref|NP_241278.1|         ---------------------------MYIPKAFHVDDVNELITFIRNHSFGIMVSQT
RAAC01655                ---------------------------MYIPRSFELKDAQLIETVLREHSFAVLVTSV
                                                    ****: * :.* :   .:.::**. :.:.

ref|NP_845841.1|         NGEPYATHLPLLLNR---ETLTLHGHFARPNEQWKDIGTQQVLAIFQGPHSYISPSWYET
ref|ZP_02260616.1|       NGEPYATHLPLLLNR---ETLTLHGHFARPNEQWKDIGTQQVLAIFQGPHSYISPSWYET
ref|ZP_02256143.1|       NGEPYATHLPLLLNR---ETLTLHGHFARPNEQWKDIGNQQVLAIFQGPHSYISPSWYET
ref|ZP_00235680.1|       NEESYATHLPLLLNR---ETLTLHGHFARPNDQWKDSGNQQVLAIFQGPHSYISPSWYET
ref|NP_241278.1|         EEEPFATHLPFLLDEQKGENGVLISHLARANPHWQGLQDQKVLVVFQGPHAYISPTWYDE
RAAC01655                GEDIMATHVPLVYDP---AEAALFGHLARANPQAKHLHEAQCLAVFQGPHAYVSPAWYGL
                          : ***:*:: :       .* .*:**.* : :    : *.:*****:*:**:**

ref|NP_845841.1|         KNAVPTWNYVAVHVYGELELVEDEQELIDSLQDLVDTYEDPQSTYSLNDVDPNYMEGLSK
ref|ZP_02260616.1|       KNAVPTWNYVAVHVYGELELVEDEQELIDSLQDLVDTYEDPQSTYSLNDVDPNYMEGLSK
ref|ZP_02256143.1|       NNAVPTWNYVAVHVYGELKFVEDEQELIDSLQELVHKYEDPESAYSLNDVDPNYMGGLSK
ref|ZP_00235680.1|       NNAVPTWNYVAVHVYGELEIVEDEQELIDSLQKLVYKYEDPKSTYSLNDVDPNYMTGLSK
ref|NP_241278.1|         PRTVPTWNYVAVHVYGTFRQIQDKHKVKEWIEKTVNVYEQTMNPPWEAVFDEPFMEGLLN
RAAC01655                ADQVPTWNYIAVHVYGRARVIEDEEAVADLLQRLLLTYDP--QSPLPADRDRPYYRNLMR
                           ******:****** . ::*:. : : ::  :  *:  ..     *  :  .* .

ref|NP_845841.1|         GIVGFKIKISKIEGKAKLSQNHSVARRKLVVEELEKVGSEGSRGIAELMRK---------
ref|ZP_02260616.1|       GIVGFKIKISKIEGKAKLSQNHSVARRKLVVEELEKVGSEGSRGIVELMRK---------
ref|ZP_02256143.1|       GIVGFKVKINKIEGKAKLSQNHSVERRNLVVEKLEKVGSEGSKGIAELMKETK-------
ref|ZP_00235680.1|       GIVGFKIKINKIEGKAKLSQNHSVERRKLVVEKLEKVGSEGSREIAELMR----------
ref|NP_241278.1|         GIVAFEIEVERMEGNWKLNQNHPIERQERVVKKLKSINEPNAQKMAELMEK---------
RAAC01655                GIVAFRIDIARIKAAAKLSQNKPLEVRARVVEALESQDDANSRAVAAWMRRLKLTHLGDD
                         ***.*.: .: :::. **.**:.:   **: *:. .. .:: :.  *.

ref|NP_845841.1|         -----------
ref|ZP_02260616.1|       -----------
ref|ZP_02256143.1|       -----------
ref|ZP_00235680.1|       -----------
ref|NP_241278.1|         -----------
RAAC01655                DGNESKPKGAS
```

FIG. 73

```
ref|ZP_02329455.1|        ---NVSEIIEHYLKHILQQSPNGAIEIQRNELADQFQCVPSQINYVISTRFTLEKGYLVE
RAAC00436                 MASNISDIIEAYLKRLMEESGLDVIEIQRNELAEQFHCVPSQINYVISTRFTTDHGYIVE
ref|YP_077369.1|          MGKNISDIIEQYLKQILEQNGKEILEIKRSEIADKFQCVPSQINYVINTRFTSERGYIVE
ref|YP_001419762.1|       MGHNISDIIEQYLKQVLDQNGKEILEIKRSEIADKFQCVPSQINYVINTRFTSERGYIVE
ref|YP_001485328.1|       MAQNISDIIEQYLKEVLDQNGREILEIKRNEIADKFQCVPSQINYVINTRFTSERGYIVE
ref|ZP_02171828.1|        ---NISDVIEGYLKQIIEKNDQELIEVKRSELAEQFDCVPSQINYVIRTRFTVEKGYMVQ
                             *:*::** ***.::::.     :*::*.*:*::*.********** **** ::**:*:

ref|ZP_02329455.1|        SKRGGGGYVRIQKIELNSHGSILDYILTTINQSIDQSTSEGLIYRLEEGEFLTAREAKLI
RAAC00436                 SKRGGGGYIRIRRVKLDKDHLLWD-VLRSLGDEVSQSASEALIERLHRDGWLTDREAALI
ref|YP_077369.1|          SKRGGGGYIRIIKIKMNDKIDLINNIMNQIYTRLSQAASDDIILRLLENGVITESEAKLM
ref|YP_001419762.1|       SKRGGGGYIRIIKIKMNNEVVLINNIISQIHTHLSQAASDDIILRLLEDGVISEREAKMM
ref|YP_001485328.1|       SKRGGGGYIRIIKVKMNDEVDLLNNIISQIYHRLSQAASDHIIMRLVENNILSEREAKMM
ref|ZP_02171828.1|        SKRGGGGYIRITRVTPDNHLQLYDQLIDLSGDEISQTAAMHLIGRLLEEEAITKREANLM
                          ********:** ::  :..  : : ::       :.*:::  :* ** .   ::  ** ::

ref|ZP_02329455.1|        RAAISRDVLQFKLP----------------------
RAAC00436                 SAMLRREVLALGLPYRDRLRAKLLASALQALAAHRKP
ref|YP_077369.1|          VSVMDRSVLYIDLP----------------------
ref|YP_001419762.1|       VSVMDRSVLYIDLP----------------------
ref|YP_001485328.1|       ISVMDRSVLHIDLP----------------------
ref|ZP_02171828.1|        ESVMNREVLSIRLPY---------------------
                           : : *.** : **
```

FIG. 74

```
ref|YP_001485324.1|      -DVWGRRIRAYRKLKGYTQEGFAKRLGISVSVLGEIERGNRLPTNQLVGQIADALNITVE
ref|YP_077366.1|         -EIWGRRIRAYRKLKGYTQEGFAKALGISVSVLGEVERGNRMPTESMLRDVANTLNITVE
ref|NP_829977.1|         -EKWGRRIRAFRKLKGYTQEGFAKELGVSVSVLGEVERGNRSPSQDFVVEVAKALNVSIE
ref|YP_001124204.1|      -ERWGRRIRAFRKLKGYTQERLAKELGVSVSILGEIERGNRMPSDSLVEQIAELLNISVE
ref|YP_145925.1|         -ERWGRRIRAFRKLKGYTQERLAKELGISVSILGEIERGNRMPSDSLVGQIAERLNISVE
RAAC01464                MDAFGRRLRAFRKLKHMTQADLARALGVSLATIGGIERGTRQPTAHLVSAIASALSVDVE
                          : :*::**       :*: **:*:: :* :***.* *:   ::   :*. *.: :* ref|YP_001485324.1|      EL----------------------------------------
ref|YP_077366.1|         EL----------------------------------------
ref|NP_829977.1|         EL----------------------------------------
ref|YP_001124204.1|      ELTPP-------------------------------------
ref|YP_145925.1|         ELAPP-------------------------------------
RAAC01464                ELCGPTWPGDGWDRGAAEDAADSRAGHGHATVDGPHSPLDQGAMVR
                         **
```

FIG. 75

```
ref|ZP_01440002.1|        -----DRSEEVAA-ILSLIANPARLRILCLLAEGEMQVGALAERVGLSQSALSQHLAKLR
ref|ZP_01419169.1|        --------DDACA-LLKALANPHRLMIVCALIDGEQSVGALAHLLGVRETLASQHLGLLR
RAAC00579                 MTHGPDMPEDVCMRCLAVLGEPQRLRILRALAEGEQTAGALSERLGVRQNTLSHHMRQLR
ref|YP_001623237.1|       ---------------LEAIAEPTRRRILDAIRTGERSVGDLVEIVGMHQPGISRHLKVLR
ref|NP_896891.1|          ---------------LKALADPTRLDVIHALAEGERCVCDLTADLGITQSRLSFHLRVLR
ref|ZP_01084741.1|        ---------DQARALLKALGDPVRLRVIEALGGGERCVCDLVTDLGLAQSKLSFHLKVLK
                                     *  :.:*  *  ::   :  **   .  *   :*: :    * *:   *:

ref|ZP_01440002.1|        AGGAVETRR---DRQTIYYRL---------------------------------
ref|ZP_01419169.1|        RDGVVAARR---DGQTIYYGLRGGQARALV----ETLS-----------------
RAAC00579                 EHGLVEVRRHPHDERFTFYRLNGRRLRALS----AVLTDWAARADAECETSGRWSS
ref|YP_001623237.1|       DSGLVEVRQ---DAQRRLYRLRAEPLKELD----QWLEPYRLEWAGRLDA------
ref|NP_896891.1|          DCGLLTDR---HSGRWTYYRLQPDALSALE----DWLAALRQHCSRS---------
ref|ZP_01084741.1|        QAGLLADRQ---EGRWIYYRLRPETLGALQ----AWLTDLGAHCGA----------
                              *  :   *      . :    * *
```

FIG. 76

```
ref|YP_954024.1|         -----VPAERLAATFKALADPARVKLLSLIAA------------ARDGE--------ACI
ref|ZP_00050136.2|       ---------ELARTFKALADPTRVQLLAIVAAQ------------EGHE--------ACV
ref|YP_001156989.1|      --------ERLAGVLKALADPARLRLLSLIQS------------APEGE--------ACV
ref|YP_001360254.1|      ---------------LKALADPARLRLLSLVA------------AHEGGE--------ACV
RAAC03156                MMVIDVTNEEVLTCLHALADKSRFQILQMMAKG---SIATCCDRIEAYEN------GCCV
ref|YP_591607.1|         --------------LRAVADPTRRRILRMLGEK---------GHCSIGE-----STGLCA
                                        ::*:**  :*  ::* ::           *       * ref|YP_954024.1|         CDLTAPLGLSQPTVSHHMKLLVDAGLVSRQQRGKW-AYY---RIQRDALDRVAQDVAALT
ref|ZP_00050136.2|       CDLTGPVGLSQPTVSHHLKILVDAGLLTREQRGRW-AYY---SLVPGALARVAG---SLT
ref|YP_001156989.1|      CDLTAPLGLSQPTVSHHLRILTEAGLLEREKRGVW-AYY---RLVPTAIATIAD---LLT
ref|YP_001360254.1|      CDLTEPLGLSQPTVSHHLKVLVEAGLLTRDKRGVW-AYF---AVVPETLNALAA--VLVT
RAAC03156                ADVVAVTGLSQPTVSHHLKVLEKAGLVRRESRGPWTCYFPNSQALEEVVKALTSELMMPA
ref|YP_591607.1|         RDIEAKIKLSQPTVSHHMKILADAGLITGQRRGQW-TWY---RRDETAVRQMTKKFREEL
                          *:      ********:::* .***:   : ** *  ::          .:  ::

ref|YP_954024.1|         S------------------------
ref|ZP_00050136.2|       -------------------------
ref|YP_001156989.1|      -------------------------
ref|YP_001360254.1|      PA-----------------------
RAAC03156                NVHNHEKGECCPCPDGSPMSPSTCET
ref|YP_591607.1|         -------------------------
```

FIG. 77

```
ref|YP_001309477.1|      ---------------------------MIHITNLKESLPLFKALSSDVRMNILEILSQYK
ref|YP_001180339.1|      ---------------------------IDNLKEAKILFEALASDARLEIINLLSKHR
RAAC00603                MSPCRPLSESSGLFYTHVKIMAGVGDRVIHIKELRSGLPLFKALGSEVRVALLELLLEHG
ref|NP_242735.1|         -------------------------------------LPVYEALASKVRLAIIQQLTRKS
ref|YP_173905.1|         ----------------------------------KQSLPVYEALASRIRLNVLQLLAERS
ref|ZP_00603386.1|       -------------------------------------LPVYEALASKTRIKIIQLLSKK-
                                                              :::**.*  *: ::: * .

ref|YP_001309477.1|      QLNMNELSEKLDLTNGAVTMHIKKLEECGLIKTTNLTGKHGLQKICSLHEDKFVIDI--G
ref|YP_001180339.1|      EMNMNEIAQKLGLTNGAVTQHMKKLIAAGIVTISAASGKHGNQKICRLVEDKIIINI--V
RAAC00603                RLNMDEIAKRLGITNGAVTQHVRKLEECGLVVTETAGARHGLQKFCYVNEQKILVEL--A
ref|NP_242735.1|         -MNIRELAEAVGLSSAIMTMHIKKLEKAGIIRTEMVPGKAGIQKLCILDTDHIEINFPPK
ref|YP_173905.1|         -MNIKELAESQQVSSAIMTKHVQKLEKAGLIDTTHVRGKAGVQKMCSLRVRHAQIAFPNK
ref|ZP_00603386.1|       KMNVKDLAKELGVSSAITTMHVKKLEEANIIKTEKVGQ----QKISSLRVDKIDISFPEK
                          :*: ::::    ::..  * *::**  ..::        **:.  :    :  :  :

ref|YP_001309477.1|      KQDVENS-YHIDLNIGHYSNYDITPTCGIATKDSIIGEVDNPNYFADPERINADILWFTK
ref|YP_001180339.1|      TK-HPQKLYECEIKVGNYSIFEVYPTCGLATKDKLIGEVDDPKYFAHPEHVNCDIIWFTK
RAAC00603                PETKDQDVYEVDIRVGHYVSFEVWPTCGLATAETIIGTFDDPRYFADPQHIDAEIVWLTK
ref|NP_242735.1|         KE-SLKLYHQTILSVGHYTDFLVEPTCGLATAEKIIGEFDEPRYFLDPERVNAKILWFSK
ref|YP_173905.1|         ENGPTRAFHESHVSVGHFTDFYVEPTCGLATPETIVGEFDEPRYFLDPMRVNARILWFYK
ref|ZP_00603386.1|       IFNAFDT-KETSIPIGHYTNYAIEPTCGLATIHDFIGKVDEPRYFMDPRRMDARILWFTS
                            .  :  :*::    : :  ****:**   .:*  .*:*.**  .*  :::  *:*:  .

ref|YP_001309477.1|      GSIEYRIPNYLKPSEVFSELQISMEISSEAPGVCSIWPSDIHFYLNNVNVGRWTSPGDFG
ref|YP_001180339.1|      GYVEYIIPNFLRQNQKAVEIQISFEISSEAPGVSENWPSDIYFYLNGVELGYWTSPGDFG
RAAC00603                GYLEYWIPNFIRTDRPVEEIQIIAELASEAPSYNNDYPSDIHFSINGVDIGYWTSPGDFG
ref|NP_242735.1|         GYIEYKIPNFLHHSENPKELEISLELSSEAPFTNDNWPSDISFYFNNVKIGIWTSPGDFG
ref|YP_173905.1|         GFVEYKLSNFIHGGETPKELEISMELSSEAPFTNDNWPSDVSFTFNGVSLGYWRSPGDFG
ref|ZP_00603386.1|       GFVEYQAPNFLNTEDTLEMEVSVEISSEFPFSNDNWPSDITFSLNGVELGTWTSPGDFA
                         * :**  .*:.      :::  *::**  *  . :*** : *.*.:*  * *****.

ref|YP_001309477.1|      -DSKGILTPSWWNPHWNQYGLLKLLTINSFGTFIDGIKISDVTLEDLELTYKSDILLKLA
ref|YP_001180339.1|      GETKGIFTPDWWFPNWNQYGLLKLLSVSEDGTYIDGFKISNVTIKDIDIESKNEIRFRVA
RAAC00603                -DERGRQNPSWWPPHLNQYGHLKLVRVNHEGTFIDGCKISDVTIEDLQPFQGHAIPLRFS
ref|NP_242735.1|         -DSPGKYTPDWWPKVINQYGLLKFIRITKEGTFIEGAKISDVTIDDVH-IRSKQWSFRVA
ref|YP_173905.1|         -DQKGKYTPDWWPRGINQYGLLKVIRITEAGTFIDGKQLSDVKLADVS-IREKVWTFRVA
ref|ZP_00603386.1|       -DIRGKYTPDWYPDNLNQYGLLKTIRITKHLTNMNGEPLSNITINDI-PKEQDTWHLRIE
                          :  *  .* *:     **** ** :  :.   * ::*  :*::..: *:        ::.

ref|YP_001309477.1|      VPEETKHVGGLTIFGKNFGNYNQGISVRLVY------
ref|YP_001180339.1|      VPDHAKNIGGVTLFGRNFGNYDQDIKFRIFY------
RAAC00603                VPENARHVGGMTIFGRRFGHYDQDIKVRVIYGRGARD
ref|NP_242735.1|         VPDDAENVGGVTIFGEGFGNYNQDIIFRLYY------
ref|YP_173905.1|         VGEEGVHIGGVTLFGSSFGNYDQDIVFRLYY------
ref|ZP_00603386.1|       VKDDAKHVGGCTLFGKGFGNYDQDIKLKVYY------
                         *  :.   ::** *:** **:*:*.*  .:: *
```

FIG. 78

```
ref|YP_001664041.1|      -----KRIKELRKKKGITQKELASYLGISDRAVGYYESGQRTPPPDILQKIADFFNVSTD
ref|YP_085042.1|         ------RIKSLRKKENLTQKQLAEKIGVSQRMIGYYESEERFPPHDVLSKLADCFSVSAD
ref|NP_242309.1|         ---FPERLRYLRKKHGLTMKELGKKINVAESTISGYENGNRKPDMDTLVKMAEYFNSSTD
RAAC03180                MSSFPERLSELLSATNSTKRALARAIGISERMIQYYITGAKSPTLDVLVAMADYFNVGLD
ref|ZP_02038515.1|       ---FEERLYQLRRERGISQEELANIIGVSRQAVQKWESGASQPNIDNLVAISEYFGVTLD
ref|YP_001210714.1|      ---FAKRLSFLITKNKLSKQAVANAINVSRPAVSQFANGENLPSVEKLIALADFFDVSLD
                            *:  *         :  :.  :.::   :   :  .   *  : *  :::*.    * ref|YP_001664041.1|      YLLG------------------
ref|YP_085042.1|         YLLG------------------
ref|NP_242309.1|         YLLG------------------
RAAC03180                YLAGRSDDPTPPPRSPSSGWDP
ref|ZP_02038515.1|       YL--------------------
ref|YP_001210714.1|      YLVG------------------
                         **
```

FIG. 79

```
ref|ZP_02309926.1|      ----FSKRLSELRKKKGFSQYKLADELGFSRGQVANYEQGTREPDYQTLLKIAEFFNVST
ref|ZP_01941236.1|      ----FSKRLSELRKKKGFSQYKLADELGFSRGQVANYEQGTREPDYQTLLKIAEFFNVST
ref|ZP_01926077.1|      ----FSKRLSELRKKKGFSQYKLADELGFSRGQVANYEQGTREPDYQTLLKIAEFFNVST
ref|NP_469419.1|        ----FSKRLSELRKKKGFSQYKLADELGFSRGQVANYEQGTREPDYQTLLKIAEFFNVST
RAAC02417               MMMTFGERLAQLRRSKGLSQYALAEQLKMTRGQIANYEQGTREPDIETLKKLADFFDVSI
ref|YP_001111866.1|     ----------------MTQEQLAQQLGFTRGQVSNYEQGSREPDFETLKKIADFFKVTT
                                        ::*   **::*  ::***::*****:****  :**  *:*:**.*:

ref|ZP_02309926.1|      DYL-LGR----DDNNLADTIAAHID--SNATEEDIKEILAYIEEKR--KEHANEKEINIT
ref|ZP_01941236.1|      DYL-LGR----DDNNLADTIAAHID--SNATEEDIKEILAYIEEKR--KEHANEREINIT
ref|ZP_01926077.1|      DYL-LGR----DDNNLADTIAAHID--SNASEEDIKEILAYIEEKR--KEHVNEEEINIT
ref|NP_469419.1|        DYL-LGR----DDNNLADTIAAHID--SNASEEDMKEILAYIEEKR--KEHANEEEIDIT
RAAC02417               DFLVLGKPNVSDFNGLTNEVKRTLEALSQMSVEKQQEVADFAEYLRS-KEEQPVVEYDVR
ref|YP_001111866.1|     DYM-LGR---------------TD--DPTPVDKLIELSALAGQQK--FDPMK-------
                        *:: **:                    :  . .:. *:          :    :

ref|ZP_02309926.1|      EIASKEDEEINKFVDEN--EDFKVVAARVM--------------
ref|ZP_01941236.1|      EIASKEDEAVDKFVEEN--EDFKAVAARVM--------------
ref|ZP_01926077.1|      EIASKEDDAVDKFVEEN--EDFKAVAARVM--------------
ref|NP_469419.1|        DIAAKKDADVAKFVEEN--PDFKAVAARVM--------------
RAAC02417               EIAANMEKALYAHGDEDLIQHFEEIMRRVIRRYDERASQDQQNR
ref|YP_001111866.1|     ELPPEAQRSL---------EDFIDYLMRK---------------
                        ::..:   :  :               .*    *
```

FIG. 80

```
ref|NP_625321.1|        ------------EQRRALILDEVRRRGGVRVNELTRKLGVSDMTVRRDLDALSRQGVLEK
ref|NP_822608.1|        -----ENQNLLAEQRRALILDEVRRGGVRVNELTRKLGVSDMTVRRDLDALARQGVLEK
ref|YP_001103030.1|     ------------RQRQEVILNEVRRTGAVQVSALVLQLGVSDMTIRRDLDALARRGLVEK
ref|ZP_00996757.1|      ------------QRRAAILSMVQDSGAVRVSDLVEHLGVSDMTVRRDIERLDTDGLLER
ref|YP_001363698.1|     ------------QRQEVILDAVRTHGGVRVADLVERLGVSEMTVRRDIGELSRRGLVAR
RAAC01912               MIKRREVRTVYPKERQRVLLELLAQHGFASYRQLAERLGVSEITVRRDMKALEAQGLVET
                          :*:   :*. :    *   .   *.  :****::*:***:  *    *::

ref|NP_625321.1|        VHGGAVPVAEASTHEPGFEAKSGLEPTAKEDIARAAAELVAPGAAIALSGGTTTYALAHR
ref|NP_822608.1|        VHGGAVPVVEASTHEPGFEAKSGLELTAKEDIARAAAELVAPGTAIALSGGTTTYALAHQ
ref|YP_001103030.1|     VYGGATSMVGRSTDEPGFEAKSVRQLAEKEAIAMLAAEQVRPGTAIGLSAGTTTWTLARH
ref|ZP_00996757.1|      VHGGALALLPRATDEPGFTAKSSLMTAAKHAIALAAARLVDPGATIGISAGTTTYEFARA
ref|YP_001363698.1|     VHGGAAS-VARSSEEPGFAAKAGLRPDAKRAIARAAADLVPDGASVALSAGTTTAEVARE
RAAC01912               AFG--GGQVARAARELPYTDKRILQIPEKIAIAKAALRQIESGMTIAIAAGTTTWVLAQH
                         ..*     :         :: *   :    *    ** *    *  ::.::.****  .*:

ref|NP_625321.1|        LVDVPDLTVVTNSVRVADVFHVAQRTSGARQGGATVVLTGG-VRTPSDSLVGPVADQAIA
ref|NP_822608.1|        LVDVPDLTVVTNSVRVADVFHAAQRTSGQRQGAATVVLTGG-VRTPSDSLVGPVADQAIV
ref|YP_001103030.1|     LDDVADLTVVTNSIRVADALQQRGRTDR------TVVLTGG-VRTPSDALVGPVAVQSLR
ref|ZP_00996757.1|      IRNIPHLTVVTNSVPVAQLLHESG-------GNHVVVLTGG-VRTPSDALVGPVAVAALQ
ref|YP_001363698.1|     LRDVSDLTVVTNSPRVADLLHDPADHSR------TVVLSGGT-RTPSDALVGPVARAGLR
RAAC01912               IAGFQNLTFLTNSVNVATELSKNGYR--------DIFLTGGQFRTPSDALVGPVAEHMIR
                        :  ...**.:***  **   :            :.*:**  *****:******    :

ref|NP_625321.1|        TLHFDALFLGVHGISAEAGLSTPNLAEAETNRRLVQSARRVVVADHTKWGVVGLSSFAA
ref|NP_822608.1|        ALHFDVLFLGVHGISVEAGLSTPNLAEAETNRRLVQSARRVVVADHTKWGTVGLSSFAS
ref|YP_001103030.1|     SLHLDLVFLGVHGIAARAGFTTPNLNESETNRALAEAANRLVVVADHSKWSTVGISTIVD
ref|ZP_00996757.1|      GLHVDRLFLGAHGIDRNAGLTTPNLVEAETNRALVRASRSVCVLADHSKVGIVGLSTFMA
ref|YP_001363698.1|     GLHVDLLFLGVHGLDAAAGLSTPNLSEADTNRALMDCAARVVVVADASKWGVVGLTSFAD
RAAC01912               QFRADILFVGASGLHVDHGLSTPNVLEAAVNRAMMERAARVVVLADHTKWGVESLMSFAK
                         :: *  :*:*. *:    *::***: *:  .**  :  : : *:** :*  .   .: ::

ref|NP_625321.1|        LEQVDTLVTD--SGLSADARAEVAE-HLGLVVAGEPEPEA-------
ref|NP_822608.1|        LDQVDTLVTD--AGLPAGARAEVSEHLRRLVVAGEP-----------
ref|YP_001103030.1|     LHEVDLLISD--DGLPQEARQVLSENVPELVLAEVP-----------
ref|ZP_00996757.1|      LHEVDTLITD--PGTPARVRALLEDSVDHLVLAEVASA---------
ref|YP_001363698.1|     LGSVDVLVTD--AALDPSARPVISDLVGELVVAGTPQEE--------
RAAC01912               LSEIDALITD--RWPGEAEAAALAECDVDLIVADAPNAESSKRGDAQ
                        *  .:* *::*      :            *::*  .
```

FIG. 81

```
ref|YP_001169444.1|    --------------------------------IRRRIVSLNYPPGLMIFENAVAAEFGVSRTP
RAAC02663              MGLRGGGDVIAGVTYGVAKKTLGEQAYEVIREEILSLRLHPGQTVYESDFTRMLNMSRTP
ref|NP_435364.1|       -------------------ETAAAQVERDLRESIIRLELAPGMRLSEQEIATRMGVSRQP
ref|YP_001313948.1|    -------------------ETTAAQVERDLRESIIRLELAPGSRLSEQEIATRMGVSRQP
ref|ZP_01509063.1|     --------DLTASVSFD-SHEPIGKQIFRALRQAIFVGQLVPGTPLSEKEVSDMFQVSRQP
ref|YP_527240.1|       ------------------------QIFEYLRDAIVSMELRPGQMIAETSLAEQFGVSRTP
                                               :*  *.  .  **   : *  .:  :  :** * ref|YP_001169444.1|    VHQAFMRLSHEGLLDVLPQRGARVSFLSRSTIIHAQYVRECLEAAAFFDAAR--IWDAAD
RAAC02663              VREAVRALAMERLIEVLPQRGMKVALISERQVEETRFVRESLELSVIRRVAEDVAQDASV
ref|NP_435364.1|       VREALIALGKSKLVDIRPNRGTVVVRISARQMMEARFVREAIEVAVARRASETF--DSWT
ref|YP_001313948.1|    VREALIALGKSKLVDIRPNRGTVVVRISARQMMEARFVREAIEVAVAQRASE--AFDSWT
ref|ZP_01509063.1|     VREAFIKLVEAGVLQVLPQRGTFVKRISPRQVREGRFIREAIETAVVKKAAVSIS-DEQL
ref|YP_527240.1|       VREALIKLSNIGFVEVLPQRGTYVTKFSTQKILEARFIREALEVAVAADLAS-----NVT
                       *::*.   *       .:::  *:**   *  :*    :  .:::**.:*  :.    :

ref|YP_001169444.1|    AAHLQ---RERRAQDLIEAQREAVARGDYLRFTELDVAFHTEILGVLGNDLLLACVSQMR
RAAC02663              RARLE---REMARS--LQDQREAAEAGDALQFMHADDAFHQIFLQHFDNETLTAIVAQMR
ref|NP_435364.1|       RR-----KIDTILAR----QKAANEAHDHNAFRREDEQFHIAIAEGAGCGLAWNAVSDIK
ref|YP_001313948.1|    RG-----RIDTILSR----QRAAEEINDHNAFRREDEQFHIAIAEGAGCGLAWNAIADIK
ref|ZP_01509063.1|     QA------LADNLRD----QKIAAKANDTAAFLALDEAFHYAIAQAIDCTAAWETIQDIK
ref|YP_527240.1|       EE------LVEACQAIIEAQSKAADEDDSITFQKLDDEFHQMLAQHTQYARVGSLIEAEK
                               *   *     *    *    **  :          :    :

ref|YP_001169444.1|    NQLNRLRLLELREAHHEKRMIADHEALLAAVSAGRADEARRRLITHLKTLEDFREEIFGR
RAAC02663              GHLNRVRMLSLFEPERMKRLVGEHERVAEAVLSGNADRSAEAMHHHLAKLMEDLPGIKAR
ref|NP_435364.1|       AHMDRVCNLQLRHPDSMKKLIAEHEAIITAIDARDADAAAAAMRSHLNGILADLPQIEAD
ref|YP_001313948.1|    AHMDRVCNFQLRHPDLMKNLIAEHEAIIIAIDARNAEAAANAMRRHLNGILSDLPQIEAD
ref|ZP_01509063.1|     AQMDRVRYLSLPDVSPLDLLIKQHAKILAGLRAHDASAAEEAMRNHLREILMSLGPIAAR
ref|YP_527240.1|       AHMDRVRNLSLQEAGQFKRVLAQHKAIVKAIKAGDANKAQEAMSTHMREVYKILTVIPAE
                        ::*: :    ..*  .  .::  :*   :  .:: *.  :    *: :    * .

ref|YP_001169444.1|    HPDLFRP
RAAC02663              HPAFFGP
ref|NP_435364.1|       NPDLF--
ref|YP_001313948.1|    NPDLF--
ref|ZP_01509063.1|     NPAWF--
ref|YP_527240.1|       HPEYF--
                       :*  *
```

FIG. 82

```
ref|YP_643029.1|            --------LRRPEPLYRQVYEVLRRRILAGEYGAGEVLQESRAAEELRVSRTPVREALRQ
RAAC01158                   MERRSVTAIQRSEPLVKQVYKYLYHAILSGEFRPRDKVVETHIAERLQVSRSPVREAIRL
ref|YP_077724.1|            -------SIQRAVSYHDQVHHYLKDMIIKGGYQPGERIYESKIAKELQVSRSPVREAIRT
ref|YP_001308645.1|         --------IEKAPSYYDQAYNSIKAMIFNGILKPGDRIYESKLASEFQISRSPVREAIRS
ref|YP_174340.1|            --------VERPIPYYEQFYHSIKKMIFTGHFKPGDRIVETQLAKEFNVSKSPIREAIRI
ref|YP_516602.1|            -----MSAITKSLPFHLQIYEILKGKILNGEISRGERLYENKISQELGVSRSPVREALRM
                                   : :. .   * :. :    *: *      :  : *.: :..: :*::*:***:* ref|YP_643029.1|            LEREGLLVARGTE-RVVADPSREEFVDLYTCRAALEGLVAERAARLAEEEELREMEEALE
RAAC01158                   LIQRDLLVEDADG-VRVFQPTQRDFAELYEMRLALEPVAAERAAENAHSTCVAALHENVK
ref|YP_077724.1|            LEQEGLLLIDDKSKITVYEPTIKDLEEIYQCRQALESLAVSLATRLASNETLELISETLS
ref|YP_001308645.1|         LEKDGLLVIGDKSKITIYKPTKEDIENIYECRQALESQAAKLTTLKASNKELDKIEKILL
ref|YP_174340.1|            LEKEGLVIVDEKSRVIVYKPTQKDVEEVYFCRMALESFAVSEATKIASDEDIHELEKLLI
ref|YP_516602.1|            LEQDELVVVTSTG-LIVNPMEFSDMEEIYQCRMALEPFAAKISADKLTNEDLAALRNLVI
                            * :  *::         :. ::*  * ***  ... ::    .  : : ::

ref|YP_643029.1|            EARRAVAAGDHGGV-------LSANTRFHDLMVRSARMPPLERLMDTLRGQILVARRHIL
RAAC01158                   QTEQALALGDWDSI-------VALNKEFHECIWQMSGNRRILKAMQEITDLVQFYWRALL
ref|YP_077724.1|            EAHKHQKSQGPESA----NALLRLNTQFHDAIIEASENERLQKQLLDLRSLTFFYRSKNL
ref|YP_001308645.1|         EIKKNIDNFDDTLT----KNIIELNTKFHDLILDFSQNNHLKKLSKDLSSLTYFYRSIDV
ref|YP_174340.1|            RTDQAISSKKEEDR------IISLNELFHSTIIDYTKNLRLKKQINDLKALIYYFRILNF
ref|YP_516602.1|            QARVYHNQKAYEKV-------VESNTQPHDIIIQSSGNSRLIGIIEKIRSLIILSRKTEF
                            .                :  * **.:   :       :         :          .

ref|YP_643029.1|            SDERIEAEICEEHASILEAIRRRDVGAARERMQRHMQNDIR-------------------
RAAC01158                   DIPNLDIQIVGDHQQIVQYIERRDSAGAHTAMKQHVAKDLRVISERFRDAKNAFKEQILD
ref|YP_077724.1|            EKPERTLEIINQHEEILRHMQDRNDAKAAESMRKHIEADLCYLKE---------------
ref|YP_001308645.1|         YEPERNIDIFNHHLEIFNYIKQRDEEKAYKAMYNHIDNDLK-------------------
ref|YP_174340.1|            QGDNRANVILEQHYRIFEFIKKRDPEKAAKAMISHLELDL--------------------
ref|YP_516602.1|            ECYQREEGYLDEHEGVLEALTQRNGDEAERLLRIHIMNDFEFYS----------------
                                       .*  :.. :  *:    *    :  *:  *:

ref|YP_643029.1|            --
RAAC01158                   EA
ref|YP_077724.1|            --
ref|YP_001308645.1|         --
ref|YP_174340.1|            --
ref|YP_516602.1|            --
```

FIG. 83

```
ref|ZP_02082978.1|        ----------------SRPLYEQVAERLRELMFKGALPDAQLPSVRSLATELSINPNTI
ref|ZP_01962813.1|        ----------------RPIYEQITEKFRTLIYQGALPAGCRLPSVRQLAMELSINPNTI
RAAC00068                 MTLDPPWQPPAWELDPSQPLYEQIAHRLRVEIAASRLPGGARLPSVRDLAAHLRVTPNTV
ref|YP_001420528.1|       ------------EFQSSKPIYLQIADRVYYRLIRSELSPGDKLPSVREMAVQMKVNPNTI
ref|YP_430032.1|          ------------EFDNSRPIYLQIIAAIKKQLARGELQPGQKLPSQREMAEELQVNPNTV
ref|ZP_02328287.1|        ----------FNLDLSKPLYEQVLSQIRSSIAKGEIALGEKIPSVREMAQALKITPNTV
                                          :*:* *:    .    :   . : .  . ::** *.:*    :  :.***:

ref|ZP_02082978.1|        QRAYTELERQGYIYSIKGKGSFVADNS---------------------------------
ref|ZP_01962813.1|        QRAYMTLEQEGLIYPVKGKGNFVAETRQIQEKSKEDFRKEFL-ELVRR------------
RAAC00068                 MRAYAELEQDGLLETFRGQGTFVARGSGVEARARARIARQAF-EHVRRVAADLGMRVEDL
ref|YP_001420528.1|       QRTYSEMERLGIVETRRGQGTFIAERSDLKAELKDRLTKDVFKRFIQEM-AELGL-----
ref|YP_430032.1|          QRAYREMEAMGLLETLRGQGTFISNRPGL-------------------------------
ref|ZP_02328287.1|        MRAYQELERDQLTVTRRGQGTFITSNAETVEQIKYNLAEIATGEYVRKM-TDIG------
                           *:*   :*         . :*:*.*::

ref|ZP_02082978.1|        ------------------
ref|ZP_01962813.1|        ------------------
RAAC00068                 LRLGAEAEGGAEDDASSH
ref|YP_001420528.1|       ------------------
ref|YP_430032.1|          ------------------
ref|ZP_02328287.1|        ------------------
```

FIG. 84

```
ref|YP_642998.1|         ------GSLS---------------------------DVAYEKLYGDITGGRLQPN
RAAC01035                MGQQDGGKLSPLWHACGITVPDDKSTGGVAHVEVPSQGYTEEECYRRLRDAIIDGTLMPS
ref|NP_822795.1|         ---PSTGEQAK------------------------QHALTQLRQAILHGEMAPA
emb|CAJ88752.1|          ---------------------------------------QLRQAILRGDMAPA
ref|YP_001191149.1|      ----TRGKKS-------------------------DYIYERLKTDIQRGKFLPG
ref|YP_752794.1|         VDLDSYKPLR-----------------------ELVLEAIREAIKNGVLKPR
                                                               :   *   * :  * ref|YP_642998.1|         ERLIELDIARELGVSRAAVRNALIRLEQEGLVKREPNRGARVRLVSEEEAVEILEARMAL
RAAC01035                QRLVEMDLARWLGASRATIRTVLARLEQEGLVERERYRGARVRHVSHEEAVEILEVRMAL
ref|NP_822795.1|         QRLVENELAEQFGVTRASIRAALIDLAAEGLVERIRNRGSRVRVVTVEEAVAITECRMVL
emb|CAJ88752.1|          QRLVENELAEQFGVTRASIRAALIDLESQGLVERIRNRGSRVRVVTVEEAVAITECRLVL
ref|YP_001191149.1|      QRLVEDALAKEYGSSRNTIRLALTRLENDGIVKRTT-SGVIVSFIDLKEAVEILEVREVI
ref|YP_752794.1|         ERLMEIQLAEELGVSRTPIREALRKLELEGFIVMVPRKGAYVADISLKDVADVFEIRAAL
                         :**:*   :*.   * :*  .:*  .*   *    :*::       *  *   ::..   :  * * .:

ref|YP_642998.1|         ECVAVRHAALNRTQEDIAGLREILSQMESRLEAGDLLGASDLNGQFHRRLVEISNHATIS
RAAC01035                ECLIARYAALRATDEDVRRLEDIISWMRRQYEGNDLLSYSDGNARLHRTIAEISRHNTAK
ref|NP_822795.1|         EGLCAAKAAVAASDEQLTELADLGAAMTKAVADGEPVTYSELNHELHDRIREFSGQQTAV
emb|CAJ88752.1|          EGLCAAKAASAVDDGQLGELKDLGTAMRKAVADGEPLVYSDLNHELHARIREFSGQRTAV
ref|YP_001191149.1|      EGFLARKAATRISEESLQRLESTLMEMKTALENREFLRYSQLNERFHSIIYEASGNTTAQ
ref|YP_752794.1|         EALAAGLAAERITDEELEAMERLLVEKVEAISSNDMDKLVDVDTKFHEAIYRASRNQRLF
                         *   . .  **    :  .:  :              :     :  : ..:*   :  . *  :

ref|YP_642998.1|         KLLKMLNSQLIRFQYRTILTPGRPASSLAEHRAIFEAVEAGDPERAEQAMRRHLSGVTEA
RAAC01035                RLLDTLNSQSVRYQYRTILAPNRSAASMQEHERIVDAIRRRDPDSAEQAMRVHLSQVCDT
ref|NP_822795.1|         ELLERLNAQLVRHRFQLALRPGRPQHSLNEHLSMIEAIRDRDPQAAEVAVRAHLTSVIEA
emb|CAJ88752.1|          ELLERLNAQLVRHRFQLALRPGRPQQSLNEHLAMIEAIEARDPQAAEAAVRAHLTSVIEA
ref|YP_001191149.1|      LLLSTLKLKMIRYQFRTVMVPGRAEVSWNEHFRIFQALKNHDENEAELWARTHVKNVREL
ref|YP_752794.1|         AIINNLREQIQRFSTSLSYPGRMQQSMQEHRDIVEAIQSRDIQLSRQLAQEHI------
                         ::. *. : *.:        *.*   *  **   ::*:.   *  :  :. :  *:

ref|YP_642998.1|         LR------
RAAC01035                LRSMRQGF
ref|NP_822795.1|         LR------
emb|CAJ88752.1|          LR------
ref|YP_001191149.1|      IQNNKE--
ref|YP_752794.1|         --------
```

FIG. 85

```
ref|YP_148128.1|            ------------IPIYYQLEQYMKEKIEKGEWQPGEMIPSERELAEMYDISRMTVRQAVN
ref|YP_001126297.1|         ------------VPIYYQLEQYMKEKIEKGEWQPGEMIPSERELAETYDISRMTVRQAVN
ref|ZP_01697892.1|          ------------IPIYFQIQEEIRKKIREGEWKTGEAIPSERVLSDLFEVSRMTVRQAVQ
RAAC02031                   MTKGSIRSMRESVPLYKQLKSELLEKILSGEWPPGEQIPSEAELASMYDVSRTTVRQAVG
ref|ZP_01662088.1|          -------------PLYERIKGTLREGILSGHYAPASLLPSEAALGEQFNASRITVRQALA
ref|YP_900875.1|            ------------MPLYHQVESHLKENIGNGTWKAGEAIPPERMLVDQYGVSRITIRQALA
                                        *:*  :::    :  *  .*   :  ...  :*.*   *  . :   ** *:***:

ref|YP_148128.1|            NLVNDGYLIRRRGKGTFVAAQKIEQPLKGLT---SFSEDMRARGMEPGTIVLSFEMVPAS
ref|YP_001126297.1|         NLVNDGYLVRRRGKGTFVAAKKIEQPLKGLT---SFSEDMRARGMEPDTVVLGFETVPAS
ref|ZP_01697892.1|          GLVDEGILMRKRGSGTFISEHKVEQPLEGR--M-SFTRLMEERGMKASNKIVAFFEREAS
RAAC02031                   DLVTSGFIVRRQGKGTFVAE--VDHPATSTTLY-GFAEELRAAGLPVDVRVDVIEMRTCP
ref|ZP_01662088.1|          DLQNEGLIFRRHGKGTFVSQPKAFQNVTALQ---GFAEAMSAQGHAIRNRVLKLRTLPAP
ref|YP_900875.1|            NLVAAGLLYRKHGKGTFVAGAQDRPITESLANLTGHLEELQLRGLNPQVRVLALETRTLA
                            .*    *  : *::*.***::              .        ...:   *     :  :

ref|YP_148128.1|            EKLAEGLGVTEGDDLYEVRRLRLADGLPMALETLYI--PVNLVPGLTRD-VVSGSVYEFI
ref|YP_001126297.1|         KKLAEWLAVKEGDALYEIRRLRLADGSPMALETLYI--PCALAPHLTRE-IVNGSVYEFM
ref|ZP_01697892.1|          VQEMEALTLKEPENVLHIERLRYGDEIPIVFES--IITPARIAAGLT-EEKLNRSFYQFL
RAAC02031                   EDIARWLRMTRSKQVLYIERTAYVEDMAYFHERSYLVPPYQVSSRMTPDPKMYDSIYGFF
ref|ZP_01662088.1|          TDVAQALQLAPGTAVTELHRVRLLDQVPVSLEVTWLPEPLG--SSVARADLVTRDVFLVL
ref|YP_900875.1|            AEVAEALERSPAAPGWYLYRLVTVDRQPLMLSTVWL--PRDLEIELTED-ILKQHGMALL
                            .  .        :  * :  *            *          ::     :        .:

ref|YP_148128.1|            EKEKGMIIGSAVQTLEASVARKVEAEHLKMKEGAPVLLLERRTHLVDGRPLEVVKSVYRG
ref|YP_001126297.1|         EKEVGLAIGTAVQVIEASVARKLEVEHLQVKEGAPVLLLERRTYLTDGRPLEVVKSVYRG
ref|ZP_01697892.1|          EREKGLRLGKGYQTIEAVAASARLAKLLKVAPGSPVLSIERVTSLSDGTPFEYVKAQYAG
RAAC02031                   E-QNGVRINSGSQTISAELADEEDCARFGLTPPAAVLCIERITRDESGAPVEYSLVRYPS
ref|ZP_01662088.1|          EQDAGVALGHATLAIDAALADHATATALDTGAGAALLRVERLTHDAQGTPIDFERLYFRG
ref|YP_900875.1|            LTRNGIFPLRGRQRIGASSAGPEEAQLLGIRPGDAVLCVKRVIYGAASRPLVWFRTLYRS
                             *:    .  :  * *              :       .:*  ::*      . *.     :  .

ref|YP_148128.1|            DRYKFMIEMKR---
ref|YP_001126297.1|         DRYKFIVEMER---
ref|ZP_01697892.1|          SRFK----------
RAAC02031                   DRYQLRVHLLRHPR
ref|ZP_01662088.1|          DAFQYRLRLDR---
ref|YP_900875.1|            DRYEYEVELKR---
                            . ::
```

FIG. 86

```
ref|YP_832996.1|            ------SKSEQAYAAVKARIVDGTYSPGYRLVLAKIAEDLGVSVVPVREAIRRLEAEGLV
ref|YP_950253.1|            ----PGSKSEQAYQAVKARIVNGAYSPGYRLVLGSIAKDLGFSVVPVREAIRRLEAEGLV
ref|YP_949591.1|            ------SKSQQAYAAVKARIVEGTYTPGYRLVLAKIAEDLGFSVVPVREAIRRLEAEGLV
ref|YP_001127075.1|         ------NKTQLAYEYILSHIESGAYGPGYRVVIDQIARELGLSSIPVREAIRQLEAEGLV
ref|YP_148880.1|            ------NKTQLAYEYILSRIENGVYGPGYRVVIDQIARELGLSSIPVREAIRQLEAEGLV
RAAC03005                   MTKHPPSKQQVAYQTLKQRILEGTYGPGYRIVIDRIAKELGVSAIPIREAIRRLEAEGLV
                                    .*  :  **    :   :* .*.* ****:*:    .:.* :*:***:***** ref|YP_832996.1|            TFERNVGATVSGIDPTEYLYTMQTLSIVEGAATALSAPLIGSADVARARAVNEEMRECLE
ref|YP_950253.1|            TFERNVGATVAGIDPTEYLYTMQTLSIVEGAATALSAPLIDSVAISRARAVNEEMRECLD
ref|YP_949591.1|            KFERNVGATVSGIDPTEYLYTMQTLSIVEGAATALSAPLIDSVAIARARAVNEEMRECLE
ref|YP_001127075.1|         EFKPYAGAVVSTINEKEYVETLSVLAVLEGYATALGSAKLTKEAIKQLEQLNEQMERALE
ref|YP_148880.1|            EFKPYTGAVVSNINEKEYIETLSVLAVLEGYATALGSAHLTKEAINELERLNEWMERALE
RAAC03005                   EVERFSGAKVTRIDAKMYEDILSALAVLEGYATAQAYRNLTDEDFDALRQTNEAMRQARS
                             .:    ** *: *: .  *     :..*::: **  ***    :  . .   **  *... .

ref|YP_832996.1|            HFDPVRFTRLNQDFHSVLFEHCPNPHILDLVHRGWNRLASLRSSTFRFVPGRARDSVDEH
ref|YP_950253.1|            HFDPVRFTRLNQDFHSVLFEHCPNPHILDLVHRGWNRLASLRSSTFRFVPGRARASVDEH
ref|YP_949591.1|            HFDPVRFTALNQDFHSVLFEHCPNPHILDLVHRGWNRLASLRSSTFRFVPGRAQESVREH
ref|YP_001127075.1|         ELELERFSELNYAFHSLIYSHCGNAYLEEQIKQIWQRMKRIRVYGFTFVPQRAKASIGEH
ref|YP_148880.1|            ELELERFSELNYEFHSLIYAHCGNAYLEEQIKQIWQRMKRIRAYGFTFVPQRAKASIEEH
RAAC03005                   DFDLTLYSRLNQQFHEIILRRCNNRYLVDEIHAVRERMDAMRVSVFNLIPHRASDSIAEH
                             .::     ::  ** **.::    :* *  ::  : ::     :*:   :*    *  ::* ** *:  **

ref|YP_832996.1|            EALLRLIESGAGADEIEKAARLHRSATLDAY-----------------------------
ref|YP_950253.1|            EALLKLIETGADADTIEKAARLHRSATLNAY-----------------------------
ref|YP_949591.1|            EALLRLIENAADADTIEKAARQHRAATLDAY-----------------------------
ref|YP_001127075.1|         REMIRLLREQAPPHEVEQYARQHKMNTIEAFLR---------------------------
ref|YP_148880.1|            REIIRLLREQAPPHEIEQYVRQHKINTAEAFKR---------------------------
RAAC03005                   DKLIQLMAVDVGEDAVERFARQHRLATLEAFRRWNEQHTRLVAERREWYRAPREIHRPGA
                             :::*:      .  . :*: .* *:   * :*:

ref|YP_832996.1|            --
ref|YP_950253.1|            --
ref|YP_949591.1|            --
ref|YP_001127075.1|         --
ref|YP_148880.1|            --
RAAC03005                   DS
```

FIG. 87

```
ref|YP_073926.1|            ------------RVSSQRIYQQIVDQITRMVQEGTLRPGDRLPPERQLAEEFGVSRSAVR
ref|YP_431134.1|            ---------------TKKIYEEIVQQIKDLIGEGNLKPGDRLPSERELSERLAVSRASVR
emb|CAB08003.1|             -------------------------------GELKPGDKLDSVQALAESFQVSRSAVR
ref|YP_001422711.1|         ---------------TKKIYEEVADALLEKIKAGELKPGEKLDSVQALSESFQVSRSAVR
ref|YP_080763.1|            ---------------TKKIYEEVAEALLESIKSGELEPGDKLDSVQALADSFQVSRSAVR
RAAC02459                   MNALDPEGDATMREASSKLYMEIAEEIRRQIEEGAFRPGDRLPTLRELADRFGVSRATVR
                                           * :.**::*  .  :  *::  :  ***::**

ref|YP_073926.1|            EALSALRMLGLVEARVGEGTFVTQPPDERFISPLALVLTIEQSEAVGRELLELRAALEAE
ref|YP_431134.1|            EALSALAAMGVIVIRPGEGTFVQNIRNGAIVEPLAMALLLDRQAAM--ELLEARQALEGE
emb|CAB08003.1|             EALSALKAMGLVEMKQGEGTYLKEFELNQISQPLSAALLMKKEDVK--QLLEVRKLLEIG
ref|YP_001422711.1|         EALSALKAMGLVDMKQGEGTYIREFEPSHVSQPLSSALLMKKEDVK--QLLEVRKLLELG
ref|YP_080763.1|            EALSALKAMGMVEMKQGEGTYVKRFEPEQISIPLSAALLMKKKDVA--ELLEVRKILEIG
RAAC02459                   EALSALRGQGLVEFRHGMGTYVRAASVEMWMQPLDAAILLSYDNVR--DLVELQTAVLAQ
                            ******    *::  :   * **::         **   .: :..  .  :*:* :  :

ref|YP_073926.1|            SAALAAVRREAEDLAAMEEALGDMERDLQEGRLGAEADWRFHDAVASASGNSLLLQTMRS
ref|YP_431134.1|            AAYLAARRAGPEDLEKMEELLKEMEHDLQRGILGEEADLRFHLAIAEAARNSVLARLMHT
emb|CAB08003.1|             VASLAAEKRTEADLERIQDALKEMGSIEADGELGEKADFAFHLALADASQNELLKHLMNH
ref|YP_001422711.1|         VAAMAAEKRTEDDLQKIRQALLEMKDIDGDEELGEKADFSFHMALAEASQNGLLKHLMNH
ref|YP_080763.1|            AVSSAAQKRTEDDLGRMQEALEDMKLADGNGELGEKADLAFHLALAGASQNDLLKGLMNH
RAAC02459                   IAYRAAAQRMESDYSVLSHALFELEASPRRGEHRIASELKFFSVLAELAGNRLLENALRV
                              .  ** :    *   :  . * ::           ::  *. ..:*   :  * :*   :.

ref|YP_073926.1|            LSDTMKEALGLYRE-QL-------------------------------------------
ref|YP_431134.1|            VSDTMRQALKTSRQ-RLYTTAGNP--------------EKLFAQHNQIYEAIKAHDPRA
emb|CAB08003.1|             VSSLLLETMRETRKIWLFSKKTSV--------------QRLYEEHERIYNAVAAGNGAQ
ref|YP_001422711.1|         VSALLLETMRETRKIWLFSKRTSV--------------QRLYEEHERIYSAVAAKDADE
ref|YP_080763.1|            VSSLLIETMR--------------------------------------------------
RAAC02459                   LQEALRSSLRLLNPKLDLGVQACRRVYNAVQTGRPADARDAVYAYGEAILRAVAEKKGRG
                            :.    :  .::

ref|YP_073926.1|            --------
ref|YP_431134.1|            ARKAI---
emb|CAB08003.1|             AEAAMLAH
ref|YP_001422711.1|         AEAAMTAH
ref|YP_080763.1|            --------
RAAC02459                   QSAMM---
```

FIG. 88

```
ref|YP_147389.1|              ---------------MNAMERENTVKSVRRALQIIEIVSTKKDGLGVTEIAKQMDINKSS
ref|YP_001125502.1|           ------------------------VKSVSRALQIIDIVSTKKDGLGVTEIAKQMDINKSS
ref|NP_243003.1|              ------------------------VKSVDRALTIISLVSEHKQGLGVTDVAAKLSLTKSS
RAAC01353                     MCRSPAEKHRRARKDEVNRLEDYTVKSVDKALLLLEVVSEHPDGIAITELAQSVGMYKST
ref|YP_001665938.1|           ------------------------VQSLERALKILEVLGKNPNGLGVTELAREVDLPKST
ref|YP_360107.1|              --------------------DTLIQSVDRALRILDTFSLKEKELGVTEIANRLGLHKST
                                                       ::*: :**  ::. ..  : .  ::*::*   :::  **:

ref|YP_147389.1|              VYRILTTLAQYGYIEQHPETERYKLGYKFLELSSKLLDSIDLRQEAKPYLRELEKETNEV
ref|YP_001125502.1|           VYRILTTLAQHGYIEQHPETERYKLGYKFLEISSKLLDSIDLRQEARPYLRQLEKETNEV
ref|NP_243003.1|              AYKLLATLVEHGFIEQDEETKKYRLGYRYLELSATLLESIDIRRQARPFLEQLEATTNEV
RAAC01353                     VHRLLGTMMRRGYIEQDPVSGRYKLGYTVLDLGMKLLSSIDLRREAMPALQELALASGEV
ref|YP_001665938.1|           VYRLLSTLAKWGYVEQEKENEKYKLGLKIIELSSNILNNLELREVARQYLEELMEFANEV
ref|YP_360107.1|              VFGLLRTLEHWGYVEQNQVTGKYRLGLKLLELGNRVKEGLDLRAVALPFLQDLVERYGET
                              ..  :* *:  . *::**.  .  :*:**   :::.   : ..::*  *   *.:*    .*.

ref|YP_147389.1|              IHLVVYDQGEVIYIEKLEGTETLRMHSKVGKRAPMHCTAVGKAILAHLPPAVAAEIIDRK
ref|YP_001125502.1|           VHLVVYDQGEVIYIEKLEGTETLRMHSKVGKRAPMHCTAVGKAILAYLPPTVTAEIIDRK
ref|NP_243003.1|              VHLVLYDQGEMVYIDKLEGTKTLRTHSKIGRRAPIHCTSVGKVIMAYLPEKVQISLIERY
RAAC01353                     VHLALLDRGSVVYIEKVESPNTIRMHSRVGTRVPVHATGLGKAILAFLPKREVQDIVRRY
ref|YP_001665938.1|           VHLCVLRDGEIVYIDKVESHNTIQMYSQIGKRAPVHCTAVGKAILAFLPQEEAISILKTK
ref|YP_360107.1|              VHLAVHDRGEIVYIEKVEGPNAIRMYSQIGRRAPMHCTGVGKAILAFRPEKEIEEIIRTK
                              :**  :    *.::**:*:*.  ::::  :*:*:* *.*:*.*.:**.*:*.  *     .::

ref|YP_147389.1|              GLPKHTDWTITDREAFFRELETVRQNGYALDLEENEYGIRCVAVPIFDYTGGVVAAISVS
ref|YP_001125502.1|           GLPKHTDLTITDREAFFRELDSVRQNGYALDLEENEYGIRCVAVPIFDYTGSVVAAVSVS
ref|NP_243003.1|              GLPPHTERTITDKETFMKELEKIRLEGYGYEMEENEPGITCIAAPIFDYQGAITAAVSIS
RAAC01353                     GLPRLTPHTITDADAFWASLEETRSTGFAFDMEEHQEGVCCVAAPIFAHDGRVMAAVSVS
ref|YP_001665938.1|           GLPRKTPNTITSLEEMLKHLEEIRRLGYAIDNVEHEEGIRCVAAPIFDYTGQVVASVSIS
ref|YP_360107.1|              GLKYFTPNTITDPKKLHEELSLIRENGYSLDREEIEIGLRCVAAPIRDSQNTVVAAISVA
                              **   *  ***. .:     *.  *  *:. :    * : *:  *:*.**     . : *::  ::

ref|YP_147389.1|              GPTIRMTDDRITSLTVRMRQIGKELSARLGYR------
ref|YP_001125502.1|           GPTIRMTDDRIAGLAMRMRQIGKELSARLGHR------
ref|NP_243003.1|              GPSIRLSKERLHELRPLIIAIGKKISQRLGYQ------
RAAC01353                     GPALRMTRERMVELVPLVKRAGERISERLGYRRERVAP
ref|YP_001665938.1|           GPEYRVTWEKVPGLAVKVKEITKKISQRLGY-------
ref|YP_360107.1|              GPSIRMTEEKIQELIVSVKEAALEISKRLGYQ------
                              **   *:: :::  *   :       ..:* ***:
```

FIG. 89

```
ref|ZP_02329176.1|         ---------TVRSVERALDILLCFRDSSEL-TLTEISNQAGLHKSTVHRLLASLEGKGFL
RAAC02432                  MPHTPSGQTTVRAVERALDILLLFTHSPRAWSLSEIARATGLHKSTVHRLLLALQQKGFV
ref|YP_076367.1|           -------------MERALDVLLCFAGERGGLGVTQIAEKLGLYKSTVHRILAALESRGFV
ref|NP_694155.1|           MNDSPKG---IRTLQRSIDILNCFIEKNSELTLTEISLYTGLAKSTTTRLLSTLEMNNFV
ref|YP_001126042.1|        ---------LRTVQRAIDILYCFTLEEQELSLTEIANKISLAKSTTTRLLATLEQNRLV
ref|YP_643152.1|           ------------AAVRVADVLLLFASGPDALGVSEISRRLGLSKAVVHRILRSLASRGLV
                                       *   *:*  *           :::*:   .* *:.. *:* :*  . ::

ref|ZP_02329176.1|         LRDSSGDKYRLGFSVWELSANLSQGDDISMLLLPEMEWLRDQVGETISIYVRDGKERVRI
RAAC02432                  RRESESDRYVLGWSLYGLGANAALHDRWSDAAKPILRRLRDETNETVSLYVRNGLERIRI
ref|YP_076367.1|           RRDPATGRYHLGLRALELAQVYLSSGDLPTIALGEMLQLRDLAQETVSLYVRDGAERVRV
ref|NP_694155.1|           EKDEVNAKYRLGKQIYFLGFVAGQTFELNSLAKSTMERLREQTKETVNLYILDGKHRVCV
ref|YP_001126042.1|        IKNPETLKYRLGQGLYYLGHIAGKSIEVREIAKPVMERLRNETRETVNLYVLEQGARVCI
ref|YP_643152.1|           SHDAESRSYGLGPAAAALGARALAGLELRRVALPVLRRLQRETGETTTLSELVGTARVYL
                             ::         *  **         *.              :   *:    .  **  .:         *:  :

ref|ZP_02329176.1|         QAVQSKHAIRRVAPVGARMPLYVGASSKVLVAFGDEALQVELAHD----ARSSVGLDPTA
RAAC02432                  LAVESLQPIRNVASVGERYPLTIGASGKVLLAFSNSAVIEAACHP----DRLPNGVRQVD
ref|YP_076367.1|           QRAEGPLTVRRVVGLGERLPLYLGASGKVLLAWCPPEERARILDA-----QLPAGFDRTA
ref|NP_694155.1|           QQFESLQSVKHMISGVGKLPLTVGASGKVFLAYQSKEFIEDAM------DTQPLKKSKVD
ref|YP_001126042.1|        EQYEGLQSLRHMVKIGERLPLWAGAGGKVLLAYQSPSFQERIL------AQVPTEERRTR
ref|YP_643152.1|           DQVPSLKEIKMTVEVGRPFPLHAGASSKAILAFAPPEVREHVLEGPLEALTPLTVTDRAR
                                :       :*       **    **..*.::*:                    .

ref|ZP_02329176.1|         ---FLKQLAETREQGFATSMEEREPGAAALSAPILNRSGKLVAALAISGPISRLTPEQMQ
RAAC02432                  ---LRQQLEAIRREGYALSRQERDAGAAAIAAPVLNEDGSCLYAIAVSGPVERMTEDKMR
ref|YP_076367.1|           ---LEARLAEAREQGWALSLEEREEGVASVAAPVIDRAGRCVAALAISGPVSRFTDDRV-
ref|NP_694155.1|           ---LKNELDLIIKEKYAVSIEERESGTSAAAAPIFNFQNEVVAVLSVSGPASRL------
ref|YP_001126042.1|        ---LTAELEMIRQRGSTSSIDEREVGSAAVAAPIFNIHGEVNACLSISGPTHRFTPQAIR
ref|YP_643152.1|           ---LEVELGQIRESGTAVSCGERQSGAGSVAAPVIGVDGYAVGSISVCGPVDRFGEETVE
                              :   .*    .   : *  **: *  .: :**::.   .    :::.** *:

ref|ZP_02329176.1|         -------------------
RAAC02432                  DMVTPLKRAAEELSERLAE
ref|YP_076367.1|           -------------------
ref|NP_694155.1|           -------------------
ref|YP_001126042.1|        -------------------
ref|YP_643152.1|           RM-----------------
```

FIG. 90

```
ref|YP_001662226.1|        --TIKDVAKRANVAPSTVSRVIADNPRISKETKERVWKAMEELGYYPNAIARSLASKVTN
ref|YP_001664166.1|        --TIKDVAKRANVAPSTVSRVIADNPRISKETKERVWKAMEELGYYPNAIARSLASKVTN
ref|NP_624096.1|           --TIKDVAKRANVAPSTVSRVIADSPRISKETKERVWKAMEELGYYPNAIARSLASKVTN
ref|ZP_02171282.1|         --TIKDVAKLANVAPSTVSRVIANSPRISERTKETVREAMKELGYHPNFNARSLANKSTN
emb|CAB65654.1|            MATIKDVARLANVSPSTVSRVLANSPRISEETKRRVRAALEQLNYHPNAFARGLVTNSTG
RAAC00570                  MATIKDVARLANVSPSTVSRVLANSPRISEETKRRVRAALEQLNYHPNAFARGLVTNSTG
                             ******: ***:*******:*:.****:.**.  *   *::*.*:**  **.*..: *.

ref|YP_001662226.1|        TLGLIMPRSTEEAFSNPFFPEVMRGISVVAHREKYDLLLSTSGNQEEEKEAVINMVKGKR
ref|YP_001664166.1|        TLGLIMPRSTEEAFSNPFFPEVMRGISVVAHREKYDLLLSTSGNQEEEKEAVINMVKGKR
ref|NP_624096.1|           TLGLIMPRSTEEAFSNPFFPEVMRGISVVAHREKYDLLLSTSGNKEEEKEAVIRMVKGKR
ref|ZP_02171282.1|         TIGIVMPNSANKTFQNPFFPEVIRGISSKAHQLEYGLYLSTGQTEAEIFEEVQHMVQGKR
emb|CAB65654.1|            AIGILIPPSAQEFFVNPFFAEWMAGVAEVARQRGVDTVLSTSARG--EIETLDHMIRGRR
RAAC00570                  AIGILIPPSAQEFFVNPFFAEWMAGVAEVARQRGVDTVLSTSARG--EIETLDHMIRGRR
                           ::*:::* *::: * ****.*  :  *::      .  ***.       * : .*::*:* ref|YP_001662226.1|        VDGIILLSSRTTDELIPWLRDEKFPFVVIGKPLDAKG--VYWVDNDNIGASKLATNYLIK
ref|YP_001664166.1|        VDGIILLSSRTTDELIPWLRDEKFPFVVIGKPLDAKG--VYWVDNDNIGASKLATNYLIK
ref|NP_624096.1|           VDGIILLSSRTTDELIPWLRDEKFPFVVIGKPLDARG--VYWVDNDNIGASKLATNYLIK
ref|ZP_02171282.1|         VDGIILLYSRVDDKVVDYLYKENFPFSVIGRPYDEKKRDITFVNNDNFKAAKTVTEYLLL
emb|CAB65654.1|            VDGVLLIGARQGDPVLQEVAKLRCPAVLLGRPADPAP--ISWVNNDNQRAAYDATVHLLN
RAAC00570                  VDGVLLIGARQGDPVLQEVAKLRCPAVLLGRPADPAP--ISWVNNDNQRAAYDATVHLLN
                           ***::*: :*   *  ::   .  *  ::*:* *    :  :*:***  *:  .*  :*:

ref|YP_001662226.1|        HGHREIAFISGSLEYVVSLDRLDGYKLALEENGIPFKRELAEQDEFSEDGGYRAMMRILE
ref|YP_001664166.1|        HGHREIAFISGSLEYVVSLDRLDGYKLALEENGIPFKRELVEQDEFSEDGGYRAMMRILE
ref|NP_624096.1|           HGHREIAFISGSLEYVVSLDRLDGYKLALEENGLTFKRELVEQEEFSEDGGYRAMMKILE
ref|ZP_02171282.1|         LGHKNIAFIGGNLDFVVTVDHMEGYRKALSNAGMELLDDYVVFHEELQEGGGQEAVIDLMS
emb|CAB65654.1|            LGHRRIGFLGGASDLVVTMDRVAGYRQALVDHGVEPDSRLEVSSFFLEQGGYLGMMRLLA
RAAC00570                  LGHRRIGFLGGASDLVVTMDRVAGYRQALVDHGVEPDSRLEVSSFFLEQGGYLGMMRLLA
                            **:.*.*:.*   : **::*::  **: **  : *:         ::**  .:: ::

ref|YP_001662226.1|        -REKPTAVVVTDDVMAFGVIRAAIDKGYRVPEDISIVGFNNIPLSAFANPPLTTIDISTF
ref|YP_001664166.1|        -REKPTAVVVTDDVMAFGVIRAAIDKGYRVPEDISIVGFNNIPLSAFANPPLTTIDISTF
ref|NP_624096.1|           -RAKPTGVVVTDDVMAFGVIRATIDKGFRVPEDISIVGFNNIPLSAFANPPLTTIDISTF
ref|ZP_02171282.1|         LNDPPTAMIVADDIMTFGVMRMLSEMEMKVPDDVSIISFNNVMISELSSPPMTTVDIHIY
emb|CAB65654.1|            IPDRPTAVLCADDVLAFGGMRAAHELGFEVPGDLAIVGFNDIRLAELAHPALTSVRVHMH
RAAC00570                  IPDRPTAVLCADDVLAFGGMRAAHELGFEVPGDLAIVGFNDIRLAELAHPALTSVRVHMH
                                 **.:: :**::** :*     .** *::*:.**:: ::  ::  *.:**  :  .

ref|YP_001662226.1|        DLGIKSAELLIARLKQKEIDIDHIIVPVKLVERKSCVAR-------
ref|YP_001664166.1|        DLGIKSAELLIARLKQKDVDTDHIIVPVKLVERKSCVAR-------
ref|NP_624096.1|           ELGIKSAELLIARLKQKEIESDHIIVPVKLIERKSC----------
ref|ZP_02171282.1|         NLGFEACNLLIDQILHPETGSKQVLIPHKMIKR-------------
emb|CAB65654.1|            ELGVRSAELLLEEIDQGKPLQRHVIVKHELVIRYSCGAKPIGTLTT
RAAC00570                  ELGVRSAELLLEEIDQGKPLQRHVIVKHELVIRYSCGAKPIGTLTT
                           :**..:.:**: .: :  .    ::::   :::  *
```

FIG. 91

```
ref|ZP_01188246.1|     MATIKDIAKIAGVSTATVSRVINNYPDVSEKTKKKILKIMKENNYRPNSVARSLSTSKSN
ref|ZP_01188241.1|     MVTIKDIARIAGVSTATVSRVINNYPQVNEKTKKKVLEVMKENNYRPNSVARSLSTSRSY
ref|ZP_01188890.1|     MATIKDIAKLAGVSVTTVSKVINNYPDISDKTKEKVIKIMEQQNYRPNAIARSLSTSRSR
ref|NP_242794.1|       MATIYDIAKKTGYSITTVSKVLNNYTDVSDKARKKVMDAVTEMGYFPSSSARMLTTKKSW
RAAC00269              MTTIYDIARRAGVSATTVSKVLNGYPDVSQKTREKVQRITRELGYQPNAAARGLVTRRSM
ref|NP_244559.1|       MTTIKDIAKVAGVSVTTVSRALNGYSDVNEKTRKKIKDIANELKYSPNVMARSLVMNRSK
                       *. *: :* * :***:..:*.*.::..:*:::*:      :   * *.  ** *    :* ref|ZP_01188246.1|     IIGIFFTDHFNTGIHHPFFREVIYGLEKIFDEKGYDILYFTNRKWGENF---SYVEKCHD
ref|ZP_01188241.1|     TIGIFFTDHFDTGLRHPFFREVIYGLEKIFGQKGYDILYFTKRNWDDKCS---YVDKCRD
ref|ZP_01188890.1|     SIGVFFTDHLNSGLRHPFFRDIIYGIEKTFFRKGYDLILFAH-QWGDRFS---YTEKCKS
ref|NP_242794.1|       TIGVVFVESAGIGMEHPFFSSVIENFKKNVERFGYDLLFASNQI-GNEAK--TYLEHFRY
RAAC00269              SIGVFFQDDARMGFRHPFLHDIVASFQDVVGESGYDLLFFSRTTPPNAPQG--FEARARH
ref|NP_244559.1|       TIGLLVSEISREGAKDNFTFEVLCGINDRASESDYDIILFNTNTSKQKLKS--YTQLCRE
                       **:..:     *  ..  *   .::  .::.     . .**::        :      :    :

ref|ZP_01188246.1|     RQ--VDGVVLMGVPKTDSNIPKLLDSDIPTVFVDLDIVGKKASYVISDNYRGAEMAVNYL
ref|ZP_01188241.1|     RH--VDGVVLMGVSREDTNLPQLLDSGIPTVFIDVDIIGKRASYVTLNNTDGAKMAVNYL
ref|ZP_01188890.1|     RH--VDGAILMGMPRTDPNLDKLVNSNIPTVFIDLDIVGKNATYVISDNVQGAKQAVNYL
ref|NP_242794.1|       RG--VDGIVVVCSLLNDPEVEKLMKADIPSVVIDLDSKGSSAVY--SDNEYGSELAVDYL
RAAC00269              RG--VDGLFLLGIPRTSPGLPSLVRSRIPIVSVDLDLFGPRASWLSSDNVGGARLAVEHL
ref|NP_244559.1|       RC--VDGVILQGIKKEDPYLEEVIESDIPCVMVDIPITGESVSYVTTDNVDGAKKAVETL
                       *    *  .:         ..  :  .::  :    *  :*:      *  *:. **: * ref|ZP_01188246.1|     HSLGHTRIGMIMGISSTKVTNDRLLGYQTAIKNLGLVYNSQWILDG-RYTEEGGYQAMSK
ref|ZP_01188241.1|     YSLGHTKIGMIMGISSTKIAHDRFLGYQMALKDLSLSYNPDWVLNG-LFSEEGGYRAMNK
ref|ZP_01188890.1|     YSLGHIKIGMIMGQRITKPAQDRLIGFQEELTNLGLEYNPEWIIEA-EFGEEGGYQAMKR
ref|NP_242794.1|       VSLGHRSIAHISGDQGLFVGVQRLKGFKDAIQKLNLSISDEYIVDGGFFTYEGGQRAMEA
RAAC00269              AAMGHTKIGFVGDRYGTKPGQDRALGYHMAMQELGLTFRSEWVAEG-DFMEESGEEAMHR
ref|NP_244559.1|       IDFGHRKIAMMNGHERAYVSGKRKLGYEQALQEAGIPLQEEWVLNG-EFSEQVAEKEAYQ
                       :**  *. :  .          .*  *:.   :   .:   :::  :.    :  . .

ref|ZP_01188246.1|     YLEMDERPTAIFCQSDSMAIGAMQAIHEAGMSVPEDFSLIGFDDIEVSRYVNPALTTIKQ
ref|ZP_01188241.1|     FLKMIDRPTAIFCQSDTMAIGAMKAIKEAKMNVPGDDIEISKYVKPALTTIRQ
ref|ZP_01188890.1|     IITQEIRPSAVFCQGDEMAIGAINAIKEHGYNVPQDFSIVGFDNIEISSYVSPGLTTIHQ
ref|NP_242794.1|       LLRNRVRPTAVYAAGDLMALGAIDTIRKHGLSVPEDFSIVGFDDIQMIRYTAPALTTIRQ
RAAC00269              ILEAREWPTAVFFASDMMAIGAMKALRQRGLEPGRDISLVGFDDVAIARLVTPSLTTIRQ
ref|NP_244559.1|       FLQKHSDVTAFFCASDLMALGVMKAAKLLNLRLPEQLSVIGFDDILLAQYTSPPLTTVAQ
                       :        :*.:   .*  **:*..:: :        ::*::***::  :    . * ***: * ref|ZP_01188246.1|     DKIGLGRAAGELLINIVENENESQAPVILPVELVKRDSCGR---
ref|ZP_01188241.1|     DKVKLGRAAGKLLLNIINNDLDGYKPVILPVKLIKRKSCAKL--
ref|ZP_01188890.1|     DKLTMGKKAASILLEMINNPNKTFSPVVLPTKLIERESCRKIG-
ref|NP_242794.1|       NTDLIGKTAANLLLDQINENEKQSLSVKIPVTLIERDSCRKI--
RAAC00269              NTRAMGEEAARELLDLMQNPNRPPRVITIPVELVSRDSVARIGG
ref|NP_244559.1|       NKYQMGYAAAGLLIDRLRMKEVPP-FHMLDNELIIRESVAK---
                       :.  :*   *.  *:: :.       :   *: *.*  :
```

FIG. 92

```
ref|YP_518526.1|         ------------------------------------------------------------
ref|ZP_01369294.1|       ------------------------------------------------------------
ref|YP_430255.1|         ------------------------------------------------ETGSTDTGG
ref|YP_001213325.1|      ------------------------------------------------------------
ref|YP_361384.1|         ------------------------------------------------------------
RAAC02012                MGGIALKRHGRRLAWVAVAAAAFGAWHAWPRPERPHAHAHGSHSVAPSSASWTATDPGTT ref|YP_518526.1|         -LKDRVTVLLIGMDNRPGE-ALSNTDTLMVASLDQKSKKMVLLSVPRDTQVIL-NQKKEK
ref|ZP_01369294.1|       -LKDRVTVLLIGMDNRPGE-ALSNTDTLMVASLDQKSKKMVLLSVPRDTQVIL-NQKKEK
ref|YP_430255.1|         SQPGTLNILLLGTDARPGE-KVGNTDTIILAHFDGE--RLALLSIPRDTRVNIPGHGVDK
ref|YP_001213325.1|      ----RLNVLLLGIDARQGE-TMARTDTMILASVDTKSKQMILLSIPRDTGVEIPGHGWDK
ref|YP_361384.1|         ---GRVNILLLGVDDRHSKNRRERTDTIIFASIDSNLKKVVLVSIPRDTRVNIPGHGWDK
RAAC02012                RLGGRETILVLGSDKRPED-PRGNADVLLVASLDDSHRRIELLSIPRDTQVAFPDGRYHK
                            .:*::*  *  *   .     .:*.::.*  .*  .  :: *:*:****  *  :  . .* ref|YP_518526.1|         VNAIARLQKGPISTQQYLQELLGTPIDGYVLTNFQGFKNIVDGLGGITIDVEKDMYYDTG
ref|ZP_01369294.1|       VNAIARLQKGPISTQQYLQELLGTPIDGYVLTNFQGFKNIVDGLGGITIDVEKDMYYDTG
ref|YP_430255.1|         INAAYSIG-GPDLTTSIVADLTGVPISKYVLLRWDGFIKIIDLLGGVTVNIPRDMYYY--
ref|YP_001213325.1|      INSAAVYG-GPELSMKVVSNLLGIPVRYYVLTNFSGFKDIVDALGGVTLEVEQNM-YHEG
ref|YP_361384.1|         INAAHVVG-GIDLTKQVVSDLLGKPVDYYVLVNFEDFKKVIDTLGGVTIDVEKDM-YHAD
RAAC02012                INEALASG-GPEETCMLVERLIGLPIDHYAIIRFDALVHMVDRIGGLDIDVPRNMDYRTG
                         :*        *   :    :   *  *  *:  *.: .:.  .  .::*  :**:  :::  ::*  * ref|YP_518526.1|         EAQDR---FINLKKGVQRLNGTQALQYARFRNDELADITRTSRQQEVIKAIVAEATTPRN
ref|ZP_01369294.1|       EAQDR---FINLKKGVQRLNGTQALQYARFRNDELADITRTSRQQEVIKAIVAEATTPRN
ref|YP_430255.1|         DPVDGPQYKINLKKGLQHLDGHQALAFVRFRKEALGDIDRTGQQQELIKALLEKVRQPGT
ref|YP_001213325.1|      DEEYGGAYGINLKKGVQRLDGDKALQYVRYREYPMGDIDRTRAQQKFLVALAKEVLQPST
ref|YP_361384.1|         EYPY----TINLKKGRQHLNGEKALMYVRYRSDALGDISRTQRQQKFLKALAEQALQPGT
RAAC02012                DKVYG---VIRLRKGRHHLSGEQALQFVRYRHDALGDIGRTERQQAFLVALKDQLLRPQT
                         :         *.*:**  ::*.*  :**   :.*:*       :.**  **  **  .:  *:     *  .

ref|YP_518526.1|         IPKLPIIIPKVYQAIDTNLNLGQIWALAMAFKNKDTYEVINQTLPGQFS-----DEE---
ref|ZP_01369294.1|       IPKLPIIIPKVYQAIDTNLNLGQIWALAMAFKNKDTYEVINQTLPGQFS-----DEE---
ref|YP_430255.1|         LLKMPRLLPEIYKNVETNMGLDEMLTMARAGLHLKNMTVVSQTLPGYFQ-----TING--
ref|YP_001213325.1|      IPKLPKLIPEISRYVKTNLSVSEMYKLAAAAKNLENGNILTQTLPGR-----PVEIGG--
ref|YP_361384.1|         LLKLPKLIPEIIQMVETDMSTKDLMSLLAFSRELNKDSIITQTLPGYFY-----NYN---
RAAC02012                LPRLPEVAFDAWKMIDTDMSLGDISRLAARAPQYKTYRTVHTTLPGSFHDP-DPSIPG--
                         :  ::* :  .  : :.*::.  ::  :         . . . :  **** ref|YP_518526.1|         --GISYWKVNPKETKVILNQLF-QGKTSP-IFETIQKVHVPAQPPASKEAKP-------
ref|ZP_01369294.1|       --GISYWKVNPKETKVILNQLF-QGKTSP-IFETIQKVHVPAQPPASKEAKP-------
ref|YP_430255.1|         ---ISYWGVDPAQARQVAQALFEYGQTTK---------QVVLDAPASQT----------
ref|YP_001213325.1|      ---ISYWGVEPAEARQMVAKLF-NGETVT---------NVV------------------
ref|YP_361384.1|         --GVSYWQADLEVAKNLVDMLFA-GQIEQ---------NIVLGTKE-------------
RAAC02012                --DLSYWVVNPAEARYVAKRFFADGEVPPRIQDPRETRTWLPPEARAAQRPADRSTSG
                           :***  .:    ::   :      :*  *:              .
```

FIG. 93

```
ref|NP_354021.1|         ----------CPVESALSFLDGKWKGVILYHLIN----EGTLRFNELRRHIPSVTQRMLT
ref|ZP_01074644.1|       ----------CPVERALEIIGGKWKGAILYHLLDSSNQGGSIRFNELRRIMPNITQRMLT
ref|NP_772010.1|         ----------CSVEATLDLIDGKWKGVILYHL-----QDGTQRFGELRRRMPGITQRMLT
RAAC01701                MSSGHRGDSPCSAVSTLQVLSGKWKWLILYHLFQ----HPSLRFSELMRRIPGITQRVLT
ref|NP_691275.1|         ----------CSVEDALGILVGKWKPIILLHLME----KGTVRFSDLKRSIPGITQKMLT
ref|YP_174284.1|         ----------CEVDTALEILVGKWKHKILFQLMT----HDVMRFNELKRAIPGITQKMLT
                                   *  .  :* .: ****  ** :*      **.:* * :*.:**::**

ref|NP_354021.1|         KQLRELEEAGLISRTVFPVVPPRVDYALTPLGETMRPVISALKSWGDAHV----------
ref|ZP_01074644.1|       KQLRELAETSLISRTVYPEVPPRVEYAMTDYGKTLAPVIDSLRAWGISHL----------
ref|NP_772010.1|         KQLRALEEDKLVIRKVYAEVPPRVEYCLSELGESLRPVIDILKAWGESHQQR--------
RAAC01701                KQLRELEEEGIVERTVYPEVPPRVEYAITPYGQSLRPILDLMHAWGLEHLRRKAERALQE
ref|NP_691275.1|         KQLRELENEEIINRVVYPEVPPRVEYSISEYGRTLEDLLHAMHEWGQAHTIRKQQK-LQE
ref|YP_174284.1|         SQLRELESHDIVERKVYPQIPPKVEYSISEYGKSLQPVLDAMHEWGKNH-----------
                         .*** *  .  :: * *:. :**:*:*.::   *.::  ::   :: ** * ref|NP_354021.1|         ---
ref|ZP_01074644.1|       ---
ref|NP_772010.1|         ---
RAAC01701                PKL
ref|NP_691275.1|         ---
ref|YP_174284.1|         ---
```

FIG. 94

```
ref|ZP_02330514.1|        --------------LCPRFEHAFEILGKRWTGLIIRVLLSGPKRFKDISDVIPGMSDRML
RAAC00927                 -----MIVMGNHEQICPRFEWAFALLGKRWTGLIIRVLLEGPKRFKDISDMIPNMSDRML
ref|YP_001376921.1|       --------MEHNSCLCPKFESAFTLLSKKWTGLIIKSLLEEPKRFREIADIIPNMSDRML
ref|YP_001253394.1|       -------------MCPKFENAFELLGKRWTGLIIRTLLNGQKRFSDIAEAIPNMSARML
ref|YP_001308605.1|       -------------MCPRFENAFELLGKRWTGLIIRTLLNGQNRFSDIEEAIPNMSARML
ref|NP_347485.1|          -------------KLCPHFEAAFELLGKRWTGLIIHSLLKGAKRFSDIQDIIPNLSARML
                                       :: ** :*.*:****: .  :** :* : **.:* *** ref|ZP_02330514.1|        SERFKELEAADIVVRKVYPETPVRIEYELTEKGKALRPVMDELQKWAEKW----------
RAAC00927                 AERFKELERAGLVVRRVYAETPVRIVYELTPKGEALRPVMEAVQKWGDEWVTDSDCDEYQ
ref|YP_001376921.1|       SERLKELESEGIVVRNVYPEVPVRIEYGLTDKGKALESVMNEVQNWAEKWV---------
ref|YP_001253394.1|       TERFKELEEEGIIIRKVYPETPVRIEYELTEKGLDLQAVMDEIQKWAEKW----------
ref|YP_001308605.1|       TERFKELEKEGIIIRKVYPETPVRIEYELTEKGRDLQSAMDEIQKWAEKW----------
ref|NP_347485.1|          TERFRELEKQGIVVRKVYAETPVRIEYELTEKGRELESVMQEIQKWAEKW----------
                          :::*   .:::*.**.*.**** *    *...*: :*:*.::* ref|ZP_02330514.1|        ------------
RAAC00927                 RRYKCSSRDRAL
ref|YP_001376921.1|       ------------
ref|YP_001253394.1|       ------------
ref|YP_001308605.1|       ------------
ref|NP_347485.1|          ------------
```

FIG. 95

```
ref|YP_001643469.1|         ------------------------------SGLTPPQFYILKILDHYGASRATQLAE
RAAC00935                   MRGDMDALTQRFAQSLGVLAQEFGPHLLNRLH-TGLTAGQFFTMQMIRREGRLKVSQLAE
gb|AAB87745.1|              ----------RLDQAFYKAMKTLGPKVYEKLE-HNLTGEQFFVLNTLEQKGRITSSQLAE
ref|NP_391166.1|            -----DQLMSDIQLSLQALFQKIQPEMLESMEKQGVTPAQLFVLASLKKHGSLKVSEIAE
pdb|1S3J|A                  -----DQLXSDIQLSLQALFQKIQPEXLESXEKQGVTPAQLFVLASLKKHGSLKVSEIAE
ref|YP_001422559.1|         -----DQYVSDIQKSLQTLLQNIQPEMVESMAKHEVTPAQLFVLASLKKHGSCKVSEIAE
                                           :*    *::  :    :  :  *      :::**

ref|YP_001643469.1|         KMYVKPSAITVMTDRLIDHGLVERYHDDNDRRVVVIELTKKGKTTVEEAMAARNEHIAKY
RAAC00935                   RLEVTPSAITVMIDRLEHHGYVSRVRDEEDRRVVVIELTEAGRAKLAEVERAWFEMMRQM
gb|AAB87745.1|              ELQVKPSAITAMVDRLLKNDFVIRERDEKDRRAVYVRISDEGRRALKSSVKKRNIIMEKY
ref|NP_391166.1|            RMEVKPSAVTLMADRLEQKNLIARTHNTKDRRVIDLSLTDEGDIKFEEVLAGRKAIMARY
pdb|1S3J|A                  RXEVKPSAVTLXADRLEQKNLIARTHNTKDRRVIDLSLTDEGDIKFEEV-----------
ref|YP_001422559.1|         RMEVKPSAVTLMADRLEQKGLIVRKHNQQDRRVIDISLTKKGETKFEDVVEGRKAILARN
                            .  *.***:*    ***  .:. :  *  :: :***.:  : ::.  *    .  .

ref|YP_001643469.1|         FSHLE-------------------------------------
RAAC00935                   VSRIEPGAFKQCVSALETMVAAAKQLRMESYGEETPRQEV---
gb|AAB87745.1|              MSKLTEEEMEQLTTVLEKLTS----------------------
ref|NP_391166.1|            LSFLTEEEMLQAAHITAKLAQAAE-------------------
pdb|1S3J|A                  -------------------------------------------
ref|YP_001422559.1|         LSVLTDDELIQSVNIIRKVAEAAENTRLIKKKTNRKEELPKHE
```

FIG. 96

```
ref|YP_001126687.1|      ---------------PSAMNEKTVAELEKLLRYIAANLKQRGREILTNYPITPPQFVALQ
ref|YP_148522.1|         -----------------------VAELEKLLRYIAANLKQRGREILTNYPITPPQFVALQ
ref|NP_693030.1|         -----------------ELSDSVNQMEKRLRYISGMIKQNGRKILNNYPITSPQFIALQ
RAAC02041                MVRFIGLWARTGCGYPLADYSPFVEEIEKALRLVAATVRRRGRVLLKDYDLTSPQFDALI
ref|YP_001320949.1|      ------------------------EIEKELRYLCTVIKQKGREILTDFQITPPQFQALQ
ref|YP_001512727.1|      ----------------ARYDDNIIEIEREIRYLCTKIKQKGREILADFSITPPQFEALQ
                                          : :*: :* :.  :::.** :* :: :*.* ref|YP_001126687.1|      WLLEEGDLTVGELSNKMYLACSTTTDLIDRMERNGLVSRVRDEHDRRVVRIHLLEKGERI
ref|YP_148522.1|         WLLEEGDLTVGELSNKMYLACSTTTDLVDRMERNGLVARVRDEHDRRVVRIRLLEKGERI
ref|NP_693030.1|         WLLEEGDLTIGELSNRISHAFSTTTDLVDRMEKNELVERVRDTNDRRVVRIHLLEKGKHI
RAAC02041                TLYNEGELTIGELSAKLYLAYSTTTDLVDRLERAGYVSRQRDLVDRRVVRVQLRDKGAQV
ref|YP_001320949.1|      YLISEDSLTIGELSNKMFLACSTITDLVDRMEKNDLVKRARDEKDRRVVRIVVLDNGHEI
ref|YP_001512727.1|      YLNNCQGITIGELSNKMFLACSTVTDLVDRMEKNDLVKRVRDEKDKRVVRPQVSEKGYQL
                           *  .   :*:****  ::  *  ** ***:**:*:   * * **  *:****   : ::* .:

ref|YP_001126687.1|      IEEVIEKRQRDLARVLENFSDEE------------------
ref|YP_148522.1|         IEEVIEKRQRDLASVLESFSDEE------------------
ref|NP_693030.1|         IEEVIDKRQAYLGEVLTKFSEEEKEQLNQLLDFLYTEM---
RAAC02041                IEAVLSARRAYLDSILKHVSIEQRRAILQALDLLLTNMGNS
ref|YP_001320949.1|      INQVLHARRNYLEEVLLDVSSEQRDSVLQGISLI-------
ref|YP_001512727.1|      IEEVLHARRNYLADVMKDVSEKDRKFILDGITMI-------
                         *: *:  *:  *  ::   .* ::
```

FIG. 97

```
ref|NP_629113.1|        --------------------------------------------------ET
ref|NP_824479.1|        --------------------------------------------------DT
ref|ZP_01169478.1|      ------------------------------------------MSKEKQNDVEL
ref|NP_631123.1|        --------------------------------------------------ET
RAAC02241               MRGHEKFLLPSDTKCQLPVPNCSGTREMKSTQLLYYTTITLKMHPKEADMDQANMDSFEA
ref|YP_001508494.1|     ---------------------------------------------------DSLRD ref|NP_629113.1|        LQHEVALFARRAEQTRLGGVGQVRNSMDRAAYLLLNRLDKEGPMGVKALAASMGIDSSTV
ref|NP_824479.1|        LQHEVAVFARRAEQTRLGGVGQVRNSMDRAAYLLLNRLDKEGPMGVKALAASMGIDSSTV
ref|ZP_01169478.1|      IEYELATFIRKAVYLEQS--EKKIGQLERSAYLLLRQLDEFGPARVKELAEAFKLDISTL
ref|NP_631123.1|        IQREMTVFARRARAS----AGRMHPELSLVSYTLLGHLEERDGRRATDLAAHYALDKSTV
RAAC02241               LEREMAIFARRLEGARQS--WRKHREIDRSAYLILLALREEGELTAGQLAARFLLDISTI
ref|YP_001508494.1|     LERELMLLARHHIAPNAARRGRTR-HLDRSAYLLLSRLEAQGPMTIGQLAEAFSLDVSTV
                         ::  *:  : *:         :    :. :* :*  *   .     **    :* **:

ref|NP_629113.1|        TRQVAPLVDTGLVKRTSHPEDGRAVVLQLSPRGVARLEEVRSSRRQLMAELTHDWAPQER
ref|NP_824479.1|        TRQVAPLVDTGLVKRTSHPEDGRAVVLQLSPRGMSRLEEVRSSRRQLMSELTHDWAPQER
ref|ZP_01169478.1|      SRQAASLESKDLIKRCSDPKDGRVSVFSITDLGKEKLEADIANRRAHYFKVLNDWTEEEK
ref|NP_631123.1|        SRQVSALERAGLIERRVDPDDHRVQVLHLTESGRDVLDRVTERRRAAFRERLADWPEEEL
RAAC02241               SRQITPLVEAGWIAKERDEDDKRQLRLSITEAGVEALEATRASRIELYRELVGDWTEEER
ref|YP_001508494.1|     NRQTAAVLQAGLAERIPDPDGGLARKLSITPEGARRVADDRAFVIGELSGLVSTWSEDEL
                         .**  ::.    :     :   ..      : ::   *    :          *. :* ref|NP_629113.1|        ETFCALLARFNGALSAR------
ref|NP_824479.1|        EAFTALLTRFNTALSDR------
ref|ZP_01169478.1|      EIFGKLVVRLN------------
ref|NP_631123.1|        LRFAAYLERYNAWPDAAPGAER-
RAAC02241               RTFLGLLRRLNERIRARQQAERT
ref|YP_001508494.1|     RLFASMLERLNTSIETK------
                          *    :  * *
```

FIG. 98

```
ref|NP_388620.1|            --------------------IDQVAKRSGLTKRTIRFYEEIGLIPAPKRTDGGVRLYS
ref|YP_001420380.1|         --------------------IDQVAKRSGLTKRTIRFYEEIGLIPAPKRTEGGVRLYS
ref|YP_090401.1|            ---------------DVEWMKIDQMAKRSGLTKRTIRFYEEIGLLSSPKRTEGGVRLYS
ref|YP_077997.1|            --------------------IDQMAKRSGLTKRTIRFYEEIGLLSSPKRTEGGVRLYS
RAAC02671                   MAYTGVRQKMRRWKMDRDKAWTVEAVAERLGITPRTLHYYEEKGLIPEVPRTPGGHRVYD
ref|YP_714968.1|            ----GVRDKDQMKKAARELCGIGQA-AQELGVSVRALRYYQEVGLLTPSGRTSGGNRLYA
                                          :  *:. *:: *::::*:* :.     ** *:* ref|NP_388620.1|            EDDMEELEKVISTKEVLGFSLQELQHFMETSRQLELNKEGYLLSLDPKERKEKLEEIQET
ref|YP_001420380.1|         EDDMEELEKVTSTKEVLGFSLQELQQFMEMSRQLELNKEGYLLSLDPKERKEKLEEIQQA
ref|YP_090401.1|            EDDLEELERVISAKEVLGFSLQELQQFMETGKHLEMNKEGYLLSLDKRERKEKLEDIQRM
ref|YP_077997.1|            EDDLEELERVISAKEVLGFSLQELQQFMETGKHLEMNKEGYLLSLDKRERKEKLEDIQRM
RAAC02671                   EDTIERIEHILRLKEALGYSLQEIRSILSTEDQLKAYRARIAEGHEPEHNVQMLSESVRL
ref|YP_714968.1|            DSDLARVRRIRELQTLLGFNLDEIGTILAYEDRLAQVREFHAASDDGDRLRLLSEGETA
                            :.  :  .:.::     :  **:.*:*:  ::      :*    :   . :  ... *.:

ref|NP_388620.1|            LNHQLDLIDEKIRTFQSFKE----------------------------
ref|YP_001420380.1|         LNHQLEMIDEKISTFQHFKTRLNGMKE----------------------
ref|YP_090401.1|            LNEQMRMIDEKIEKFQSFKK----------------------------
ref|YP_077997.1|            LNEQMRMIDEKIEKFQSFKK----------------------------
RAAC02671                   LEDVVRHIDEKMLRLGSMREHYMDRLARIRARLEREEAATRVGFPDQEGE
ref|YP_714968.1|            YVKLRAEIDEKISRLAAFRD----------------------------
                             .   ****:   :   ::
```

FIG. 99

```
ref|YP_001141973.1|      --RTYSISELAREFDVTTRSIRFYEDQGLLNPARQGQTRIYSKQDRVRLKLTLRGKRLGF
ref|YP_856665.1|         --RTYSISELAREFDVTTRSIRFYEDQGLLNPARQGQTRIYSRQDRVRLKLTLRGKRLGF
ref|YP_927240.1|         ----YSISDLSKEFDITTRSIRFYEDQGLLKPKRRGQTRIYSLKDRVRLKLILRGKRLGF
ref|YP_001141729.1|      ----YSISELAHEFDITPRTIRYYEDEGLITPTREGQTRIYSHKDKIRLKLTLRGKRLGF
ref|YP_427081.1|         -RDSFSIADLAAEFSVTPRAIRFYEDKGLITPARDGMRRIYSPRDRVRLMLILRGKRLGF
RAAC00549                MRRYYTIRDLADMFDITPRTLRHYEDMGLLKPARRGAKRLYSERDRVRLQLILRGRRLGF
                           :* :*:   *.:*.*::*.*** **:.* * *  *:** :*::** * ***:****

ref|YP_001141973.1|      SLADIRDLFDLYDADKSSRTQLQTMLGLVADKRETLQQQLEDIKMVLLELDAAEQRCQQA
ref|YP_856665.1|         SLADIRDLFDLYDADKSSRTQLQTMLGLVADKRETLQQQLEDIKMVLLELDAAEQRCQQA
ref|YP_927240.1|         SLAETRRLFELYDADKTSVTQLNTMLALIEEKKAALQQQMDDIKVVLMELTSAEAQCRGA
ref|YP_001141729.1|      SLAEIRELFDMYDTDRSSKTQLHSMIQLINAKRQSLHQQLEDIQMVMAELEAAEQRCANS
ref|YP_427081.1|         SLKEIQEIIDLYDAEPTGEAQLRRLITTCQTSRAALRQQMEDIRITIDEIEAVEAQCRQA
RAAC00549                SLPEIAEMLDLYDADPTEITQLREVIRRGDEKLRHVELQISELEALRDELIAMRSRLQQV
                         ** :    :::: **::  :  :**. ::      .    :. *:.::.    *: : .:

ref|YP_001141973.1|      L--------------
ref|YP_856665.1|         L--------------
ref|YP_927240.1|         LD-------------
ref|YP_001141729.1|      LN-------------
ref|YP_427081.1|         L--------------
RAAC00549                LDDKLKQCHQKGCDD
                         *
```

FIG. 100

```
dbj|BAA00729.1|         ----------------------------------------RRSMPLFPIGIVMQLTELSA
ref|NP_389627.1|        ----------------------------------------RRSMPLFPIGIVMQLTELSA
ref|NP_833433.1|        --------------------------------------EDRRSAPLFPIGIVMDLTQLSA
ref|YP_001375615.1|     --------------------------------------EDRRSAPLFPIGIVMDLTQLSA
ref|ZP_02328256.1|      ----------------------------------------RRNMALFPIGIVMKLTDLTA
RAAC01080               --------------MSWRALHVTISFNRSHREGRAVDLEERRNMPLFSIGTVQKLTGLSA
                                                              . ..** * .** *:* dbj|BAA00729.1|         RQIRYYEENGLIFPARSEGNRRLFSFHDVDKLLEIKHLIEQGVNMAGIKQILAKAEAEPE
ref|NP_389627.1|        RQIRYYEENGLIFPARSEGNRRLFSFHDVDKLLEIKHLIEQGVNMAGIKQILAKAEAEPE
ref|NP_833433.1|        RQIRYYEEHNLVSPTRTKGNRRLFSFNDVDKLLEIKDLLDQGLNMAGIKQVLLMKEN---
ref|YP_001375615.1|     RQIRYYEEHNLISPTRTKGNRRLFSFNDVDKLLEIKDLLDQGLNMAGVKQVLQMKEN---
ref|ZP_02328256.1|      RQIRYYEQHELVIPARTSGNQRLYSFNDVERLLEIKDLIEKGVNIAGIKQVLLPVSKDSE
RAAC01080               RQIRYYEEHGLIQPARTPGNQRQFSFADVERLMQIRQLLDEGHNIASVKRNLLEKDRRPR
                        *******:: *: *:*: **:* :**:**::*::*:.*:::* *:*.:*: *    .

dbj|BAA00729.1|         QKQNEKTKKPVKH-DLSDDELRQLLKNEL---MQAGRFQRGNTFRQGDMSRFF---
ref|NP_389627.1|        QKQNEKTKKPMKH-DLSDDELRQLLKNEL---MQAGRFQRGNTFRQGDMSRFF---
ref|NP_833433.1|        QTEAVKVKEETK--EISKTELRKILRDEL---QHTGRFNR-TSLRQGDISRFF---
ref|YP_001375615.1|     QTEAVKTKEETK--EISKAELRRILRDEL---QHTGRFNR-TSLRQGDISRFF---
ref|ZP_02328256.1|      EATYLNEASETKRKELTDSQLRQLLKQQI---VGARRPGQ-VSLIQGELSRFY---
RAAC01080               SSRPLATR------DVPDSEVYQWLEREL---MERRQTGE----FQGDLSRFYRHR
                        .               ::.. :: : *. ::            :  .    **::***:
```

FIG. 101

```
ref|YP_146517.1|         ----------------------QIIEAAAQSFAAFGYKATTMEQIAKLANVGKGTIYTF
ref|YP_001124699.1|      ----------------------QIIEAAAQSFAAFGYKATTMEQIAKLANVGKGTIYTF
ref|ZP_00739458.1|       -----FGGEDVAIDRKRS------IIEAATKSFSAFGYKATTMDQVAKLANVGKGTIYTF
ref|NP_830863.1|         ----------MAIDRKRS------IIEAATKSFSAFGYKATTMDQVAKLANVGKGTIYTF
ref|YP_893832.1|         -----FGGDDVAIDRKRS------IIEAATKSFSAFGYKATTMDQVAKLANVGKGTIYTF
RAAC01126                MTKLEFWSECVAMRRKRGMTVRDRIEEAAKRAFSEFGYKGTTMDQIARLAGVSKGAIYLH
                                                * ***  ::*: ****.***:*:*:**.*.**:**  .

ref|YP_146517.1|         FKSKEELLDEIVSGLIMEIKAEAELAMDSSLPFSENVHRALYRILEFRQRHQLTAKLLQE
ref|YP_001124699.1|      FKSKEELLDEIVSSLIAEIKVEAEQAMDSSLPFSENVHRALYRILEFRQRHQLTAKLLQE
ref|ZP_00739458.1|       FKNKEELFGEIISNLITEMKQVAESAIRSDVSFFENVHRALYSILEFRKEHQLMIKLIQE
ref|NP_830863.1|         FKNKEELFGEIISNLITEMKQVAESAIRSDVSFFENVHRALYSILEFRKEHQLMIKLIQE
ref|YP_893832.1|         FKNKEELFGEIISNLITEMKQVAENAIRSDVSFFENVHRALYSILEFRKEHQLMIKLIQE
RAAC01126                FPSKEALFQHMLRGVIAQVRDAFESAQVEGDDYFRNLERGLRALMRFRADHAMLSKLVQE
                         * .** *:  .::  .:*  :::    * *    :  .*:.*.*   ::.**  *  :   **:**

ref|YP_146517.1|         VRNIGTAAVQEVLAKLDRAMVEFIRQKIDAAVEKGEIRPCNSEITAFLMLKTYIALIVDW
ref|YP_001124699.1|      MRSIGTIAVQEVLTKFDRAMVEFIRQKIEAAVEKGEIRPCNAEITAFLMLKMYIALIVDW
ref|ZP_00739458.1|       ERDMGTKEVQEVMQQVDVEIVSVIQSYLKIAIEKGEISKCDPEITAFIMLRLYVSLIFDW
ref|NP_830863.1|         ERDMGTKEVQEVMQQVDVEIVSVIQSYLKIAIEKGEISKCDPEITAFIMLRLYVSLIFDW
ref|YP_893832.1|         ERDMGTKEVQEVMQQVDVEIVSFIQSYLKIAIEKGEISKCDPEITAFIMLRLYVSLIFDW
RAAC01126                VRQFGTAEARAGLGELEAAILDYLARHLKRGVELGVVRPCRANLVAFVLLRAYTAVLRDF
                          *.:**   .:   :  :..:  ::.  :      :.  ..:* *  *  .:::.**::*:  *   :::  *:

ref|YP_146517.1|         EKDHEPLTKEQIAELFTLYFLQGL------------------
ref|YP_001124699.1|      EKDHQPLTKEQIAELFALYFLQGL------------------
ref|ZP_00739458.1|       EKNHEPLEKEKIAELFELYLLKGL------------------
ref|NP_830863.1|         EKNHEPLEKEKIAELFELYLLKGL------------------
ref|YP_893832.1|         EKNHEPLEKEKIAELFELYLLRGL------------------
RAAC01126                PSAEGPLSEEDLYQLFTGVFVDGLRLRPGEGEPRNTQSEQER
                         .  .  ** :*.:   :**      ::   **
```

FIG. 102

```
ref|NP_832103.1|         -----KQRPLGRPRQNKNTKSTKENILEVATRLFLTQNYQVVSMDEVAKVCGVTKATVYY
ref|NP_978750.1|         -----KQRPLGRPRQNKNTKSTKETILEVATRLFLTQNYQVVSMDEVAKVCGVTKATVYY
ref|ZP_02215257.1|       -----KQRPLGRPRQNKNTKSTKETILEVATRLFLTQNYQVVSMDEVAKVCGVTKATVYY
ref|NP_844783.1|         -----KQRPLGRPRQNKNTKSTKETILEVATRLFLTQNYQVVSMDEVAKVCGVTKATVYY
ref|YP_894956.1|         -----KQRPLGRPRQNKNTKSTKETILEVATRLFLTQNYQGVSMDEVAKVCGVTKATVYY
RAAC01138                -MRNARSRRPGRPPQVEMEEPTAEKILRAAAECFMDQGFAAVSMDDVAERAGVTKAVVYY
                              :.*   *** *   :    :.* *.**..*:.  *:  *.:  **:: .***.* ref|NP_832103.1|         YYSTKADLFTATMIEMMVRIRENMSQILSTNKTLEERLLDFAKVYLHATMDIDMKNFMKD
ref|NP_978750.1|         YYSTKADLFTATMIQMMVRIRENMFQILSTNKTLKERLLDFAKVYLHATMDIDMKNFMKD
ref|ZP_02215257.1|       YFSTKADLFTATMIQMMIRIRENMSQILSTNNTLEERLLNFAKVYLHATMDIDMKNFMKD
ref|NP_844783.1|         YFSTKADLFTATMIQMMIRIRENMSQILSTNNTLEERLLNFAKVYLHATMDIDMKNFMKD
ref|YP_894956.1|         YFSTKADLFTATMIQMMIRIRENMSQILSTNNTLEERLLNFAKVYLHATMDIDMKNFMKD
RAAC01138                YYGSKTELFQRAMMEVMRASRERTQAILRENGPLRERLQKLTRTRLAIPATLDMNHILRG
                         *:..*::**  :*:::*    **.   **   * .*.*** .::::. *   .  :**::::.

ref|NP_832103.1|         AKLSLSEEQLKQLKNAEDNMYEVLEKALDNAMHIGEIPKGNAKFAAHAFVSLLSIGNFKD
ref|NP_978750.1|         AKLSLSEEQLKQLKHAEDNMYEVLEKALDNAMQIGEIPKGNAKFVAHAFVSLLSIGNFKD
ref|ZP_02215257.1|       AKLSLSEEQLKELKKAEDSMYEVLEKALDKAMQLGEIQKGNPKFAAHAFVSLLSIGNFKD
ref|NP_844783.1|         AKLSLSEEQLKELKKAEDSMYEVLEKALDKAMQLGEIQKGNPKFAAHAFVSLLSIGNFKD
ref|YP_894956.1|         AKLSLSEEQLKELKKAEDSMYEVLEKALDKAMQLGEIQKGNPKFAAHAFVSLLSIGNFKD
RAAC01138                SQRALRPDQVDEMHRAEEQLVEVIAQELHAEMEQGRLRPVDAMFVARSYLALLGMGQAEI
                         ::  :*   :*:.:::.**:.: **: :  *.  *. *.:    :. *.*:::::**.:*: :

ref|NP_832103.1|         ENHNPILANIDELAQEIVSFYWNGL---
ref|NP_978750.1|         ENHNPILTNIDELAQEIVSFYWNGL---
ref|ZP_02215257.1|       ENDNPIIISIDELAQEIVSFYWNGL---
ref|NP_844783.1|         ENDNPIIISIDELAQEIVSFYWNGL---
ref|YP_894956.1|         ENDNPIIVSIDELAQEIVSFYWNGL---
RAAC01138                RRRGGGQAAIDEIAEEIVDLLWRGIEPR
                         ..  .       ***:*:***.:  *.*:
```

FIG. 103

```
ref|YP_001309939.1|       MDRRIEKSKQAIMGAFIKLMSEKDFEKITINEIAEEANVNRGTVYLHYEDKFDLMNKCID
ref|YP_001643723.1|       VDRRIIKSKEAIKNAFIELMAEKGFDKITVKDICSGADVGNRTFYLHYLDKFDLLDKLVI
RAAC00354                 MDRRVQKSRQAIRDAFVALMKEKDFDHITVQDITERANVSRKTFYLHFLDKYDLLDRVME
ref|YP_001647188.1|       -DPRVKRTRQLIQDAFVALVGEKGFENVTVQHIAERAPVNRATFYSHYHDKYDLLEKSIE
ref|NP_980994.1|          -DPRVKRTRQLIQDAFVALVGEKGFENVTVQHIAERAPVNRATFYSHYHDKYDLLDKSIE
ref|YP_079403.1|          -DRRVKRTKKMIRDALSELMKNKAFEEISVTDITKKADINRGTFYLHYEDKYDLLDQSEE
                           * *: :::: *  .*:    *:   :* *:.:::   .*   .  *   :...  *.*  *:  **:**:::

ref|YP_001309939.1|       THLNQLCD------SCISDGESSNFDSKA---SLLQTFQYLEKHAIFYSNMLTNKAMPAF
ref|YP_001643723.1|       ERIEALKT------LCAP---LHDLSFRE---ACIAWFENMEQHYFFFSTMLAGKGASAF
RAAC00354                 DAIRDMDEFG----QCVS-----ELDWVP---ATEQCFQYLADRYDFFGTMLTQAGAPYF
ref|YP_001647188.1|       EMLEKLAAVIKPQNRNKEDF-QLTFDSPH--PTFLALFEHIADNTNFYNVMLGDKAAGNY
ref|NP_980994.1|          EMLEKLTKVIKQKNRNKEDF-QLTFDSPH--PSFLALFEHIAENANFYNVMLGDKAAGNY
ref|YP_079403.1|          EIIQEINKIAKRSIHSMDVLNQDVIDHPL--TFVVDIFQYIKENEVFMKAVLGPKGPGSF
                                 :.                :.                *: :  ..  *     :*    :

ref|YP_001309939.1|       RERILTMALKSMEEHL-DMTGSNE--NISKNIMAQYVASAAVGVMEWWIVNSMPYPAAYM
ref|YP_001643723.1|       RKHFFDYIIEQIKDDVDIKEGINK--GFSEDMIITFFGSAIVGVVETYFMKGLPDPPEIV
RAAC00354                 RRRYVESCKASFTREIRRVVGRDP--LPEEDAILQFVVNAYVGTVEWWLQEGMPYPPRVM
ref|YP_001647188.1|       SYKMMKTIQTHLTLSLSISQPDDEDLMVPRDILISYVTGAHIGMIMSWLKRGMIYTPHFM
ref|NP_980994.1|          TYKMMKAIQTHLTLSLSISQPNDEKLMVPRDILISYVTGAHLGMIMSWLKKGMIYTPHFM
ref|YP_079403.1|          RLKF-KSVLISNLKRLKTAIRTDP--IVPEDYLISYITGAHISVMQQWLENGMKETPHDM
                              :                :             :            .: :  :..* :.:    ::  ..:    ..  :

ref|YP_001309939.1|       AEQLWQLLK------------------------
ref|YP_001643723.1|       AEQLGMLLD------------------------
RAAC00354                 ADRIGRMLESVYTQLPSLAEKPASPRETSQVRPA
ref|YP_001647188.1|       AMQLTRLI-------------------------
ref|NP_980994.1|          AMQLTRLI-------------------------
ref|YP_079403.1|          A--------------------------------
                          *
```

FIG. 104

```
ref|YP_036650.1|       ------------------------------------------------------------
ref|NP_844911.1|       ------------------------------------------------------------
ref|NP_978853.1|       ------------------------------------------------------------
ref|ZP_02256518.1|     ------------------------------------------------------------
ref|ZP_01173627.1|     ------------------------------------------------------------
RAAC02712              ----------MTGGVPHPSVSHLRDGVAECFLDG------------NLSKGEYPMSERMD ref|YP_036650.1|       -WLEELIAATNTDKRNERQMRILEAAVDMFGEKGYASTSTSEIAKRAGVAEGTIFRYYKT
ref|NP_844911.1|       -WLEELIAATNTDKRNERQMRILEAAVDMFGEKGYASTSTSEIAKRAGVAEGTIFRYYKT
ref|NP_978853.1|       -WLEELIAATNTDKRNERQMRILEAAVDMFGEKGYASTSTSEIAKRAGVAEGTIFRYYKT
ref|ZP_02256518.1|     -WLEELIAATNTDKRNQRQMRILEAAVDMFGEKGYASTSTSEIAKRAGVAEGTIFRYYKT
ref|ZP_01173627.1|     --------------LTEKQRSILLAAIQMFSEKGYSATSTNEIAKLAGVAEGTIFRHYKT
RAAC02712              QWLTELVRLNEDDRVTDRQLNILRAAVEVFAEKGFAAASTSEIAQRAGVAEGTIFRHYKT
                        .::*    ::*.*:::.*: ******:* ref|YP_036650.1|       KKDLLLAVVMPTLMKFAAPFFVQAFAKEIFKSEYESYEGLLRVVIHNRFDFAKKHFPMIK
ref|NP_844911.1|       KKDLLLAVVMPTLMKFAAPFFVQAFAKEIFKSEYESYEGLLRVVIHNRFDFAKKHFPMIK
ref|NP_978853.1|       KKDLLLAVVMPTLTKFAAPFFVQAFAKEIFKSEYESYEGLLRVVIHNRFEFAKKHFPMIK
ref|ZP_02256518.1|     KKDLLLAVVMPTLTKFAAPFFVQAFAKEIFKSEYESYEGLLRVVIHNRFEFAKKHFPMIK
ref|ZP_01173627.1|     KKDLLLAIVEPIMSDLVAPYLIQD-IEQVLKQRPIRYEDFLRSLLDNRIAFLKKNLPIVK
RAAC02712              KKDLLLSITVPVIDEFVGPFLLRD-LETILTAQHERFEDFLRAVLFNRLQFAKKYAQVLR
                       ******::.  *  :  .:..*:::     :  ::  .   :*.:** ::  ** : * **   :::

ref|YP_036650.1|       ILIQEVPFHPELKNEIQQLVETELLLHFKKLIEKFQEKGEIIE-MPPATVLRLTLSAVLG
ref|NP_844911.1|       ILIQEVPFHPELKNEIQQLVETELLLHFKKLIEKFQEKGKIIE-MPPATVLRLTLSAVFG
ref|NP_978853.1|       ILIQEVPFQPELKNEIQQLVETELLSHFKKLIEKFQEKGEIIE-MPPVTVLRLTLSAVLG
ref|ZP_02256518.1|     ILIQEVPFQPELKNEIQQLVETELLSHFKKLIAKFQEKGEIIE-MPPSSVLRLTLSAVLG
ref|ZP_01173627.1|     ILIQEIPFHPDLKKRFIEQIAEKVFQQFAKIVEYYQEQGQIISGIPPKSIVRMTFSALIG
RAAC02712              ILAQEIPFHPELKAQLKQYVTENVLKRLVGIIEHFQEKGEIAR-IPARTVIRLTVSVILS
                       ** **:**:*:**  .: : :   :::  ::  ::   :**:*:*    :*. :::*:*.*.:::

ref|YP_036650.1|       LLLTRFLLLPEEKWDDETEIENTIQFILYGLTP-------
ref|NP_844911.1|       LLLTRFLLLPEEKWDDETEIENTIQFILYGLTP-------
ref|NP_978853.1|       LLLTRFLLLPEEKWNDEAEIENTIQFILYGLTP-------
ref|ZP_02256518.1|     LLLTRFLLLPEEKWDDEVEIEHTIQFILFGLTP-------
ref|ZP_01173627.1|     HLAIRYLFLPEAQWDDEAEVERTIRFVMNGLSP-------
RAAC02712              HVVLRHILFHDAPWRDDEEIEMTVRFIVQGLRPDASRDQK
                       :   *.::: : *   *:  *:*  *::*::   ** *
```

FIG. 105

```
ref|ZP_02327699.1|    MTS----KKREKYQLILDAALKVFAEHGFHRSQVSKIAKAAGVADGTIYLYFKRKEDILI
RAAC01059             MTSGLAEKRREKYEAILKAALKMFAEHGFFNSQVSKIAREAGVADGTIYLYFKNKEDILI
ref|YP_001126706.1|   -------REKPKFKQIIDAAVVVIAEHGYHQAQVSKIAKQAGVADGTIYLYFKNKEDILI
ref|YP_148542.1|      -------REKPKFKQIIDAAVVVIAEHGYHQAQVSKIAKQAGVADGTIYLYFKNKEDILI
ref|NP_243968.1|      ----MGKKKGPKYDQIIDAAVQVIAEHGYHQAQVSKIAKAAGVADGTIYLYFNNKEDVLI
ref|YP_360433.1|      ----MAKKSIDKYEAILDAAAKIIGEVGYHKAQISKIAREANVAEGTIYLYFKNKQDLLL
                          *:. *:.**   ::.* *:...*:****: *.**:*******:.*:*:*:

ref|ZP_02327699.1|    SLFREKLGELVSKFNQSIETSTDMKQALYHICRIHYTELEQDVDLAFVTQIELRQSSLEL
RAAC01059             SLFREKLGSLVRKFHEHVHEDDRADEAIRKICELHFTELEKDVQLAKVTQLELRQSSREL
ref|YP_001126706.1|   SLFQEKMGSFIEKIEQEIEGISSPLEKLYVLVRTHFSALADDPHMAVVTQLELRQSNKEL
ref|YP_148542.1|      SLFQEKMGAFIEKIEQETEGISSPLEKLYVLVKTHFSALAADPHMAVVTQLELRQSNKEL
ref|NP_243968.1|      SLFQEKMGRFVDKIRSQMNEATDVEEKLKILVNMHFKQLAADHKLAIVTQLELRQSNTEL
ref|YP_360433.1|      SLFQKRYGEFISNLKVEIAAAKTPLDKLKKLITMHLENSEKDRNFAQVTQIELRQADRDL
                      ***::: *  ::  ::.        :  :   *     * .:* *:**:.  :* ref|ZP_02327699.1|    RREIGKAVKPYIVLIEQLLLKGIEEEVFRPDLDVKLTRSLIFGAMDEVVTSWLVSGRKYS
RAAC01059             HSEISKALKPYIQLIEDVLVRGIEQGIFRRDLDVKLTRLLIFGAMDEVVSSWLISGRRYS
ref|YP_001126706.1|   RQRINEVLKGYLRLIDSIIIEGMEKGEFRNDLDVRLTRQMIFGTIDETVTTWVMNEQKYD
ref|YP_148542.1|      RHRINEVLKGYLRLIDRIIMEGMEKGEFRQDLDVRLTRQMIFGTLDETVTTWVMNEQKYD
ref|NP_243968.1|      RLKINEVLKGYLNLLDELLMEGKEKGYFFQELDTRLARQMIFGTLDEVVTNWVMKDCKYD
ref|YP_360433.1|      RQKLSELLKDYFYIIESVIEEGKEQGIFRKDISTKVIRRMIFGTLDETVSSWLLSSRRYS
                      :  .:.: :* *: ::: ::  .* *:  *  :::..::  * :***::**.*:.*::.   .*.

ref|ZP_02327699.1|    LSDQVEGTVQFFLRGI--
RAAC01059             LSAQVDKTVDFFLRGLRA
ref|YP_001126706.1|   LAALAEPVYELLAKGCAA
ref|YP_148542.1|      LAALADPVYELLVKGCAA
ref|NP_243968.1|      LTALVKPVHQLLLGGLR-
ref|YP_360433.1|      LAKLSDDVFQLFCYGI--
                      *:    . . ::: *
```

FIG. 106

```
ref|YP_076316.1|       -----------MGRNRRREAMLQAAIGLFSDKGYHATTVREIAQAVGILPGSLYAHMASK
RAAC01638              MLSGSAGGETRMPRPSQKDQILAAARRLFSEKGYHGTTIREIAVEAGVLSGSLYAHIESK
ref|YP_603589.1|       ---------PAKTR---REQIYDVASRLFSERGYHATSMRDLAGELGMQGGSLYAHISGK
ref|NP_296097.1|       --------ETTKPR---REQIHDVASRLFSERGYHATSMRDLAGQLGMQGGSLYAHISGK
ref|YP_004584.1|       -------------R---RSQILTIAGHLFSRKGYHATSMRELARHLNLQGGSLYAHIQSK
ref|YP_144239.1|       -------------R---RSQILTIAGHLFSQRGYHATSMRELARHLNLQGGSLYAHIQSK
                                    *   :  :   *   * :*.*::*::*   .:  ******: .* ref|YP_076316.1|       EDLLYEAVVQASERFQEAVAPIAESPGHAGERLRQAMAAHIRVVAESPAAATVFLHEWRA
RAAC01638              EDLLFEIADEGAEAFLLAARAVESKWQHPVDRLREGLRAHIRVVADKQESAKVFFHEWRA
ref|YP_603589.1|       EDLLIEIVNRAARQFDAALFTLRDDPRPADHKLREAMYRHIRVVADNMESATVFFHEWKH
ref|NP_296097.1|       EELLVEIVRGASQQFDEALFSLRDVNLPADEKLREAMFRHIQVVADNMDSATVFFHEWKH
ref|YP_004584.1|       EELLLEVVRQAAERFQKVLEELPSG--DPVTRMKALVKGHLRVIAEELPRATVFFHEWKH
ref|YP_144239.1|       EELLLEVVRQAAERFQKVLEELPSG--DPVTRMKALVKGHLRVIAEELPRATVFFHEWKH
                       *:** *    .:: *    .  :   .     :::   :   *:: *:*:.    *.**:***:

ref|YP_076316.1|       LSPQRRAMAVAHRRAYEELLARIIREGVESGVFRPVD-EKFVRLLVLSAVNWTYQWYRAD
RAAC01638              LSDDRRKVIQSKRDRYEAHWRKWIEEGMAQGAVRKAD-PKFVRLCLLSVANWVYQWYRPG
ref|YP_603589.1|       LSPAAYARVTAWRDTIDTFYRELVRQGIDEGLFRHDLDVKMTANLILSAVNWTYTWYRPG
ref|NP_296097.1|       LSAEPYAQVVAWRDTIDIFYRDLVAQGVRDGTFRADLDVRAAANLILSAVNWTYTWYRPG
ref|YP_004584.1|       LSPPLLEEAKALRRRYEEGVQAVVEEGVRAGVFRVEN-VRLATLFVLSALNWTYQWYRPD
ref|YP_144239.1|       LSPPLLEEAKALRRRYEEGVQAVVEEGVRAGVFRVEN-VRLATLFVLSALNWTYQWYRPD
                       **         : *    :      : :*:  * .*      : .   :**.**.* ***..

ref|YP_076316.1|       GPLSPEQVADQFYAIIAGGL---------------
RAAC01638              GEFTPEDIAEHFWTLLFNGIGTGQPAACELLGEA
ref|YP_603589.1|       GTLTPRDVAEGYADMLLGGL---------------
ref|NP_296097.1|       GRLSPRDVAEQFADMLLSGLMAGE----------
ref|YP_004584.1|       GPLSLEALAEAYAELVLKALG-------------
ref|YP_144239.1|       GPLSLEALAEAYAELVLKALG-------------
                       *  :: . :*:  :   ::      ..:
```

FIG. 107

```
ref|YP_148132.1|         ----RILVVDDEERIRRLLKMYLERENYVIDEAGDGNEALEKALTNDYDVILLDLMLPGK
ref|YP_001126301.1|      -----ILVVDDEERIRRLLKMYLERENYVIDEAGDGNVALEKALANDYDVILLDLMLPGK
ref|NP_242446.1|         --EAKILVVDDEDRIRNLLKMYLEREAYDVEEASDGKEALEKALAFDYDVILLDLMMPEM
ref|YP_175331.1|         -----LLVVDDEERIRRLLRMYLEREEYQIEEASNGEEALELALAKEYDLILLDVMMPGM
ref|ZP_02330236.1|       -----ILVVDDEERIRRLLRMYLEKEGYDIEESQDGETALKLAMDKDYDLILLDIMLPGM
RAAC02161                MAQTRILVVDDEERIRRLVRMYLERNGFEVDEAADGKEALHKALNQAYALIILDLMLPGM
                              :****:*.*::****::  : ::*: :*: **. *:   * :*:**:*:* ref|YP_148132.1|         DGIEVCKEIRAQKTTPIMMLTAKGEESNRVQGFEVGTDDYIVKPFSPREVVLRVKALLRR
ref|YP_001126301.1|      DGIEVCKEIREHKTTPIIMLTAKGEESNRVQGFEVGTDDYIVKPFSPREVVLRVKALLRR
ref|NP_242446.1|         DGIEVCQKLRKQKATPIIMLTAKGEEANRVQGFEVGTDDYIVKPFSPREVVLRVKALLRR
ref|YP_175331.1|         DGVEMCQELRKKKATPVMMLTAKGEEANRVQGFEVGADDYIVKPFSPREVVLRVKALLRR
ref|ZP_02330236.1|       DGTEVCARLRQFKTTPVIMLTAKGEETNRVHGFEVGADDYVVKPFSPREVIYRVKAILRR
RAAC02161                DGRDVCAQIRQHSNVPIMMLTAAGDEANRVHGFELGADDYVVKPFSPRELVLRVKAMLKR
                         **  ::*  .:*    .*::**** *:*:* *:*:*:****::  **:*:* ref|YP_148132.1|         AANAAYAPVETTAKDVLVFPHLTIDNDAHRVTVDGKEVSLTPKEYELLLFLARSPDKVFD
ref|YP_001126301.1|      AANATYAPVETTTKDVLVFPHLTIDNDAHRVTVDGKEVSLTPKEYELLLFLARSPDKVFD
ref|NP_242446.1|         SSSTKFLQTDTQAKDVLVFPHLSIDNDAHRVTVADQEINLTPKEYELLYYLAQSPDKVFS
ref|YP_175331.1|         ASATKFLQTDTQTKDVLVFGPLTIDNDAHRVTVDKTEISLTPKEYELLFYLAQSPDKVFS
ref|ZP_02330236.1|       SSATAFLSKDSNSSNNIVFPHLVIEHDAHRVTAGGQEVALTPKEYELLHYLAVSPDKVFS
RAAC02161                TGEMEYAR---NAIQTLTFPGLEIQIDARRVEVNGQEVNLTPKEFDLLVYMAQRPDKVFS
                         :.     :       :    :   ::.*   * *: **:** .   *: *****::** ::*   *****.

ref|YP_148132.1|         REQLLKEVWHYEFFGDLRTVDTHIKRLREKLNKASPQAGKMIVTVWGVGYKFEAVS
ref|YP_001126301.1|      REQLLKEVWHYEFFGDLRTVDTHIKRLREKLNKASPQAGKMIVTVWGVGYKFEAVS
ref|NP_242446.1|         REQLLKDVWNYDFFGDLRTVDTHIKRLREKLNRVSPQAASMISTVWGVGYKFEV--
ref|YP_175331.1|         REQLLKDVWNYEFFGDLRTVDTHVKRLREKLNRVSPEVAAIISTVWGVGYKFE---
ref|ZP_02330236.1|       REELLKDVWNYEFFGDLRTVDTHVKRLREKLNKVSPEAAVMITTVWGVGYKLEV--
RAAC02161                REELLRDVWNYQFFGDQRTVDTHIKRLREKLGQASPEVSRYIVTVWGVGYKFEVAS
                         **:**::**:*:**** ******:*******.::**:..  * ********:*
```

FIG. 108

```
ref|YP_001213400.1|        -------EILELLEGNARLTPGQIATMLGMEEGEVTRIIKEMEEKKVILGYYTLVNWEKA
ref|YP_001114520.1|        ------LEILELLQSNSRLTAKEIAVLTGQEEDEVKGIIERLEADKTIIKYFTLINWEKA
ref|YP_358986.1|           -------EILQLLHENAKLTPKQIATMLGVTEKEVRAKIKELEERKAIIKYHTLINWEKT
ref|YP_430046.1|           ----MRKKILDLLENNGRLTAKEIAIMLALPVDQVAKEIAAMEQEKIILRYHTLINWEKA
RAAC00349                  MNDALRLKICDLLHENAKLSAETIARMLGETPDVIESTIRELEEEKVILRYSAVVNWDKL
ref|ZP_02330078.1|         --DDFKLKVLELLKEDARRGSDLIATMLGANEEQVAKAIKEMEEENIIVKYATVLNWAKV
                              :: :. :.:  .    : .     :   *   :*   : *: * :::** * ref|YP_001213400.1|        GEEKVSALIEVKISPQREVGFDAVAERIYRFPEVKTVRLMSGAYDLAVMVEGQNLKEVAN
ref|YP_001114520.1|        GLEKVSALIEVKMSPQRDVGFDSVAERIYRFPEVKSVHLMSGAYDLAVFLEGATMKEVAL
ref|YP_358986.1|           EYEPVMALIEVKVTPQREVGFDGIARRIYQFAEVKDVYLMSGDYDLAVMVEGSSMKEVAL
ref|YP_430046.1|           GEEEVAALIDVKVIPQRDLGFDEIASRIYRYPEVKSVFLMSGGYDLSVLVQGKSLKEVAS
RAAC00349                  PVNQVTAVIDVKVLPQREVGFDAIARKIYRFDEVKSVALMSGGYDLQVTVVGRDLREVSR
ref|ZP_02330078.1|         DSDKVTALIEVQITPERGTGFDAIAERIYLFPEVKAVYLMSGSYDLQVEIEGRTLQEVSS
                                  :  *  *:*:*:: *:*   *** :*  :** :  *** * **** *** *  :  *    ::**:

ref|YP_001213400.1|        FVAQKLASLDNVLSTTTHFVLKTYKNQGVIVEDGEEDRRLVVTP
ref|YP_001114520.1|        FVAQKLATIDNVLSTATHFVLKTYKQDGFIFEDRENDQRLVIQP
ref|YP_358986.1|           FVALKLSTIEGVQSCATHFILKTYKHEGVILDDEEEDRRLVITP
ref|YP_430046.1|           FVSQKLATLEHVQSTMTHFILKRYKQDGVIFEDQEADRRQALQP
RAAC00349                  FVSEKLATLENVTSTATHFLLKTYKSDGVIYDDTDGERRLMITP
ref|ZP_02330078.1|         FVSTKLSTLDRVLSTKTHFILKKYKHDGIIFEDHEDDHRMLISP
                           **: **::::  *  *   ***:** **  :*.*  :*   : ::*   : *
```

FIG. 109

```
ref|YP_001634921.1|      ----------MELRHLRYFEAVARHSHVTRAAAELHIAQPALSKQISQLERELGITLFDR
ref|YP_290510.1|         ----------MQLQQLAYFLAVAETRHFTRAAELSRVAQPSLSKQIKALEEELGAPLFVR
RAAC01375                MNTRRIGRMRMELVQLEYFLAVAEYQSFRRAADAIRVSQPALSRAIQKLEGDLGAPLFVR
ref|YP_079987.1|         ----------MELYQIDHFIAVSRHKHFTKAALEQRISQPALSRSIKKLEEELGVPLFIR
ref|YP_001422015.1|      ----------MELHQIDNFIAAAAHQHFTNAAKERMISQPALSRSIIRLEEELGAPLFFR
ref|YP_001423330.1|      ----------MDWHQINYFQTVAQVQHITQAAKQLSISQPALSRSISKLEDELGVQLFDR
                                   *:  ::  *  :.:    . .     :::**: *   : ** * ref|YP_001634921.1|      VGRSLRLTEAGEALLPYARAILAQVEEARAAMAERIGLKAGRVTIGAPPTVGAHLLPPLL
ref|YP_290510.1|         ARGNITLTPAGEILLPLAQRILADVETARREIQELAGMRRGWVRLGATPSLCAGLLADAL
RAAC01375                TAQGVRLTPCGEAFLPHARQALAEVAAGARKVAELAGQARGVLHVGLIYSLGTRFLPDVI
ref|YP_079987.1|         KTKSIRLTKYGEQFLIKAKQARLALDEGVQQIRESVNPNAGEISVSFLHTLGSRLMPQLI
ref|YP_001422015.1|      DTKAVRLTRHGEQFLIKAKQARRALNEGVEQVKKNMSLEHGEISVSFLHTLGLRLMPQLI
ref|YP_001423330.1|      KGRNIYLNRYGKMFLHRVEQSIRQIEIGKQEVWNEIHPNSGTILLSFLPSLGMSMVPDVI
                              : *.  *: :*   ..    :       : :      * : :.   ::    ::.   :

ref|YP_001634921.1|      TIFHQRYPGITLRLHEAGIQSLLDLLEAGITDLAVVALPVT--DEQLTVTPLLNEPLVLI
ref|YP_290510.1|         VRFHERYPGIELHVEEGGSRDLIRALGGGELDLALIILPLHSSDPAFVTVPILRESLVVA
RAAC01375                RTFTRTHPGVTVRLSEAPTQKLLQQLDAGEIDIAFCT-PQH--APHLTLVEILQEELVAI
ref|YP_079987.1|         AEFKKKYPNVAFRLYQAANEHLQHMVETGEADICLSSPPLP--NEHLEWTVLDTEPLYLV
ref|YP_001422015.1|      AEFKKLYPNVTFRLYQGANETLRKMVETGDADICLSSPPLP--SELLQWTVLEKEPLYAV
ref|YP_001423330.1|      SSFQHMYPHVNFQLTQASNQQIIEQLTSREVDIALTSLRDE--NDDVICQPLLTEELYLA
                          *  .:* :  .:: :.  . :    :      *:..       .   : * * ref|YP_001634921.1|      VSTTHPLARRSEVM-MTELRHERWILSPSSYELREATLKACREAGFTPQTVLEGGETETL
ref|YP_290510.1|         SPISQPPPTNGGAMRITDLRDQPLVMFRRGYDVRETTLSACRAAGFEPRLAVEGGEMDAV
RAAC01375                VPLDHPLAAKDQCH-LSDLAGEPFVAYARESGIRHVIERYCAEAGFTPRVAMEGVEDLTV
ref|YP_079987.1|         LPADHPLADRKEVA-IRSIAHEDFVCFKPGYGLRYVFDQMCRDLNIHPHLAFEGEEVSTI
ref|YP_001422015.1|      LPENHPLAGNKSIQ-MKEMQDEDFVGFKPGYGLRYMFDLMCRDLNIHPHLAFEGEEVSTI
ref|YP_001423330.1|      VSAEHPLASYDEID-LKMAEHEPFISFKDTNVLHGMIKELCEKAGFSPDVVFEGEDIVTA
                          . :*  .        :   :   :       ::       * .: *  ..**  :  :

ref|YP_001634921.1|      VRFVAAGLGVSLVPALAVAGCTDVVRLTVSDQHLTRSLGLVWRSDRTASPAARALREFL-
ref|YP_290510.1|         LRFVEAGLGLAVVPSMVLRNRPGLRGTPLAEPRLLRTIALAHRKDVALSRTARAF-----
RAAC01375                AGLVAAGVGVAVVPLHAQLDQLPVHVLRLCEP-CKRSVYMAWHTHTTLSPVARAFIAFVK
ref|YP_079987.1|         LGLVSAGLGVAILPKTAEHVHSPVAFCRVSDYRSERTIGLAVLKDHYLSPAARNFKEFV-
ref|YP_001422015.1|      LGLTAAGLGAAVLPKTAEHSYFPVVFLPVADYQCERTIALAQLKNHALSPAAERFKQF--
ref|YP_001423330.1|      SGLVGAKLGVSLIPDLHVFDKTKVKLLSVTNPICEREIGLAWRKDGYLSPAAENFIAFIQ
                          ::. *  :* :::*            :  :    * : :.   ..    * .*. :

ref|YP_001634921.1|      -----
ref|YP_290510.1|         -----
RAAC01375                RMCAP
ref|YP_079987.1|         -----
ref|YP_001422015.1|      -----
ref|YP_001423330.1|      -----
```

FIG. 110

```
ref|ZP_02255842.1|        -------LKIFVTVVEQKHFSRAAELLNLSQPGVSMHIRNLENEFGTTLIQRSPKHVQVT
ref|YP_897365.1|          -------LKIFVTVVEQKHFSRAAELLNLSQPGVSMHIRNLENEFGTTLIQRSPKHVQVT
ref|NP_981573.1|          -------LKIFVTVVEQKHFSRAAELLNLSQPGVSMHIRNLENEFGTTLIQRSPKHVQVT
ref|YP_001647744.1|       -------LKIFVTVVEQKHFSRAAELLNLSQPGVSMHIRNLENEFGTTLIQRSPKHVQVT
ref|YP_146744.1|          ---MDQLLYVFVKVVEKGNFTKAAEELHMTQPAVSQHIQTLERLFDTKLLDRTNKYVKLN
RAAC00013                 MKRVDLQLRVFVTVVEENSFTRAAEKLHISQPAISQHVQTLEQRLGVRLIDRGRRRLQVN
                                 * :**.***:  *::*** *:::**.:* *::.**. :.. *::*  : :::.

ref|ZP_02255842.1|        EAGNILYIHAKQMLSLYEDAKQEINELHNVVTGTLRIGASFTIGEYLLPKILANYANENP
ref|YP_897365.1|          EAGNILYIHAKQMLSLYEDAKQKINELHNVVTGTLRIGASFTIGEYLLPKILANYANENP
ref|NP_981573.1|          EAGNILYIHAKQMLSLYEDAKQEINELHNVVTGTLRIGASFTIGEYLLPKILANYANENP
ref|YP_001647744.1|       EAGNILYIHAKQMLSLYEDAKQEINALHNVVTGTLRIGASFTIGEYLLPKILARFANENA
ref|YP_146744.1|          KAGEIVYHYAKEILGLYTRMNQLLDDLMNRASGELSIGASYTYGEYVLPQMIAKLHQHYP
RAAC00013                 PAGRIVYEHAKEILALYRRMERLIADMQEMPAGPVHVGASLTYGEYVLPHVIARFRKAYP
                           **.*:*  :**::*.**    ::   :  :    :* : :***  * ***:**.::*.   :  .

ref|ZP_02255842.1|        RVEVHTFISNTEDVLQSLRSNQIDIGLVEGQVVYADVDVET-FMQDEMKLVVPPNHPLLR
ref|YP_897365.1|          HVEVHTFISNTEDVLQSLRSNQIDIGLVEGQVVYADVDVET-FMQDEMKLVVPPNHPLLR
ref|NP_981573.1|          RVEVHTFISNTEDVLQSLRSNQIDIGLVEGQVVYADVDVET-FMQDEMKLVVPPNHPLLD
ref|YP_001647744.1|       HVEVHTFISNTEEVLQSLRSNQIDIGLVEGQVVYADVDVET-FMQDEMKLVVPPNHPLLH
ref|YP_146744.1|          LIKPTITIGNSNEIVEMVRDHQLDVGIIE-MDIEPKNVYIEPFAKDQMVVASAHHPYAQ
RAAC00013                 AVQPSVSIANTQTIAHAVAVRQLDIGIVEGQDVVEDEVVLTPFAEDEMLVVASPASPWYA
                           ::      *.*::   . :   .*:*:*::*    :        * :*:*  :*... * ref|ZP_02255842.1|        TNEINERTLQDQ-VWVLRESGSGTRAYSDRFIHQHHLKMKRFFTFSSIQSVKEAVAAGLG
ref|YP_897365.1|          TNEMNESTLQDQ-VWVLRESGSGTRAYSDRFIHQHHLKMKRFFTFSSIQSVKEAVSAGLG
ref|NP_981573.1|          TKEVNERTLQDQ-VWVLRESGSGTRAYSDRFIHQHHLKMKRFFTFSSIQSVKEAVAAGLG
ref|YP_001647744.1|       IKGINENTLQDQ-VWVLRESGSGTRAYSDRFIHQHHLKMKRFFTFSSIQSVKEAVAAGLG
ref|YP_146744.1|          KETVQMEDLCNA-TWIVRETGSGTRKATDEFFLKHNFFPSSIMEFGSTQLIKEAVEAGLG
RAAC00013                 -EAPDRSLLERA-TWFIREPGSGTREMTDRLFTQLGIQPRDLVEYTSSQVIKESVAAGLG
                            :   :    *    .*.:.***  :*.:: :  :    :. * * :**:* **** ref|ZP_02255842.1|        IAILSDWTVRKELLAKELFHVEVPDEQLIRPFSIVRGKYFIPSKA---------------
ref|YP_897365.1|          IAILSDWTVRKELLAKELFHVEVPNEQLIRPFSIVRGKYFIPSKA---------------
ref|NP_981573.1|          IAILSDWTVRKELLAKELFHVEVPNEQLIRPFSIVRGKYFIPSKA---------------
ref|YP_001647744.1|       IAILSDWTVRKELLAKELFHIPVPNEELIRPFSIVRGKYFIPSKA---------------
ref|YP_146744.1|          LTFLSLWTIKKELSFGTLKIIPINDEPFFRHFSLVTPKTPFYTKAMEVFLTIVRTHQPSI
RAAC00013                 LACLSRWVVARELAWGMLRTLPICAPVKRTFSIVTPKSAFETKASKLLYSFLMEHGSPE
                           ::  ** *.:  :**      *   : :   . * **:*   *   :  :**

ref|ZP_02255842.1|        --------
ref|YP_897365.1|          --------
ref|NP_981573.1|          --------
ref|YP_001647744.1|       --------
ref|YP_146744.1|          SHSPQPPS
RAAC00013                 NPSLAGE-
```

FIG. 111

```
ref|YP_075596.1|         ---------------LLQHLTTFCRVVEEGSFTRAAQVLNLTQPSVTKQVGALEDYLQVQ
ref|YP_478499.1|         ------------------------IAQQGSFRRAADSLFVSQPAVSLQVQNLERQLGVV
ref|YP_430668.1|         -------------------LITFITTVEKGTLSAAAEELHLTQPAVSKQLQALEDYFGLR
ref|YP_001668480.1|      ----------------EQLITFATVAEHGNISHAAQALHLSQPAVSGQLKLLQEAFGEP
RAAC01493                MICIIFMLNLYGVMDMFEALRALVTVVSLGSVSEAARALHVTQPTVTRQIQQLERHFGQA
ref|YP_590553.1|         ---------------FDQLLTFLEVAKLGNFSRAGEKVYRSQSAVSAQIRQLEQEYGER
                                         .. *.. *.  :  :*.:*: *: *:

ref|YP_075596.1|         LFTRQGKRVHLTPVGELVYDYA-RQVIHLVQRCEEAVREYRSPGSGSVTVGCVHTIGLFT
ref|YP_478499.1|         LFDRSGRKVELTDAGKVVLQYS-ERILKLCREAVEALADLQKMEGGHLVLGASQTVGTYV
ref|YP_430668.1|         LLERRGREVRLTAAGEICYRHA-RIIASHLNQTRRELAELTQLVRGRLLLGASTTPGQYI
ref|YP_001668480.1|      LYQRAGRGVRLTAAGEQLLAHA-ERLRETFRQAQALREAMRGLERGTLRIGASTTPASYL
RAAC01493                LFDRSGKRLALTPAGERVHAYALEVLRKQE-ELAESLLEMSNPEAGLVRMGAGLSPTLYR
ref|YP_590553.1|         LFDRSGKIVRLSPAGEVLLEYA-QRMVALRNESLRAVADQGETPRGVLSIGANEATCLYV
                          *  *  *:  : *:  .*:        ::  . :          *  :  :*.  :    :

ref|YP_075596.1|         LPELLAAYVREHPRVK---INVKTGNNRETVTMLLHGEVDVGLVT--TPQVHER-IEVVP
ref|YP_478499.1|         MPSLIAQYHRRYPQIS---VQLLVQSTRRIAQKLVDGQLDVAIVGGEIPFELQRHLKVMA
ref|YP_430668.1|         LPRLIGAFRREYPRV---EVILTIADTQEVVQRLQEGEIDLGVVGAAGGRGKNLSYSRLA
ref|YP_001668480.1|      LPYLIADFHARHPEV---LVTTSHGNTAEIVAALDS--VDIALIEGPPGQELPLGTAVTA
RAAC01493                LPAMVARYASMHPRVR---FQVVTGSSKVTLERLASRVVDLAIVTTPPEDE--AGVEQVA
ref|YP_590553.1|         LPDIFTEYCQQFPQVQ---ITVYRNFSRKILQAVEDGVIDLGIAT--LPVKSPS-LKVHP
                         :* :.   :   .*.:   .          :      : :*:..       .

ref|YP_075596.1|         LFEDPLVVVAGPSFAADLPPVVSNADLAQLPFIG-YVRGARFRMTTDQVLEEMGIQPQF-
ref|YP_478499.1|         LAEDEYVLVGAPGCAI---DSPALVDLLALPFIT-LDPQSSTRQTIDRVLNRHGINPAQL
ref|YP_430668.1|         G--DELVLIVPPGHRLAGATAISPGELKEEPLVW-RESGSGTRRVVEERLAAAGFTVDPE
ref|YP_001668480.1|      WREDEIVAIVPSGHPLAGSDQQALASLGAYPLVL-RESGSGVRQIVERAFARDGVAMRV-
RAAC01493                LWRDELVAVAPSYHALAG-KRATIVELAQYPLVV-MHGESGLRRQIDDLLHRAGVERPAP
ref|YP_590553.1|         IFRDRLELMVPVRHPLAAKESVTIEEIAEYPQI--FPKTGYTRQQLDKLFRP---YNSKL
                                 *          :      :  .:   *:       .    *    :   :

ref|YP_075596.1|         --VMEFDNHEAIKTMVALGFGIALEPVSAVQRELISGQLVRLNVPGLPRLSRTTSLILRR
ref|YP_478499.1|         NVRLELSSIEAIKNAVQAGLGVAFLSTVAVGSDVEQGRFRKLAVEGLQI-RRTLWLAFNP
ref|YP_430668.1|         QIVMELGSTEAIVSAVEAGLGISLVTSWAVEKSVKLGRLAVVTLQGVDL-KRDLYLVRRR
ref|YP_001668480.1|      --ALEIAGVEGVKEAVRAGMGV--------------------------------------
RAAC01493                P-VMETDSLEAMNRFVQAGLGLAVVPWPAVADDVTQGRLKLVHIVGCDLGQRTVTLVWRK
ref|YP_590553.1|         RVAMEIPSVGLIKSFVVSGVGVTLLSSTFAQDEVRAGKAKMLPIAGVDM-WRELGLIYRN
                           :*     .    :      *   *.*:

ref|YP_075596.1|         GERRSEAVRAFLSLL-------------
ref|YP_478499.1|         ERYQSQAATRFLQGL-------------
ref|YP_430668.1|         QPLSP-AAEAFVNFAA------------
ref|YP_001668480.1|      ----------------------------
RAAC01493                ESHIPAAARAFIEWLASVGAASSSELR
ref|YP_590553.1|         DRTLPRSATAFIDLMRHRPVAKKSK--
```

FIG. 112

```
ref|YP_896056.1|              --------------------------------------------------ELRHLQYFV
ref|NP_845992.1|              --------------------------------------------------ELRHLQYFV
ref|ZP_02254866.1|            --------------------------------------------------ELRHLQYFV
ref|ZP_00743391.1|            --------------------------------------------------ELRHLQYFV
ref|YP_001375561.1|           --------------------------------------------------ELRHLQYFI
RAAC01653                     -------------------------------------------------MDTELRQLEYFV
                                                                                ***:*:**:

ref|YP_896056.1|              VVAEELHFGRAAARLQMTQPPLSQQIQQLEKEMGVMLFSRTKRKVELTEAGEMFLKEVKK
ref|NP_845992.1|              VVAEELHFGRAAARLQMTQPPLSQQIQQLEKEMGVMLFSRTKRKVELTEAGEMFLKEVKK
ref|ZP_02254866.1|            VVAEELHFGRAAARLQMTQPPLSQQIQQLEKEMGVMLFSRTKRKVELTEAGEMFLKEVKK
ref|ZP_00743391.1|            VVAEELHFGRAAARLQMTQPPLSQQIQQLEKEMGVTLFSRTKRKVELTEAGEMFLKEVKK
ref|YP_001375561.1|           VVAEELHFGRAAARLQMTQPPLSQQIQQLEQEMGVMLFERTKRKVELTEAGEMFLKEVKK
RAAC01653                     AVAEELHFGRAAKRLGLTQPPLSQQIQKLEDEIGVTLFDRTNRRVQLTHAGRVLLEEARK
                              .******** .:********:.*: .**:*:...::*:*..* ref|YP_896056.1|              AFEQIEKAVEIAQSAQRGEVGSLSIGFVGAAIYDILPSIVREYRKKFPRVSVALHELSTP
ref|NP_845992.1|              AFEQIEKAVEIAQSAQRGEVGSLSIGFVGAAIYDILPSIVREYRKKFPRVSVALHELSTP
ref|ZP_02254866.1|            AFEQIEKAVEIAQSAQRGEVGSLSIGFVGAAIYDILPSIVREYRKKFPRVSVALHELSTP
ref|ZP_00743391.1|            AFEQIEKAVEVAQSAQRGEVGSLSIGFVGAAIYDILPSIVREYRKKFPRVSVALHELSTP
ref|YP_001375561.1|           AFDQIEKAVEVAQSAQRGEVGSLSIGFVGAAIYDILPSIVREYRKKFPRVSVALHELSTP
RAAC01653                     VLAHVQTAVKAARDAAAGRVGRLSVAFVGSATYGWLPEVIRAYQERHPDVELVLREMSTP
                              .: :::.**: *:.*  *. :.***:* *. **.::* *:::.* *.::*:*:*** ref|YP_896056.1|              DQVHALHDNRIDIGFLRPPIPTQLLELEPIQKLSCTLCLPKAHPLAEKDEIHIEDLRDEP
ref|NP_845992.1|              DQVHALHDNRIDIGFLRPPIPTQLLELEPIQKLSCTLCLPKAHPLAEKDEIHIEDLRDEP
ref|ZP_02254866.1|            DQVHALHDNRIDIGFLRPPIPTQLLELEPIQKLSCTLCLPKAHPLAEKDEIHIEDLRDEP
ref|ZP_00743391.1|            DQVHALHDNRIDIGFLRPPIPTQLLELEPIQRLSCTLCLPKAHPLAEKDEIHIEDLRDEP
ref|YP_001375561.1|           EQVHALHENRIDVGFLRPPISTQLLELEPIQKLPCTLCLPKAHPLAEKEEIHIEDLRDES
RAAC01653                     AQMEALTAGELDVGVLRLPAQHPDLHVRLVERDDCVAVVPSEHPLATRSSLFLVELAEEP
                               *:.**  ..:*:*.** *    *.:. :::  *.  :*. ****  :....: :* :*.

ref|YP_896056.1|              FVFITRPVWPALYDTILSLCREVGFSPRIVQEATEYQTVMGLVAAGIGITVIPVSANKLY
ref|NP_845992.1|              FVFITRPVWPALYDTILSLCREVGFSPRIVQEATEYQTVMGLVAAGIGITVIPVSANKLY
ref|ZP_02254866.1|            FVFITRPVWPALYDTILSLCRDVGFSPRIVQEATEYQTVMGLVAAGIGITVIPVSANKLY
ref|ZP_00743391.1|            FVFITRPVWPALYDTILSLCREVGFSPRIVQEATEYQTVMGLVAAGIGITVIPVSANKLY
ref|YP_001375561.1|           FVFITRPVWPALYDTILSLCRGVGFSPRIVQEATEYQTVMGLVAAGIGITVIPVSANKLY
RAAC01653                     FVLVSRAIWPGLYDGFITLARALGFEPRVRLEVTEVQTAVGLVAAGLGVSIVPSATERVH
                              **::: *.:**.***  :::*.* :** **.**:   *.** **.:******:*:::::*  ::::::

ref|YP_896056.1|              KTEVVYKELYDSNFVAEMSVAYKKMNSNPELLEFLKIA--------
ref|NP_845992.1|              KTEVVYKELYDSNFVAEMSVAYKKMNSNPELLEFLKIA--------
ref|ZP_02254866.1|            KTEVVYKELYDSNFVAEMSVAYKKMNSNPELLEFLKIA--------
ref|ZP_00743391.1|            KTEVVYKELYDSNFVAEMSVAYKKMNSNPELLEFLKIA--------
ref|YP_001375561.1|           KTEVVYKDIYDSNFIAEMSVAYRKTNSSPELLEFLKIA--------
RAAC01653                     RRDVRYLHIDGQSPTVELGVAWRRRDTSPLVAAFLAMAESVRPGLS
                              : :*  *  .: ...  .*:.**:::  ::.*  :   ** :*
```

FIG. 113

```
ref|YP_001210836.1|      ---EEKVDGNLLKVLRSLAPGTHLREGLENILRAKAGALIVIGDTPEVMEIAEGGFAINA
ref|YP_001111557.1|      MVKDEKIEDKLIKLLRLVAPGTPLREGLENILRAKTGALIVIGDIPEVMELAEGGFAINA
RAAC00430                MKDDAKREAAINKILRMVAPGTVLREGIENILRAKTGGLIVVGATETVLSMMDGGFAIQC
ref|YP_001485333.1|      ------RELDLLDIVQFVAPGTPLRAGIENVLRANTGGLIVVGYNDKVKSVVDGGFHINS
ref|NP_387969.1|         -KKGAKHELDLSSILQFVAPGTPLRAGMENVLRANTGGLIVVGYNDKVKEVVDGGFHINT
ref|NP_240971.1|         --DSEVKERFARNILKMVAPGTALRTGIDNVLRAKTGGLIVLGYNENMKGIVDGGFYLDC
                                 .::: :****.** *::*:***::*.***:*    :  : :** ::

ref|YP_001210836.1|      DFTPSSLYELAKMDGAIILSKDAKKILAANTQLVPNQNIPSAETGIRHRTAERVAKQTGA
ref|YP_001111557.1|      DFTPAGLYELAKMDGAIILSEDAKKIIAANTQLIPDLIIPSSETGIRHRTAERVAKQCDM
RAAC00430                DLTPSHLYELAKMDGAIIISEDAKKVHYANTTLNPDHTIPTSETGTRHRTAERVARQSGQ
ref|YP_001485333.1|      AFSPAHLYELAKMDGAIILSDSGQKILYANTQLMPDATIHSSETGMRHRTAERVAKQTGC
ref|NP_387969.1|         AFSPAHLYELAKMDGAIILSDSGQKILYANTQLMPDATISSSETGMRHRTAERVAKQTGC
ref|NP_240971.1|         PFSPASLYELAKMDGAIILNEDGTKILYANTQLNPDNAISSNETGIRHRTAERVAKQTGN
                           ::*: ***********:.... *:   *** * *:  * : *** *********:* .

ref|YP_001210836.1|      LVIAISQRRGVITIYKGASKYVLRDIGVILSKANQAIQTLEKYRTVLDKVLVELSVLEFE
ref|YP_001111557.1|      PVISISQRRSVITVYKGSIKYFLRDISVILAKANQAVQTLEKYRSVSDRVINELSMMELQ
RAAC00430                LVICISQRRNVITLYQGNLKYVLRDISVILAKANQALQTLEKYKTVLEQELTDLSALEFE
ref|YP_001485333.1|      LIIAISERRNVITLYQGNRRYTLKDIGFILTKANQAIQTLEKYKTILDHAISALSALEFE
ref|NP_387969.1|         LVIAISERRNVITLYQENMKYTLKDIGFILTKANQAIQTLEKYKTILDKTINALNALEFE
ref|NP_240971.1|         LVISISQRRNVITLYHGHLRYALRDIGVILTKANQAIQTLDKYKSVLDQDITDLGALEFE
                          :*.**:**.***:*:    :* *:**..**:*****:***:**::: ::  : *. :*::

ref|YP_001210836.1|      EVVTLFDVAKAIQRVEMVLRVVKEIERYTSELGAEGRLITMQMEELVANVESEGLLVIQD
ref|YP_001111557.1|      EVVTLFDVTKAIQRIEMVLRVKKEIDRYISELGTEGRLIAMQMEELVANVEEEGLLIIQD
RAAC00430                EAVTLEDVTRVLQRFETVLRVTNEIRRYIIELGNEGRLVSMQLEELVSDVDEQAYLLIKD
ref|YP_001485333.1|      ELVTFGDVLSVLHRYEMVLRIKNEINMYIKELGTEGHLIRLQVNELITDMEQEAALFIKD
ref|NP_387969.1|         ELVTFSDVLSVMHRYEMVLRIKNEINMYIKELGTEGHLIKLQVIELITDMEEEAALFIKD
ref|NP_240971.1|         ELVTFHEVSQVMQRIHMVLNIKGEILNYVNELGSEGRLITMQLNELVSNLEKEVLLLIQD
                         *  **:  :*  .::* . .:  * * :*: :*: **::::::.: *.*:* ref|YP_001210836.1|      YATTIGEKTPSSILGVIGSWPAEDILDLSLIARALGYPGSASILEQHVSPRGYRILEKIP
ref|YP_001111557.1|      YATTLGEKTPESILKVIGSWPAEDLLDLVLIARALGYPGSASVLDQSVSPRGYRALRKIP
RAAC00430                FAHPECPHTPHQIMSQIHNLSSEELLDGALLARILGYPPSVNQLEESVPSRGYRILNKIS
ref|YP_001485333.1|      YV-KEKIKDPYVLLKQLQDMSSFELLDDSILYKLLGYPASTN-IDEYVYTRGYRLLHKIP
ref|NP_387969.1|         YV-KEKIKDPFVLLKELQDMSSYDLLDDSIVYKLLGYPASTN-LDDYVLPRGYRLLNKIP
ref|NP_240971.1|         YA-KEDDVDPEDVLEQMMKCSNEELLDDSNILKLLGYHKAFNVQEQQATPRGYRILHKIP
                         :.      *  ::  :  .     ::**    :  ***   . :: .  .****.*.**.

ref|YP_001210836.1|      RLPLPVIDNLVKTFGTLNRILVATIEELDDVEGIGEVRARSIKEGLNRYREQLLQER--
ref|YP_001111557.1|      RLPLPVIENLVSTFQYLRTILAASIAELDEVEGIGEVRARSIKDGLTRYGEMLLQDR--
RAAC00430                RLPQPVIENLVEHFGVLSNILKASMADLDKVEGVGPVRARMIQNGLGRIQEQVLIDRQI
ref|YP_001485333.1|      RLPMPIVENVVEAFGVLDRIMEADVQDLDEVEGIGEVRAKKIKKGLKRLQEKHYIDRQL
ref|NP_387969.1|         RLPMPIVENVVEAFGVLPRIIEASAEEELDEVEGIGEVRAQKIKKGLKRLQEKHYLDRQL
ref|NP_240971.1|         RLPATIVRNLVHSFENINDMLRADLKELDEVEGIGEARAKLIKDGLSRIQEQLFMDRNI
                         ***  .:: *:*  *   :   :: *    :**.*****:* .**: *:.**  *   :*
```

FIG. 114

```
ref|NP_832076.1|           ------------------------------------MNKTELIKNVAQSADISQKDASAA
ref|YP_001645033.1|        ------------------------------------MNKTELVKNVAQSADISQKDASAA
ref|NP_844759.1|           ------------------------------------MNKTELIKNVAQSADISQKDASAA
ref|YP_001375058.1|        ------------------------------------MNKTELIKNVAQSADISQKDASVA
ref|YP_535778.1|           -------------------------------------NKAALIERVAEKTGLTKKDATVA
RAAC02359                  ------------------------------------MNKRDLIRKTAEETGLSQKDCEAV
                                                               **   *:...*:.:.:::**.  ..

ref|NP_832076.1|           VQSVFDTIANALQSGDKVQLIGFGTFEVRERSARTGRNPQTGEEIQIAAGKVPAFKAGKE
ref|YP_001645033.1|        VQSVFDTIANALQSGDKVQLIGFGTFEVRERSARTGRNPQTGEEIQIAAGKVPAFKAGKE
ref|NP_844759.1|           VQSVFDTIATALQSGDKVQLIGFGTFEVRERSARTGRNPQTGEEIQIAAGKVPAFKAGKE
ref|YP_001375058.1|        VQSVFDTITNALQNGDKVQLIGFGTFEVRERAARTGRNPQTGEEIQIAAGKVPAFKAGKE
ref|YP_535778.1|           VDAVFETIQDALVDGEKVQLIGFGNFEVRERAARKGRNPQTGEEIEIPASKVPAFKPGKS
RAAC02359                  INTLFDTIRKTVESGEKVQIIGFGTFELRERAARTARNPRTGEAVEVPARRVPAFKPGAE
                           :.::*:**    ::  .*:***:****.**:***:**..***:*** :::.* :*****.* .

ref|NP_832076.1|           LKEAVK-
ref|YP_001645033.1|        LKEAVK-
ref|NP_844759.1|           LKEAVK-
ref|YP_001375058.1|        LKEAVK-
ref|YP_535778.1|           LKDAVK-
RAAC02359                  LKQAVQV
                           **:**:
```

FIG. 115

```
ref|YP_375842.1|          --------------------MSKAELVEKIAAQAKLTKVDAERAVNAFINVVTSSLKGGD
ref|YP_001131112.1|       --------------------MSKAELVEKIAAQANLTKVDAEKSVNAFINVVTSSLKAGD
ref|ZP_00591928.1|        -------------------LMSKAELVEKIASQAGLTKADAERAVNSFVSVVTDSLKAGE
ref|YP_001003150.1|       --------------------MNKADLAEKVAAETGVSKRVATDAVSAVFTGIEESLASGE
ref|NP_046614.1|          --------------------MNKTELIAKVAEKQGVSKKEGAPSVEKVFDTISEALKSGE
RAAC02589                 MCCLTGLERMRDLLEKERELVNKGELVAEVQARVGLPKSQVLQVLNTFCEVTTERLQAGE
                                              :.* :*   ::    . :.*       :.     . * .*:

ref|YP_375842.1|          DVTLVGFGTFTTGDRAARQGRNPQTGKAITIPAKKVVKFKPGKALKDEV-
ref|YP_001131112.1|       DVTLVGFGTFTTGDRAERQGRNPQTGKTITIPAKTVVKFKPGKALKDEV-
ref|ZP_00591928.1|        DVTLVGFGTFSVGERAERQGRNPQTGETITIAARKAVKFKPGKALKEEVD
ref|YP_001003150.1|       DVSIPGFGKFAVVARPERQGRNPQTGELIDIPAGMNVRFKPGAPLKRSVD
ref|NP_046614.1|          KVSIPGFGTFEVRERAARKGRNPQTGEEIDIPATKAPAFKPAKALKDAV-
RAAC02589                 EVSLPPLGKFQYVMRSARRQRNPQTGEMIDVPEKATVRFRPSGALKGRVN
                          .*::   :*.*       *. *: ******: * :.       *:*. .** *
```

FIG. 116

```
ref|ZP_02170919.1|    MNKTELINAVAESADLSKKDATSAVDAVFEVITDSLKKGDKVQLIGFGNFEVRERAARKG
ref|ZP_01862118.1|    MNKTELINAVAEAAELSKKDATKAVDAVFESIQDALANGDKVQLIGFGNFEVRERAARKG
ref|NP_692713.1|      MNKTDLVNAVAEKSELSKKDATKAVDAVFESVMDSLKNGEKVQLIGFGNFEVRERSARKG
ref|YP_535778.1|      -NKAALIERVAEKTGLTKKDATVAVDAVFETIQDALVDGEKVQLIGFGNFEVRERAARKG
ref|YP_359077.1|      MNKAELVSVIAEKAEMTKKDAEKALNAVLAAIEEALKKGEKVQLVGFGTFEVRERAARKG
RAAC01442             MNKMELINRVAEKTNLKKKDAESAVNAVFEIIEEALANGEKVQIIGFGTFETRSAARSG
                       **   *:. : : :.**   *::**:   : ::* .*:*::*.**.*.*:**.* ref|ZP_02170919.1|    RNPQTGEEIEIPASNVPAFKPGKALKDAVK
ref|ZP_01862118.1|    RNPQTGEEIEISASKVPAFKPGKALKDAVK
ref|NP_692713.1|      RNPQTGEEIEIPASKVPAFKPGKALKD---
ref|YP_535778.1|      RNPQTGEEIEIPASKVPAFKPGKSLKDAVK
ref|YP_359077.1|      RNPQTGQEIEIPASKVPVFKPGKLLKE---
RAAC01442             RNPQTGEVIEIPASTVPAFKPGNKLKEVTR
                      ******: ***.**.**.****: **:
```

FIG. 117

```
ref|YP_001213441.1|      MLNKVILIGRLTQDPELRYTPGGVAVARFTLAVNRARLNKQGERETDFIDVVVWQKQAET
RAAC00027                MLNRVILIGRLTADPELRYTNNGTAVASFTLAVDRMRSGPNGERQTDFINVVVWQKQAEI
ref|YP_077145.1|         MLNSVVLIGRLTKDPELRYTPSGKAVATLRLAVDRGTVNQQGERETDFIDIVVWEKQAET
ref|NP_244917.1|         MLNRVVLVGRLTRDPELRYTPNGVAVANFTLAVNRPFSNQQGEREADFINCVVWRKQAEN
ref|YP_149334.1|         MINRVILVGRLTRDPELRYTPSGVAVATFTLAVNRPFTNQQGERETDFIQCVVWRRQAEN
ref|YP_001377189.1|      MMNRVILVGRLTKDPDLRYTPNGVAVATFTLAVNRAFTNQQGEREADFINCVIWRKQAEN
                         *:*  *:*:** :****  .* *  :  *:*      . :*::*: *:*.:*** ref|YP_001213441.1|      CANYIRKGRLVAVEGRLQVRSYDDSQGIRRKAAEVVAETVRFLDR---------------
RAAC00027                VAQYLQKGRLAAVDGRLQIRSYDNRDGQRVRVAEVVAETVRFLDRGPDQAQGSGYSAAG-
ref|YP_077145.1|         VANYLQKGRLVAVQGRLQIRQYTTQDGQKREKAEVVATTVRFLDSARD------------
ref|NP_244917.1|         VANYLKKGSLAGVDGRIQTRSYDNNEGR--------------------------------
ref|YP_149334.1|         VANFLKKGSLAGVDGRLQTRSYENQEGRRVYVTEVVADSVQFLEPKGT-SEQRGATAGGY
ref|YP_001377189.1|      VANYLKKGSLAGVDGRLQTRNYEGQDGRRVYVTEVLAESVQFLEPRNSGGEQRGSFNQQP
                         *::::**  *..*:**:* *.*    :* ref|YP_001213441.1|      ------------------------------------------------
RAAC00027                --------AQTRQQRPTPSSAPPFEDDPFADDSQLIDISEDDLPF
ref|YP_077145.1|         ------------------------------------------------
ref|NP_244917.1|         ------------------------------------------------
ref|YP_149334.1|         YGDPFPFGQDQNHQYPNEKGFGRIDDDPFANDGQPIDISDDDLPF
ref|YP_001377189.1|      SGAGFGNQGSNPFGQSGNSGFTK-NDDPFSNVGQPIDISDDDLPF
```

FIG. 118

```
ref|YP_001038261.1|     ------------------------------------------------------------
ref|YP_001394883.1|     ------------------------------------------------------------
ref|NP_624000.1|        ------------------------------------------------------------
ref|YP_001662406.1|     ------------------------------------------------------------
ref|YP_001664279.1|     ------------------------------------------------------------
RAAC02508               MRLSSCASSKHNTRCQLQRLGQQPHCTGQCVACSLRHPFALHWNPADVDGRIIASVTLDC ref|YP_001038261.1|     ------------------------ILVVDDEKKIVEVVKSYLEHSGYEVYEAFTGKEA
ref|YP_001394883.1|     ------------------------ILVVDDEQKIVDVIRAYLEKAGYEVHSAYNGTEA
ref|NP_624000.1|        ------------------------ILVVDDEIKILEVVKSYLEREGFSVITETNGNNV
ref|YP_001662406.1|     ------------------------IFVVDDEIKILEVVKSYLEHEGFSVITETNGNNV
ref|YP_001664279.1|     ------------------------IFVVDDEIKILEVVKSYLEHEGFSVITETNGNNV
RAAC02508               EDGMKTADCRQIVTHAGGATMKRHHTILVADDEKKIADVLSLYLEQAGFGVVCVDNGSEV
                                                *:*.*** ** :*: ***: *: *    .*.::.

ref|YP_001038261.1|     LYVFEKVPLSLIVLDLMLPDLSGEEICKIIRKKSRVPIIMLTAKAEEEDILKGLNIGADD
ref|YP_001394883.1|     VKLFEKISPALIVLDLMLPDISGEDICKMLRKKSRVPIIMLTAKVDEKTVLEGFNIGADD
ref|NP_624000.1|        LDTFKKEKPDLVILDLMLPGISGEELCKRLRQFSNVPILMLTAKVQESDKINGFSIGADD
ref|YP_001662406.1|     LDTFKKEKPDLVILDLMLPGISGEELCKRLRQFSNVPILMLTAKVQESDKINGFSIGADD
ref|YP_001664279.1|     LNTFKKEKPDLVILDLMLPGISGEELCKRIRQFSNVPILMLTAKVQESDKINGFSIGADD
RAAC02508               LRRLEGLHPSLIILDLMLPDIPGEEVCMAVRARSAVPILMLTAKHRDEDRLRGLQIGADD
                        :  ::      *::****.::::*   :*   * *:***   :.   :.*:.***** ref|YP_001038261.1|     YITKPFSPKQLVARVTAVLRRTSDDPVPLSNIFSFNNGDLVIDSLKYEVRKGNNVVNLTP
ref|YP_001394883.1|     YVTKPFSPKQLVARVMAHLRRTEEEAIPLSNILSFNNGDLVLNVIKHEVRKNGITVNLTS
ref|NP_624000.1|        YITKPFSPRELVMRVKAILRRTTDD-VPLAEVMSFNNDDLVVDLRAHTVRKKGVVVNLTP
ref|YP_001662406.1|     YITKPFSPRELVMRVKAILRRTTDD-VPLAEVMSFNNDDLVVDLRAHTVRKKGVVVNLTP
ref|YP_001664279.1|     YLTKPFSPRELVMRVKAILRRTSDD-VPLAEVMSFNNDDLVVDFKAHTVKKKGVVVNLTP
RAAC02508               YVTKPFNPNEVVARVQAILRRTMLD-HPLADRLEYRDGDLVIDALSQVVYKGGINAELTA
                        *:****.*.::* ** * ****   :  **::  :.:.:. ***::    * *  . .:**.

ref|YP_001038261.1|     NEYKILMTLVKYPGKTFTRDELINMALGDDFDGFDRTVDTHIKNLRQKIETDPKSPKYIL
ref|YP_001394883.1|     SEYNILMTLVKYPQKTFTREELVNLALEEDFNGFDRIIDAHVKNLRQKIEDNSREPKYIL
ref|NP_624000.1|        NEFKILKILIRNPNRVFTREELIEKVMGFDYEGYDRTIDAHIKNLRQKIEDDTKNPVYIK
ref|YP_001662406.1|     NEFKILKILIRNPNRVFTREELIEKVMGFDYEGYDRTIDAHIKNLRQKIEDDTKNPVYIK
ref|YP_001664279.1|     NEFKILKFLIRNPNRVFTREELIEKVMGFDYEGYDRTIDAHIKNLRQKIEDDTKNPVYIK
RAAC02508               TEYKLLVILSRHPRRVFSREELIERVFGMDFRGDVRTIDAHVKNLRAKIEDDPKSPVYIQ
                        .*:::*  * : *  :.*:*:**::  .:   *: *  * :*:*:** *  :.:.* ** ref|YP_001038261.1|     TVHGVGYRFEG---
ref|YP_001394883.1|     TVYKVGYRFGGE--
ref|NP_624000.1|        TVYGVGYKF-GDGN
ref|YP_001662406.1|     TVYGVGYKF-GDGN
ref|YP_001664279.1|     TVYGVGYKF-GDGN
RAAC02508               TVYGMGYRFGGDGN
                        **: :**:* *
```

FIG. 119

```
ref|ZP_00237866.1|        -----MRLLVVEDNASLLESIVQILRDE-FEVDTALNGEEGLFLALQNIYDAILLDVMMP
ref|YP_034830.1|          -----MRLLVVEDNASLLESIVQILRDE-FEVDTALNGEEGLFLALQNIYDAILLDVMMP
ref|ZP_00739566.1|        MEGESMRLLVVEDNTSLLESIVQILRDE-FEVDTALNGEDGLFLALQNIYDAILLDVMMP
ref|YP_001643379.1|       -----MRLLVVEDNASLLESIVQILRDE-FEVDTAMNGEDGLFLALQNIYDAILLDVMMP
ref|NP_830389.1|          MEGESMRLLVVEDNASLLESIVQILRDE-FEVDTAINGEDGLFLALQNIYDAILLDVMMP
RAAC00905                 MEG-AMRILLVEDDRGLSDALAELLREESFQVDVAHDGEEGLYLAETAVYDALVVDVMLP
                             :  **:*:***: .* ::.:.::**:* *:**.* :::   :*::***:* ref|ZP_00237866.1|        EMDGFEVIQKIRDEKIETPVLFLTARDSLEDRVKGLDFGGDDYIVKPFQAPELKARIRAL
ref|YP_034830.1|          EMDGFEVIQKIRDEKIETPVLFLTARDSLEDRVKGLDFGGDDYIVKPFQAPELKARIRAL
ref|ZP_00739566.1|        GMDGFEVIQKIRDEKIETPVLFLTARDSLEDRVKGLDFGGDDYIVKPFQAPELKARIRAL
ref|YP_001643379.1|       EMDGFEVIQKIRDEKIETPVLFLTARDSLEDRVKGLDFGGDDYIVKPFQAPELKARIRAL
ref|NP_830389.1|          GMDGFEVIQKIRDEKIETPVLFLTARDSLEDRVKGLDFGGDDYIVKPFQAPELKARIRAL
RAAC00905                 GLSGYDLVRTLRDKRVHVPVLFLTALGDVDHRVQGLNAGGDDYLPKPFATEEFLARLRAL
                           : .*::::::.:::: .**  ..::.:: *: * : *: :* ref|ZP_00237866.1|        LRRSGSLTTKQTIRYKGIELFGKDKDVQVDGQSMKLTLKQYELLEYLIQNSGKILMREQI
ref|YP_034830.1|          LRRSGSLTTKQTIRYKGIELFGKDKDVQVDGQSMKLTLKQYELLEYLVQNSGKILMREQI
ref|ZP_00739566.1|        LRRSGSLTTQQTIRYKGIELFGKDKDVQVDGQGIKLTLKQYELLEYLIQNSGKILMREQI
ref|YP_001643379.1|       LRRSGSLTTQQTIRYKGIELFGKDKDIQVDGQGIKLTLKQYELLEYLIQNSGKILMREQI
ref|NP_830389.1|          LRRSGSLTTQQTIRYKGIELFGKDKDVQVDGKGMKLSLKQYELLEYLVQNSGKILMREQI
RAAC00905                 LRRNRELGTDMTLRSGLLVLDPLARRAAFGNEPIKLSDKEFDLLEYLLSHRGQILMRERI
                          ***. .* *. *:*      : *       :   ...: :**: *:::*****:.: *:*****:* ref|ZP_00237866.1|        FDRVWGFDSDTTVAIVEVYVHHLRKKLEPFGYQKDIQTVRGIGYI----
ref|YP_034830.1|          FDRVWGFDSDTTVAIVEVYVHHLRKKLEPFGYQKDIQTVRGIGYI----
ref|ZP_00739566.1|        FDRVWGFDSDTTVAIVEVYVHHLRKKLEPFGYQKDIQTVRGIGYI----
ref|YP_001643379.1|       FDRVWGFDSDTTVAIVEVYVHHLRKKLEPFGYQKDIQTVRGIGYI----
ref|NP_830389.1|          FDRVWGFDSDTTVAIVEVYVHHLRKKLEPFGYQKDIQTVRGIGYI----
RAAC00905                 FNRVWGIDSDVMDTTVDLYVHYLRKKLQPFGYDTAIRTVRNVGYMWSDP
                          *:****:***.     :  *::***:*****:.*:***:.:**:
```

FIG. 120

```
ref|YP_001244333.1|      -IPDRILLKPGILTPEEFEIMKQHTTIGFKILSRSNSPILQLGAEIALTHHERWDGSGYP
ref|ZP_02128221.1|       -IPDRILLKPGILTPEEFEIMKQHTTIGFRILSRSNSPILQLGAEIALTHHERWNGAGYP
ref|NP_228001.1|         -IPDRILLKPGILTPEEFEIMKQHTTIGFRILSRSNSPILQLGAEIALTHHERWDGSGYP
emb|CAI44346.1|          -IPDRILLKPGILTPEEFEIMKQHTTIGFRILSRSSSPILQLGAEIALTHHERWNGSGYP
RAAC01903                QIPDEILRKPGRLTPEEFDIMKMHTIYGRDMMNSPVHPFLHIGSTVAEQHHERYDGSGYP
ref|ZP_02171167.1|       QVPEEILLKPSKLTEEEWAIMKLHTSYGAEMLRETCISHFLLAAEVVEQHHERYDGSGYP
                          :*:. .  : *    *   ::   .  . : :.: :.  ****::*:*** ref|YP_001244333.1|      RGLKGREIPISGLIVAVADSFDAMVSKRPYKNPKPLEEAFREIESLSGKLYSPEVVEAFL
ref|ZP_02128221.1|       RGLKGREIPISGLIVAVADSFDAMVSKRPYKNPKPLEEAFREIESLSGKLYSPEVVEAFL
ref|NP_228001.1|         RGLKEREIPISGLIVAVADSFDAMVSRRPYKNPKPLEEAFREIESLSGKLYSPEVVEAFL
emb|CAI44346.1|          KGLKGKEIPLSGLIVAVADSFDAMVSRRPYKKPKTLEEAFQEIEELSGKLYSPEVVKAFL
RAAC01903                YGLKGEEIYLPAAIVAVVDSYDAMTSQRPYQRPKSKHEAIEEIRALRGKLYDPRVVDAFL
ref|ZP_02171167.1|       RGLKKEEISLEAAIVGLVDSYDAITSERVYQHARSHESALNELRGLRGIKYQPDVVDAFT
                          ***  .**  :  **.:.**:**:.*.*  *:..:.  ...*:.*:. * *  *.* **.**

ref|YP_001244333.1|      KLEKEITD-
ref|ZP_02128221.1|       KLEKEITD-
ref|NP_228001.1|         KLEKEITD-
emb|CAI44346.1|          KL-------
RAAC01903                KVVDTFEDT
ref|ZP_02171167.1|       DVIE-----
                         .:
```

FIG. 121

```
ref|YP_290547.1|              ---------IKVLVVDDHEFFRRGLVSVLAEEPDIEVVGEAGDGEEAVARAKELRPDVVL
ref|NP_627230.1|              ------EEPIRVLVVDDHALFRRGLEIVLAAEEDIQVVGEAGDGAEAVEKAADLLPDIVL
ref|YP_480150.1|              ----EGSALIRVLVVDDHELFLQGLQTVLEIEEDISVVGRAGNGQEALTLASGTSPDIVL
ref|YP_001509772.1|           ----RDVMPIRVLVVDDHELFLQGLQTVLETEEDISVVGRAADGQEALTLASGTTPDIVL
RAAC00981                     MGTWQDESVIKVLVVDDHELFRRGVVTVLRSTPGIYVVGEAGNGREAIECFQTLQPDVTL
ref|YP_074752.1|              ---------MKVLIVDDHLMLRKGVLSVLSNTD-LEVIGEASNGQEALELVPKLKPDLVL
                                       :::**  ::  :*: **       : *:*.*.:* :       :.* ref|YP_290547.1|              LDVRMPKRSGIAACAGIKEAVPDAKIVMLTMSDEEEDLFEAIKAGATGYLLKEISVVELP
ref|NP_627230.1|              MDVRMPKRGGIEACTSIKEVAPSAKIIMLTISDEEADLYDAIKAGATGYLLKEISTDEVA
ref|YP_480150.1|              MDVRMPGRDGIAAAGAIKRAVPRTRIVMLTVSDEESDLFEAIKAGAVGYLLKSIPPHEVA
ref|YP_001509772.1|           MDVRMPGRDGIAAAGAIKRAVPRTRIVMLTVSDEESDLFEAIKAGAVGYLLKSIPPHEVA
RAAC00981                     LDIHMPVCNGLETARKMREANPNTKILMLTVSETEEMLFEAVKSGASGYVLKSVSPERLI
ref|YP_074752.1|              MDINMPVLDGVEATRKLKQMYPDLKVVILTVSEIDKDLFEAIKAGADGYLLKNLGPEELV
                              :*:.**   .*: :   ::.  *  :::**:*: :  *::*:*:** **:**.:    .:

ref|YP_290547.1|              EAVRAVCKGQSFINPSMATKLINEFAALARKGKDRRSQPTKP-PRLTERETEVLRLVARG
ref|NP_627230.1|              TAIRAVADGQSQISPSMASKLLTEFKSMIQRTDERRLVPA---PRLTDRELEVLKLVATG
ref|YP_480150.1|              DAVRAVHNGQSLISPSMASKLMVEFATMARGTEDRPRAHA---PHLTARELEVLKLVAEG
ref|YP_001509772.1|           DAVRAVHNGQSLISPSMASKLMVEFATMARGGEDRPRAHA---PHLTARELEVLKLVAEG
RAAC00981                     ECVRQVYEGEPVVPSSLAMKMIAEFSRTAETRMPSSESVT----ELTEREREVLQYLSAG
ref|YP_074752.1|              SSLRAAISGEAPISSVMAAKMLKEF-RQPRANTTGKQPGQ----QLSPREIEVLRLASTG
                               .:*  . .*:. :  .:* *:: **  .             .*:  *:  : * ref|YP_290547.1|              LNNRDIADRLYISDNTVKNHVRNILEKLQLHSRTEAAVYAIR-------------
ref|NP_627230.1|              MNNRDIAKELFISENTVKNHVRNILEKLQLHSRMEAVVYAMREKI----------
ref|YP_480150.1|              RANREIARKLFISENTVKNHVRNILDKLQLHSRMEAVMYAVRQGL----------
ref|YP_001509772.1|           RANREIARKLFISENTVKNHVRNILDKLQLHSRMEAVMYAVRQGL----------
RAAC00981                     ASNKEIARALFISENTVRNHVRHILDKLHLSNRAQAAAYAVRNGIARGRQLTSDV
ref|YP_074752.1|              LTYKEIAAKLYVAESTVKNHMRHILEKLHLRNRSEAVGYAIRTGLA---------
                              ::**  *::::.**:**:**:*:**:* :*. :.  **:*
```

FIG. 122A

```
ref|NP_937072.1|          ------------------------------------------------------------
ref|NP_762428.1|          ------------------------------------------------------------
ref|YP_001489923.1|       ------------------------------------------------------------
ref|ZP_01847462.1|        ------------------------------------------------------------
RAAC00986                 MIVREAVHALWVALGVISALEFLNMRSSWLRRNHVYEFFTDWLPYGLIWIWIGWVDGVGN
ref|ZP_01964315.1|        ------------------------------------------------------------ ref|NP_937072.1|          ------------------------------------------------------------
ref|NP_762428.1|          ------------------------------------------------------------
ref|YP_001489923.1|       ------------------------------------------------------------
ref|ZP_01847462.1|        ------------------------------------------------------------
RAAC00986                 VVMPLYATLSCALHTPNRWNRKISLLGMMIPAALYVIHERHFDPVESEILIGIAAGYVVF
ref|ZP_01964315.1|        ------------------------------------------------------------ ref|NP_937072.1|          ------------------------------------------------------------
ref|NP_762428.1|          ------------------------------------------------------------
ref|YP_001489923.1|       ------------------------------------------------------------
ref|ZP_01847462.1|        ------------------------------------------------------------
RAAC00986                 HNRVRASYWAYGCANIVATGFCVLHMTPFTFGTFEETLIVSTIFALYEHDALIRARYKEE
ref|ZP_01964315.1|        --------------------------------------------------------YNRE ref|NP_937072.1|          ------------------------------------------------------------
ref|NP_762428.1|          ------------------------------------------------------------
ref|YP_001489923.1|       ------------------------------------------------------------
ref|ZP_01847462.1|        ------------------------------------------------------------
RAAC00986                 RGLDPLTGLYNRRGAEEWLNLHEGNAGIAVLVDLDDFKFINDFFGHDAGDEVLRKVGGLL
ref|ZP_01964315.1|        LYTDALTGIYNRRYYEERIKNSDMTAGIA-MIDLDDFKIYNDTFGHDAGDLALTTVVGIV ref|NP_937072.1|          ------------------------------------------------------------
ref|NP_762428.1|          ------------------------------------------------------------
ref|YP_001489923.1|       ------------------------------------------------------------
ref|ZP_01847462.1|        ------------------------------------------------------------
RAAC00986                 LRFVSSPGIGVRWGGDEFLILAEHETAQSAEQFVEELFSQLSSLELS-LNERRLRLRCSV
ref|ZP_01964315.1|        KANVRRTDMLIRMGGDEFLLVMPDITDQIFADKLKQIQEKIHDTKVPGYSQLRLSVSIGG ref|NP_937072.1|          ------------------------------------------------------------
ref|NP_762428.1|          ------------------------------------------------------------
ref|YP_001489923.1|       ------------------------------------------------------------
ref|ZP_01847462.1|        ------------------------------------------------------------
RAAC00986                 GVAYGPLGDLLITEADRALLRVKQSGKAHVEWYHSTIENQGEQLDINQYAFQKAFHQLTE
ref|ZP_01964315.1|        VLSAPGSTVENAIHKADQFMYQAKTCKNMVVTEHDEEVQDKAEGGETSKTYKYRILIVDD ref|NP_937072.1|          ------------------------------------------------------------
ref|NP_762428.1|          ------------------------------------------------------------
ref|YP_001489923.1|       --------TDLKGVITHASSAFCKISGYEKKELIGKPHNIIRHPETSKETFKKMWEE---
ref|ZP_01847462.1|        ------------------------------------------------------------
RAAC00986                 FCSAPCLATDLEFRIIDLNEAYERVSGYTRHALRGQKPSMLAFGDWNRRWYPEIHET---
ref|ZP_01964315.1|        SEMNRAILSEILSEEYDIVEADSGESCIDKLRQYEREISLVLLDIVMPGMDGFGVLN---
```

FIG. 122B

```
ref|NP_937072.1|        ------------------------------------------------------------
ref|NP_762428.1|        ------------------------------------------------------------
ref|YP_001489923.1|     -IQKEKKFTT---ELKNLRKDGTY-----------------YWVVAEIEPKYDKKGNHI
ref|ZP_01847462.1|      -----------------------------------------------RAYREQEE
RAAC00986               -LQRGRSWTG---ILHNQREDGTIWSGEMVISPVRIGEITAGYWCMVR----RVFSGDKV
ref|ZP_01964315.1|      YMNRHHYLED----IPVIMISSEDSTEVVRRAYEMGVSDYINRPFDAGV--VHRRVYNTI ref|NP_937072.1|        ------ENLNLLLDVRETSKELVYN-----LANAVEARSKETGAHVQRV----SLISEKL
ref|NP_762428.1|        ------ENLNLLLDVRETSKELVYN-----LANAVEARSKETGAHVQRV----SLISEKL
ref|YP_001489923.1|     GYFAVREDITANKEIEEIQKEIIFT-----MGSIAESRSKETSEHIERV----AKYTELI
ref|ZP_01847462.1|      RAAWLAREVAAAVSLVEAREREIVT----LLMRAAEHRDTDTGDHVARV----AGYVGLI
RAAC00986               RTELLNYEIQVDQDTAEYIENIFLQ----VLAEVAEWGDPELHAHVLRV----RRYTNWL
ref|ZP_01964315.1|      KLYAKQRRLITLITNQVYEKEKNNRMMVEILSQIVEFRNGESGSHVLNINILTGMILESL
                                 :.           :     .*   .  :   *:  .:             :

ref|NP_937072.1|        AQLYG----LSDFEVNLIKHASPLHDVGKVAIPDNILHKPSKLDAQEWEIMKKHVEYGVN
ref|NP_762428.1|        AQLYG----LSDFEVNLIKHASPLHDVGKVAIPDNILHKPGKLDAQEWEIMKKHVEYGVN
ref|YP_001489923.1|     ALELG----LEPKEAKMLKLASPMHDIGKIAIPDYILNKPAKLTPEEFEIVKTHTIKGYE
ref|ZP_01847462.1|      AEAMG----FPPDRGRLISLASTMHDVGKIAIPDAILLKRGPLSAAERREMERHAERGER
RAAC00986               AAKLADRKLIDPRDVPILSSASIAHDIGKVAIAREILFKPNTLDDVEHLYIQRHTEIGEQ
ref|ZP_01964315.1|      VQKTDKYN-ITWSERLLITTASALHDIGKIGIDDKILNKPGKLTDEEFKIMQNHTIIGAR
                        .        :    ::. **  **:**:.*    **  *     *    ::  *.  *  .

ref|NP_937072.1|        ILSK---------SKRRLFAIAKEIAGTHHEKWDGSGYPMGLKGEAIPISGRITGLADV
ref|NP_762428.1|        ILSK---------SKRRLFAIAKEIAGTHHEKWDGSGYPMGLQGEAIPISGRITGLADV
ref|YP_001489923.1|     ML-----------NLSERPLLKTAAIIALTHHEKYDGTGYPKGLKGEEIPLYGRITAIADV
ref|ZP_01847462.1|      MLES---------SSSEVVRLAAEIAGTHHERWDGTGYPRGLKGEEIPLSGRIVAVADV
RAAC00986               ILQSVLDKLDDMHVHAKRVVEYAKVIAGSHHEWWNGKGYPRGLRGNDIPLPGRLVAITDV
ref|ZP_01964315.1|      ILKNMEGYEDE------ELMMVAYQICRWHHERYDGRGYPDGLKGDEIPISAQVVSLADV
                        :*                 :. *  *.  *** ::* *** **:*: **: .::..:**

ref|NP_937072.1|        FDALGAKRSYKEPWSDEQIRQEIEAQKGKHFDPRLVDLLLENWQAFIDI-----------
ref|NP_762428.1|        FDALGAKRSYKEPWSDEQIRQEIEAQKGKHFDPRLVDLLLENWQAFIDI-----------
ref|YP_001489923.1|     FDALAHERCYKKAWRVDKIVEYIKEERGKHFDPKLVDLFFENFDKILEIKK---------
ref|ZP_01847462.1|      FDALTSARPYKAAWSLEAARDHVRAQAGTHFDPAVVEAFLGRWPAVEAL-----------
RAAC00986               LDALLSRRPYKEPWSLEEVRNYIESHRGLQFDPKLVTILLEEWAAFEDLVKEVTLYEVRE
ref|ZP_01964315.1|      YDALVGERVYKKAYSHEKAVQMILNGECGAFNPILLECLID-------------------
                        ***  *  **  .:   :     : :        *:*  ::   ::

ref|NP_937072.1|        -
ref|NP_762428.1|        -
ref|YP_001489923.1|     -
ref|ZP_01847462.1|      -
RAAC00986               S
ref|ZP_01964315.1|      -
```

FIG. 123A

```
ref|ZP_01170738.1|       ------------------------------YNRFLKKLLINYIFGSLIAVLAIGATFIFTT
ref|ZP_01856429.1|       ------------------------------------------------------------
ref|YP_001114416.1|      ------------------------------------------------------------
RAAC03031                MSAACGIHSSEVCVRRDVGCGMSWTANYEFKRLVKRLILNYFAGSVIAVLGVGGVLIFTT
ref|ZP_00539543.1|       ------------------------------QKFERQLLKNYLIGSFVAVFGVGCLFIFET
ref|ZP_02168828.1|       ------------------------------RMLINYMVGSLIAVFGVGSVFIFHT ref|ZP_01170738.1|       IDARGYDKALIWLILAGSMVIMFFTEGFFFRQHIRPIRAVFLSDGMDAESVRKAILRLKQ
ref|ZP_01856429.1|       ------------------------------------------------------------
ref|YP_001114416.1|      ------------------------------------------------------------
RAAC03031                LHLSQEDLWVICGILGGSLVLMLTADSIAFRVQIRPIRKALLTAHPTEDVLAKGYKRALH
ref|ZP_00539543.1|       LTFDARERVTLLTIMFLSVVLMFSFEYTIYRKHMRPLYQFFQTSTPSQAQLTAAFRTTHR
ref|ZP_02168828.1|       LTLSSEETLILLGIMVLSGLIMISLELFVYSKHIRPLVHFFKKGMNPQDA----YMTAHS ref|ZP_01170738.1|       FPVLTVKRIMLPHLLGLTIPAASASLYLISAGELKLSYYMVLYAAIAAFLVASMHALVEF
ref|ZP_01856429.1|       ------------------------------------------------------------
ref|YP_001114416.1|      ------------------------------------------------------------
RAAC03031                LPALAVLRVMGPHWLSFLIPGLVSSSILVRRGLLHLPMAYVWLASLGTLIVACMHAVIEF
ref|ZP_00539543.1|       FPLLTIKRILGPHFLGLSIPSSSLTALAIHFQWLEMPYYLIGLACFGAILVAILHALIEF
ref|ZP_02168828.1|       FPFMTVRRIMGPHLLGLSIPATVMTLFALSLGFLTLPHLYVLYAWIGAILIATLHAMIEF ref|ZP_01170738.1|       YLTLRAIKPVLAHFKAANKSGW---LVQETPSTIPIKKKFRLTVLVIGVLPVLIFMVAAQ
ref|ZP_01856429.1|       ------------------------------------------------------------
ref|YP_001114416.1|      ------------------------------------------------------------
RAAC03031                FLTSRSIEPTLVTIRRRSEHMYGASVLLRGQVVVPLAFKFAMSAVVFGALPLLLFGLANA
ref|ZP_00539543.1|       FLTYRVTESMLAELTVQSQQYGHGELILTKKDFISLRKKMLISTLIIGVFPILLFVLASA
ref|ZP_02168828.1|       FMTSRAVQPLIASICARTDE----NLKLDGVKVISMKWKLLLSMLLIAVFPAALFLLAGQ ref|ZP_01170738.1|       IKLEGMGMETAVFWQWAAVVIFITVCYAMLTAKYMAEDIEEPISRLQTLMSEAENQNFAY
ref|ZP_01856429.1|       ------------------------------------------------------------
ref|YP_001114416.1|      ------------------------------------------------------------
RAAC03031                VRLTHEGLGSSTYWTWAGGILALGSLFSAFGGYLLASDVQRPIRRLEALMRRVERGDFSL
ref|ZP_00539543.1|       VQLT-ENESLRSYWSWSTLILIVILCLATFCSLLLYENIQKPILALQEGVAQIESGQLNT
ref|ZP_02168828.1|       IRESAET--TTAYWNWAFLVIVVILFVSIAGAVVLYRNMEQPILELRKNLEQVQHGEFHref|ZP_01170738.1|       LKDNVYTDEFSEVFTGFNIMIAALKQREETNRQLLESFMTVLSAALDARDPYTSGHSMRV
ref|ZP_01856429.1|       -----------------------AQQEE----LMLSFVKSFISTLDAKDPYTRGHSERV
ref|YP_001114416.1|      ------------------------------KTMFKSFLVALASAIDARDPYTRGHSERV
RAAC03031                RADDTYMDEFSDLIQGFNLMLNGLAHRDAMNRQLIDSYFATLAAALDARDPYTAGHSQRV
ref|ZP_00539543.1|       -INNPFSDEFSQLVGGFNLMVEGIQGRDQENEQLLDSLFTLFAATLDARDPYTAGHSLRV
ref|ZP_02168828.1|       EMPNYYADEFSTLINGFNSMVSGIKSRDAENERLLESFFSVFAATLDARDSYTAGHTTRV
                                                :: *  .   :  :::**:*.** **: **

ref|ZP_01170738.1|       ASFSRDIGKRLGLHDEELKQLYQTALLHDIGKIGVPDGVLQKEGKLSDEEFEYIKAHPVI
ref|ZP_01856429.1|       ALIAQQLAKQLGYSGEFIQDIYLSGLLHDIGKIGVDDGILRKEGKLTDEEFSQIQKHPMI
ref|YP_001114416.1|      SQYSLMMGKALGLPEQDLELLERAAFLHDIGKIGIRDHILLKESPLDNEEFIIMKTHTTI
RAAC03031                ARYAEAIGRKVNLSPQTVRELRQSALLHDIGKIGIRDEILLKEGKLTDEEFAIIKQHPVI
ref|ZP_00539543.1|       AEYSVEIARAAGLADDQVELLRKSALLHDIGKIGIRDDVLLKEGRLTGEEFDKIKQHPVI
ref|ZP_02168828.1|       ADYSTQIARRSGLSGDELDLLRKSALLHDIGKIGIPDSVLLKDGKLTDEEFDKIKEHPVI
                          :    :  .:  .     :   :..:*******:  * :* *:.  * .***   :: *. *
```

FIG. 123B

```
ref|ZP_01170738.1|      GETILKQVQPAGEVASLLPGIRSHHERIDGKYPDGLQGEEIPYFGRIIAVADSYDAMTS
ref|ZP_01856429.1|      GYKILTGIKK---LKNILPGIRNHHEQIDGRGYPDGLRGSDIPLMARIIAVADAYDAMGS
ref|YP_001114416.1|     GQNILQQIEPNYLVQEISQGAACHHERYDGKGYPQGLQREEIPLAARIMAIADTFDAMVT
RAAC03031               GENIIRQIQPDDAMKPLLPGIRSHHERYDGKGYPDGLAGEEIPLFGRILAVADAFDAMTS
ref|ZP_00539543.1|      GVHILSQVHLPEKLQPILPGVKYHHERYDGKYPEGLAGESIPVFGRIMAIADAYDAMTS
ref|ZP_02168828.1|      GGDILEKVNLPEHLRPLLDGVRHHHERFDGKGYPDGLSGDRIPLYGRIIAVADAFDAMTS
                        *  *:  :.    :  : *    ***: **:***:**  . **  .**:*:**:;*** :

ref|ZP_01170738.1|      DRPYRKGMPPEKALHILESGKGTQWDPQVADAFIELARKM-------------------
ref|ZP_01856429.1|      DRPYRNGMPLERLENIFREGKGLQWDSDVIDAYFEIRDEI-------------------
ref|YP_001114416.1|     DRPYRKGLPVKLALQEIKRCAGSQFDPQLAEIFL-------------------------
RAAC03031               DRPYRSGMPVERAIQVLREGRGTQWDPHFVDAFIEVYREVYIPDEAKSAAREAAASTSQ
ref|ZP_00539543.1|      DRPYRKGMPVAKALAILEEGSGTQWDASFTQLFLDLKR---------------------
ref|ZP_02168828.1|      NRPYRKAMSYEQARNILQNGRGSQWDPAFIDHFMDFYEE--------------------
                        :****..:.         :.    * *:*. . : ::
```

FIG. 124

```
pdb|1B4A|A                  ----------------------------------------------------------N
sp|O31408|ARGR_BACST        ----------------------------------------------------------N
ref|YP_001126414.1|         ----------------------------------------------------------N
ref|NP_243643.1|            ----------------------------------------------------------N
ref|ZP_00538558.1|          ----------------------------------------------------------T
RAAC01956                   -------------------------------------------------MKRRLSVQS
                                                                                     .

pdb|1B4A|A                  KGQRHIKIREIIMSNDIETQDELVDRLREAGFNVTQATVSRDIKEMQLVKVPMANGRYKY
sp|O31408|ARGR_BACST        KGQRHIKIREIIMSNDIETQDELVDRLREAGFNVTQATVSRDIKEMQLVKVPMANGRYKY
ref|YP_001126414.1|         KGQRHIKIREIIMNSDIETQDELVDRLKEAGFNVTQATVSRDIKEMQLVKVPMANGRYKY
ref|NP_243643.1|            KGQRHIKIREIIANNDVETQDELVEQLKAAGYNVTQATVSRDIKELHLVKVPMMDGRYKY
ref|ZP_00538558.1|          KGQRLIKIREIITQSEIETQDELVEELRNAGYKVTQATVSRDIKELHLVKVPLNDGRYKY
RAAC01956                   KEQRLMRIREIVSQNEIETQEDLVRALEEAGFPVTQATISRDIKELQLVKVVGSNGKYKY
                            *   :::  ...::*::**  *. : *:**::**   :*:*** pdb|1B4A|A                  SLPSDQRFNPLQKLKRALVDVFIKLDGTGNLLVLRTLPGNAHAIGVLLDNLDWDEIVGTI
sp|O31408|ARGR_BACST        SLPSDQRFNPLQKLKRALVDVFIKLDGTGNLLVLRTLPGNAHAIGVLLDNLDWDEIVGTI
ref|YP_001126414.1|         SLPSDQRFNPLQKLKRALVDVFIKLDGTGNLLVLRTLPGNAHAIGVLLDNLDWGEIVGTI
ref|NP_243643.1|            SLPADQRFNPLQKLKRGLVDSFVSIDRTDNLIVMKTLPGNAHAIGALIDNLDWTEIMGTI
ref|ZP_00538558.1|          SLPADQRFNPLGKLRRLLGDSFISIDSAQNLIVMHVLPGNANALGVLLDHLNWPELLGTV
RAAC01956                   ALPTAVNKVSVDALQRRLAEVFISHARANNLIVIKVAPGNAHAIGALMDALDPPGLLGTI
                            :**:    .  .:  *:*  *  : *:.      : **:*::. ****:*:*.*:*  *:    ::**:

pdb|1B4A|A                  CGDDTCLIICRTPKDAKKVSNQLLSM-
sp|O31408|ARGR_BACST        CGDDTCLIICRTPKDAKKVSNQLLSM-
ref|YP_001126414.1|         CGDDTCLIICRTPKDAKKVSNQLLSM-
ref|NP_243643.1|            CGDDTILIICKDKQDGPVVTERFLNM-
ref|ZP_00538558.1|          CGDDTILMITRNEEAATEVTERILGM-
RAAC01956                   CGDDTMLLVCQDEEAAVRLLNETLNIG
                            ***** *:: :   :  . :  :. *.:
```

FIG. 125

```
ref|YP_001127098.1|    ---------------AQKKLLPDLLEVMQKRYQILHSISLMAPIGRRALAASLGMSERVLR
ref|YP_148912.1|       ---------------AQKKLLPDLLDVMQKRYQILHSISLMAPIGRRALAASLGMSERVLR
ref|ZP_01696601.1|     ----------------KKLYPDILAVMQKRYRILRSISFAEPVGRRTLAQMLGMSERVLR
ref|ZP_01171675.1|     ----------------KRLLPDLLTVMQKRYQILQYIGFMQPVGRRSLAVSLGSTERVLR
ref|YP_176517.1|       -----------------QIVPELMETMAKRYRLLQYIRLMQPIGRRSLATNLQTSERIVR
RAAC01498              MTMRRSGMEWTVWAAVERVAPELVRAMEHRVRVMQRIDAHAPIGRRALAQAMGQSERTLR
                                      ::  *:::  .*  :*  ::::  *       *:*:   :  :** :* ref|YP_001127098.1|    SETEFLKGQNLLSTDVSGMRLTEEGQALLHTLNDLMREALGLKELETALKQRLNVARVVV
ref|YP_148912.1|       SETEFLKGQNLLSADVSGMRLTEEGQALLHTLNDLMREALGLKELEAALQEQLGIPRVIV
ref|ZP_01696601.1|     SETDFLKNQKLIDVKPSGMSVTNDGAALLQNMESMMREISGINETEEKLKQALGLEDVVV
ref|ZP_01171675.1|     SEVDFLKNQNLISVASSGMNLTAEGKDLLERLESIMRDITGIDILEARLKEVLGVRQVIV
ref|YP_176517.1|       GEVTLLKDQGLIELTTAGMRLTEAGEALFLELADMMAELLGHRRLEEKLKEKLGVSQAIV
RAAC01498              TELDYLKQLGLVATSSSGVSLTPEGKALLGELEPLVAEIAGRSDLAWRVSALLRIPRVIV
                          *    **    *:     :*:   :*   *  *:  :    ::    :   *     :.  *  :  ..:* ref|YP_001127098.1|    VAGDSDRSPWVKKELGRACVACMKEQLRPGDIVAVAGGTTMAAVAEMMTPDPKLA-DVLF
ref|YP_148912.1|       VAGDSDRSPWVKKEMGRACVACMKELLEPGDIVAVAGGTTMAAVAEMMTPDSKLR-DVLF
ref|ZP_01696601.1|     VQGDSDKEPWVKNELGRACAVRMKAALTGNNIIAVTGGSTMAAVADVLTPDISAKRQLLF
ref|ZP_01171675.1|     VAGNSDESPWVKSELGRACAASMKQRLKGKNTVAVTGGSTMAAVAEMLTPNLFDD-ELLF
ref|YP_176517.1|       VAGDSDEEEWVKQELGRACVDELKRVAKKGDVFAVMGGTTLAAVANMVTPDETLA-TTTF
RAAC01498              VEGDADEDAWVTDRIGQAGSDVLAEVLQDGDIIAVTGGTTVAAVAKAMSAKPLRQ-RITV
                       *  *::*..  **...:*:*        :       :  .**  **:*:****.   :: ..              .

ref|YP_001127098.1|    VPARGGLGEDVENQANTICAKMAEKATGRYRLLHVPDQLSGEAYASLIEEPAVKEVLELI
ref|YP_148912.1|       VPARGGLGEDVENQANTICAKMAEKAMGRYRLLHVPDQLSDEAYASLVEEPAVKEVLELI
ref|ZP_01696601.1|     VPARGGIGEDVANQANTICAKMAERTGGKHRVLYVPDQVSPEVYKSVVNEPSIKEVLTLI
ref|ZP_01171675.1|     VPARGGIGEEVKNQANTICAMMAEHTASRHKFLHVPDQVSKTMYETIMKEPVINEVLNLI
ref|YP_176517.1|       VPARGGLGEKVEIQANTISAEFARRSGASYRLLHVPDQLSEEAYHSLVLERSVREILDVI
RAAC01498              VPARGTVGEIVAYQANTIASELAAKLGGSSVLLQISDSLSQKALEQLLDDPYIQERLPII
                       *** : *  ***** .: :*  :        . * :.*.:*     :: :  :.* * :* ref|YP_001127098.1|    QSCRMVVHGIGEAVTMAKRRKTPPVEMEKIIARHAVAEAFGYYFNEHGDVVHKVKTVGIQ
ref|YP_148912.1|       QSCRMVVHGIGEAVTMAKRRKTPPVEMENIIARHAVAEAFGYYFNEYGDVVHKVKTVGIQ
ref|ZP_01696601.1|     KQADIVLHGIGEAMTMAERRKTGKEEMEKIIRGHAVGEAFGYYFNEQGEIVHKVRTIGLQ
ref|ZP_01171675.1|     QSAGMVLHGIGDAITMAERRKTTPEDLLKIQERKAVGEAFGYYFDEAGEVVHKVQTIGLQ
ref|YP_176517.1|       TSSAVVMHGIGDARRMAARRDSGQPFIETLKREEAVAGEAFGYYFNANGEIIHKQRTIGLQ
RAAC01498              RQATVVVHGVGDALAMARRRHATEEEIKLLEAREAKAEAFGHYFNARGEVVYAMRTIGLR
                       ..   :*:**:*:*    ** **.:      :    .* .****:** :*::::  :*:*::

ref|YP_001127098.1|    LENLPHVEHVIAVGGASKAKAIQAYIKRAPHS-LLVTDEGAAKALV-------------
ref|YP_148912.1|       LEHLPHVEHVIAVGGASKAKAIRAYMKRAPHS-LLVTDEGAAK-----------------
ref|ZP_01696601.1|     LEDLHRIRHVFAVGGASKAKAIKAYMNTKPESTVLITDEGAAKQIL-------------
ref|ZP_01171675.1|     LKDLADIEHVIAVGGSSKAKAIRAYMKQAPSSTILITDEGAAKQLLK------------
ref|YP_176517.1|       LGE-LEGKYVISIAGGHTKANAILAYMKNRPSD-VLVTDEGAARRLL------------
RAAC01498              LDDVARARVVIAVAGGQKKAQAIASVANAYRID-VLVTDEGAARRILQLETPAGKERVEH
                       *  .    . *:::***  .**:**  :     . :*:******:

ref|YP_001127098.1|    ------
ref|YP_148912.1|       ------
ref|ZP_01696601.1|     ------
ref|ZP_01171675.1|     ------
ref|YP_176517.1|       ------
RAAC01498              GSEGWY
```

FIG. 126

```
ref|YP_090740.1|         ----------------------------MATIKEIALQAKVSSTTVSRVLNHDQSLSVAP
ref|YP_078338.1|         ----------------------------MATIKEIALQAKVSSTTVSRVLNHDQSLSVAP
ref|YP_001422307.1|      ----------------------------MVRLKDIALQASVSSATVSRILNKDDSLAVTD
ref|NP_243093.1|         ----------------------------MATIKDIAKLANVSNATVSRVLNRDATLSVTE
ref|YP_001126180.1|      ----------------------------MATLKEIAEKVGVSVATVSRVLNYDTTLSVSD
RAAC01624                MEIFLCIFTRKIILSLSPVICVKGGGKVLATMKDVAELARVSIAVVSRVLNEDRSLSVPE
                                                     :.  :*::*  . ** :.***:**  * :*:*.

ref|YP_090740.1|         ETRQRILDIAARLGYKSTRRREVYASGSGESPRIGIVVCQSQEEELNDPYFYSIRQGIE
ref|YP_078338.1|         ETRQRILDIAARLGYKSTRRREVYASGSGESPRIGIVVCQSQEEELNDPYFYSIRQGIE
ref|YP_001422307.1|      ETREKVLRIADELGYQPSAKRR-KNRSRSDSAPLIGVVSCLSPEVERQDPYFSAIRKGIE
ref|NP_243093.1|         ETRERIYSIAKELGYKRIKERQ---ETKKQVAPNIGIIILQSPEEEIDDPYFNSIRNGVE
ref|YP_001126180.1|      ETRKRIFEVAQELNYKTLRERS---QQARESFR-LGLIHWYSERQEIDDPYYMAIRLGVE
RAAC01624                STRKRVIEAANQLNYKVKRRQN---RSATSKIKTIAIVDFHPEEQERDDPYFWPMVRGIE
                          .**:::     *  .*.*:    .:            :::.    . .  * :***:  .:    *:* ref|YP_090740.1|         SECFERGAF--ITKFIQLSSIR--SNQPVGD--VDGLIVIGRINFAGLQQCMGALNN--V
ref|YP_078338.1|         SECFERGAF--ITKFIQLSSIR--SNQPVGD--VDGLIVIGRINFAGLQQCMGALNN--V
ref|YP_001422307.1|      EECFRQKVF--ITSSIHLGSFQ--EHMPHEL---DGVIVIGSLQDEALTNISAAFRH--A
ref|NP_243093.1|         QTLQAKGIY--STKVIHVQDST--TTSNIDG--LDGLIIIGGVTSDKIKQMTAPLEH--L
ref|YP_001126180.1|      KECFERG-IQLVKLFKQNGA-YPIERMKELD----GIIAVGKFGPKEVSDFARGAKQ--I
RAAC01624                LECQEKGLIHPVKFYVKTPAEF--SPSELSN--FDGVLVIGAEEWSGWDDFH--HPN--V
                                 .    :            :         *::  :*        :        :

ref|YP_090740.1|         VYINHTDNEELRDSVVVDFEKATGRALNHLKSLGYTRIGYIGGREKEHFRISDQETSAIE
ref|YP_078338.1|         VYINHTDNEELRDSVVVDFEKATGRALNHLKSLGYTRIGYIGGREKEHFRISDQETSAIE
ref|YP_001422307.1|      VFVNGTPDPARYDSVSVDFYAAAQKAIEHLLSLGYQRLGYIGGREREHTVIDG-VNSNKT
ref|NP_243093.1|         VFVNRCPSEEEFDSVVIDFEKATSKALDYLFLKGFRRIGYIGGTERQLS-----DQGKVE
ref|YP_001126180.1|      VFVDCSPDERQFDSVVIDLRQATITVLDYLLQLGHTKIGYIGGRE--------YVDGETP
RAAC01624                VFLDHCPNVARYSSVLLNFSSAVKDVFNHFWRLGYRTFAYIGGTRRFG------------
                         *:::       . .  .** ::: *.  .::::   *.  :.****   .

ref|YP_090740.1|         IEDKRLTAFL---EMAGSDNAKH-IYIGEYSMQQGYELMKKALLE-KNVPEAFFIASDSM
ref|YP_078338.1|         IEDKRLTAFL---EMAGSDNAKH-IYIGEYSMQQGYELMKKALLE-KNVPEAFFIASDSM
ref|YP_001422307.1|      IEDKRLTAFL---QMAG-AEPEH-VLIGEYSMHEGFRLMNEAIKGGS-LPDAFFIASDSM
ref|NP_243093.1|         IEDFRHTVYVKKMEELGLYEPSL-VFIGEYKMTEGYKLMKRAIEAG-NLPEAFFISSDPM
ref|YP_001126180.1|      IRDERETAFYEYLYVKGMYDSRD-VWIGAFTAEDGYRLMKEAIAKG-DLPTAFFIASDSM
RAAC01624                -MDERESTFR--TCVKSTVGAEPPVYHGDWSTGGGYEAMKLMLQEGAPLPRAIFVASDPM
                           * * ::.     .  . :   * :.   *:. *: :       :* *:*::**.* ref|YP_090740.1|         AIGALRALRESGLKVPEDVAIVSFNGIEASEFANPPLTTVKVHTEEMGRTGVKLLLDRLK
ref|YP_078338.1|         AIGALRALRESGLKVPEDVAIVSFNGIEASEFANPPLTTVKVHTEEMGRTGVKLLLDRLK
ref|YP_001422307.1|      AVGALKALQEAGLQVPRDTAVVSFNGIDEAEYASTPLSTVKVYTEEMGRTGVKLLLDRLN
ref|NP_243093.1|         AVGALRALKEANIAVPRDVSLVSFNDNEMAQFVDPPLTTVKVFTEQMGEMAVQLLLDRLN
ref|YP_001126180.1|      AIGALRALHEAGIAVPQDVAIVGFNDLPTAAFLHPPLSTVKVYTEFMGETAVELLIERLT
RAAC01624                AIGVIRALTEIGKRVPEDVAVVGFDDIDMAAYVNPALTTIRVQPEVMGRIGVRMLMCPYD
                         *:*.::**  *  **.*.::*.*:.   : :  ..*:*::*  .*  **. .*.:*:

ref|YP_090740.1|         -GRELPLKVTVPSELIIRE----------------
ref|YP_078338.1|         -GRELPLKVTVPSELIIRE----------------
ref|YP_001422307.1|      -GRTVPLAVTLPTSLIVRQ----------------
ref|NP_243093.1|         -GRTLPLKVVVPTELVVRE----------------
ref|YP_001126180.1|      TKRTICKKVIVPTELVVR-----------------
RAAC01624                --PNVPVQVVMPYQLVIRESCGACGSLAAGGRDFGL
```

FIG. 127

```
ref|ZP_01696173.1|    ---------------------------------------LGEQIANELRLLILTNEIKPGDI
ref|ZP_02327860.1|    ---------------------------------------LGESIACELRLQIINGTIKPGEV
ref|ZP_00539488.1|    ---------------------------------------GDRVAHELRMRIISGKIESGTV
ref|YP_034511.1|      ---------------------------------------GDRVASELRMRIIAGAIESGTI
ref|NP_694112.1|      ---------------------------------------GEQVVAELRMRIISQAIEPETV
RAAC00077             -------------------------MRRNAGGERRLGDVIADVLRREIVWGEWPSGHV
                                                              *:  :.  **  *:      .  :

ref|ZP_01696173.1|    ISENQIARKYGTSRSPVRDALKALANDGLIQLERMGARVLGMGLTDIHELYDVREMIEIF
ref|ZP_02327860.1|    ISENRVAADFGTSRSPVREALKTLSNEGLIRLERMGAVVLGLSSKDVEELYDVRFLIESF
ref|ZP_00539488.1|    LSENKLAADFSVSRSPVRDALKVLASERIIRLERMGAVVVGLSKKDIQEIYDVRLLIETF
ref|YP_034511.1|      LSENKIAADFSVSRSPVREALKLLASENIIRLERMGAVVIGLTEKEIEEIYDVRLLIETF
ref|NP_694112.1|      LSENQLAKEFQVSRSPIREALKVLSSENIVRPERMGAVVIGISEKDIEEIYDVRLMMESF
RAAC00077             FSENALARRFGTSRSPVREALRQLAHEGLISLGRNGARVVGLDLGDALELYDVRSLIEQF
                      :***  :*   :  .****:*:**: *:   ::    * ** *:*:     *:****  ::* * ref|ZP_01696173.1|    AQQRVSAAP---QE---QLIQFLNETIDKMKIAAKYENHSDFAYYDFSFHDRIIRHAGHK
ref|ZP_02327860.1|    VQERLAS---INQE---PLMTKLNQIIDKMELAVKYNDIADFAYQDFSFHETTVAAAGHN
ref|ZP_00539488.1|    VFERIV---KMDRQ---DLVRELSKVLEMMKIAIKYKDADEFSYQDVLFHETIIRSIDHG
ref|YP_034511.1|      IFERL---GKMDTN---DLVRELNKIMEMMKIAIKYHDSDEFSYQDLLFHETIIRTIEHS
ref|NP_694112.1|      TFQRLL---DMDNA---SLINDLEKVVEMMKIAIKYKDVDQFSFLDMEFHETIIRSINHH
RAAC00077             TASRVCERPRAERE---SLAHTLSTLVLAMEEAASRRDWQSFSDLDLAYHDAIVRAANHR
                        .*:          *     *.  :  *: *  . .:  .*:  *. :*: :      * ref|ZP_01696173.1|    RILNLWNGMKSLIMAVLLVTTEHVFAHGPDHLAWVIEKHRKIVNSLLTGNEENVEQSVSA
ref|ZP_02327860.1|    RIFYLWTSIRHIVMTVMLITTEEVFSMGERKKQSVIEKHRTIIRGLESKNGEIILKTVRT
ref|ZP_00539488.1|    YVSMMWQNLKPVMESFILLSMRQRLDEDIEDFERILENHALYIEAIETGD---------
ref|YP_034511.1|      YILMIWNNLKPVMESLILLSMRTRFKEKYEDFERIIKNHELYIKAIESKDRALMIEALHQ
ref|NP_694112.1|      YIAMLWTNLKPVMECLVLLSMRYRMQEDENDFERIIENHRLIVESIKNKDANLVNNAFYK
RAAC00077             RVLRMWDEMRSLVQLTLALVMRKRMQRGDADMRGALAQHRSLAEAILAGDAAWVRRVMQS
                       :  :*   ::  ::      : :  .    :            .    : :*     ..:    :

ref|ZP_01696173.1|    YFKDSKRTLD------------
ref|ZP_02327860.1|    YFADSRQTLHNSL---------
ref|ZP_00539488.1|    ----------------------
ref|YP_034511.1|      NFDDVQGKVE------------
ref|NP_694112.1|      NFNDVQNRVE------------
RAAC00077             HVEETRRLLEGGLRGHPAGDER
```

FIG. 128

```
ref|NP_980690.1|          ---------MLTERQLLILQTIIDDFIGSAQPVGSRTLAKKDEITFSSATIRNEMADLEE
ref|ZP_02257686.1|        ---------MLTERQLLILQTIIDDFIGSAQPVGSRTLAKKDEITFSSATIRNEMADLEE
ref|YP_038371.1|          ---------MLTERQLLILQTIIDDFIGSAQPVGSRTLAKKDEITYSSATIRNEMADLEE
ref|YP_079889.1|          ---------MLTNRQLLILQVIVNDFIRSAQPVGSRTLSKKEDITFSSATIRNEMADLEE
ref|ZP_02170056.1|        ---------MLTERQLLILKAIIDDYVSHAEPVGSRSVSKRDDIHFSPATIRNEMSDLED
RAAC00876                 ---------MLTPRQQLILSAIIEDYVRMAEPIGSRALAKHEEIQYSPATIRNEMADLEE
                                   *** ** ***..*::*::  *:*:***:::*:::* :*.*******:***:

ref|NP_980690.1|          LGFIEKTHSSSGRVPSEKGYRFYVDHLLAPQNLPNDEIVQIKDLFAERIFEAEKIAQQSA
ref|ZP_02257686.1|        LGFIEKTHSSSGRVPSEKGYRFYVDHLLAPQNLPNDEIVQIKDLFAERIFEAEKIAQQSA
ref|YP_038371.1|          LGFIEKTHSSSGRVPSEKGYRFYVDHLLAPQNLPNDEIVQIKDLFAERIFEAEKIAQQSA
ref|YP_079889.1|          LGFIEKTHSSSGRIPSEKGYRYYVDHLLSPGKLSKTDLNIIHSIFKEKIFELEKAVQKSA
ref|ZP_02170056.1|        MGFLEKTHSSSGRIPSHKGYRHYVDHLLSPGQLSKEDIGNIQDVLRSRFHELEEVVRHSA
RAAC00876                 MGYLTQPHASAGRFPSQKGYRFYVDNLLRLGQMDRETGEFLKSVFTKRIDEVEQVAREVA
                          :*:: :.*:*:..**.*:**    ::  .       ::..:: .:: * *: .:. * ref|NP_980690.1|          QILSELTNYTAIVLGPKLSTNKLKNVQIVPLDRQTAVAIIVTDTGHVQSKTITVPESVDL
ref|ZP_02257686.1|        QILSELTNYTAIVLGPKLSTNKLKNVQIVPLDRQTAVAIIVTDTGHVQSKTITVPESVDL
ref|YP_038371.1|          QILSELTNYTAIVLGPKLSTNKLKNVQIVPLDRQTAVAIIVTDTGHVQSKTITVPESVDL
ref|YP_079889.1|          QVLSDLTNYTSIVLGPRLSENHLKQIQIVPIQPKKAVAILVTNTGHVENKTINFPAEVDL
ref|ZP_02170056.1|        KLLSELTNYTSIVLGPEMFESKLRQIQLIPISDKQAVAIIVTDTGHVENQTVHFPERINP
RAAC00876                 NVLSMLTKQTVIVLGPKTDTEKLRKIELIPLGGGRAIAILVTNSGHVETVHVRFSSEMEA
                          ::** **: * *****.   .:*::::::*:    *:**:**::***:.  :  .. ::

ref|NP_980690.1|          SDLEKMVNILNEKLSGVPMSELHNKIFKEIVTVLRGYVHNYDSAIKILDGTFQVP-LSEK
ref|ZP_02257686.1|        SDLEKMVNILNEKLSGVPMSELHNKIFKEIVTVLRGYVHNYDSAIKILDGTFQVP-LSEK
ref|YP_038371.1|          SDLEKMVNILNEKLSGVPMSELHNKIFKEIVTVLRGYVHNYDSAIKMLDGTFQVP-LSEK
ref|YP_079889.1|          SDLEKVVNILNERLRGVPISELKDRIPKEVVIFLKSHIQNYDTILHALGATLDSSVQTDR
ref|ZP_02170056.1|        DDLEKVVNILNDRLRGVPLYKLNEALSKEIHAVMKQYVNRHEAMLNVFHEVFRQHAREK-
RAAC00876                 DDVETLVRVLNDKVVGVPISELRRTLYAELAGELRRTVERFEDAIAVLNEVCQVPEREEA
                          .*:*.:*.:**::: *** :*.   : *:    ::  :....: ..:   .

ref|NP_980690.1|          IYFGGKANMLSQPEFHDIQKVRSLLTMIDNEAEFYDILRHKQVGIQVKIGRENSSTAMED
ref|ZP_02257686.1|        IYFGGKANMLSQPEFHDIQKVRSLLTMIDNEAEFYDILRHKQVGIQVKIGRENSATAMED
ref|YP_038371.1|          IYFGGKANMLSQPEFHDIHKVRSLLTMIDNEAEFYDILRHKQVGIQVKIGRENSATAMED
ref|YP_079889.1|          LFFGGKINMLNQPEFHDIDRVKSLLSLIEKEQEILRLFQSTESGITIKIGKENDYEEMEN
ref|ZP_02170056.1|        VYFGGKTNILAQPEFNDVERVRKILNIFEEDQLVSKLFRSDQEGMTIRIGEENHFAPFDD
RAAC00876                 VYIGGASNMLAQPEFHDVGKAQPILSLLEQNESISNWFPKAEDGIEVRIGAENAVVELKD
                          :::.*  *:* ****:*: :.: :*.::::: .  :   : *: ::** **    :.:

ref|NP_980690.1|          CSLISATYSIGEEQVGTIAILGPTRMQYSRVISLLQLFTRQITDGLKK-----
ref|ZP_02257686.1|        CSLISATYSIGEEQLGTIAILGPTRMQYSRVISLLQLFTRQITDGLKK-----
ref|YP_038371.1|          CSLISATYSIGEEQLGTIAILGPTRMQYSRVISLLQLFTRQFTDGLKK-----
ref|YP_079889.1|          CSLITATYTVGSKQIGSIAVIGPTRMDYSRVVGLLQHVSSDLSKALT------
ref|ZP_02170056.1|        CTIITATYEAGGQYLGTVGILGPTRMEYPRVISIMEYLATDLSKKLS------
RAAC00876                 CTVIATTYRLGGVPVGHIGVLGPTRMDYNRVMQILSFTSQALTEFLTRFASSG
                          *:*::**  *    :* :.::*****:*  **:  ::.    :  ..  *.
```

FIG 129

```
ref|YP_001488458.1|    ------------------------KVTINEVAAYAGVSKSTVSRYINGRTNEISIEKVK
ref|YP_080909.1|       ------------------------KVTINEVAAHAGVSKSTVSRYINGKIDAISPKKVK
ref|ZP_01665756.1|     ------------------------TIRDVAQQAGVSKSTISRYLNGRYECMSLETRE
RAAC00525              MIAGQDGGGGAPPPFAWERRHSVPKRATIQDVARAAGVSVTTVSRYLNGRYESMSENTRE
ref|YP_841318.1|       ------------------------EKLTIQDVADYAGVSKATVSRYLNRGGEQLSADVEA
ref|NP_347033.1|       ------------------------KKVVIDDVAKLAGVSKATISRYLNGKFEYMSEKTKD
                                                .*  :** ****  :*:***:*   :  :* .

ref|YP_001488458.1|    KIKKAIEELHYRPSQLAQGLKVRKSKVIGFIVADITNPFSVATLRGVEEICDEYGYSIMV
ref|YP_080909.1|       SIKKAIEELNYRPSQMAQGLKVKKSKVIGFLVADITNPFSVATLRGVEEVCDQYGYSIMV
ref|ZP_01665756.1|     RIARVIAELDYRPNAVARSLKQKRTHTVGAIVANILNPFSTSIIRGVEDHCKKHGFNLIL
RAAC00525              KIAAVIAELGYRPNALAKGLKAQRTETVGAIVVNMSYPFCVGFLRAFSRTLSAAGYHLMV
ref|YP_841318.1|       RVAAAIRALGYSPSPMAQGLKRGKSRLIGLVVADVSNSFSVAVLRGVEKACRDAGYMVML
ref|NP_347033.1|       RIKESIEELNYRPNNIARSLKSNKSKLIGVVIADLTNPFSSIIIKGIGDECKARGYNMVI
                        :    *   *  *.  :*:.**  ::  :*  ::.::   .*.   ::..       *:  :::

ref|YP_001488458.1|    CNTDNRPEKEREMLLKLNAHYIEGLIINTTGQNNDILQDFQKDGVPIVLVDRKLSELKVD
ref|YP_080909.1|       CNTDNSPEKEREMLHKLNAHYIEGLIINTTGRNNDVLLDLISQDVSIVLVDRKVPGLKID
ref|ZP_01665756.1|     CNADDDPVKEREYIEMLTAKQIDGLIINTTGGNN-PLVKEVNASVPVVLIDRKAPEMGLD
RAAC00525              AESEGDAKRERQLIESFVANRVEAIALQTSGANN-DYLEDLAREMPVVLVDRAFALRNAY
ref|YP_841318.1|       FNLGNDEQLEREAIRSLSAYRVEGFILHTLGHDAGALADAAQLGKPVVLVDRKVGDAEVD
ref|NP_347033.1|       ANSDNDVKQEEEYIKSLLDQRVEGIIVNSTGYNEEFLLSIKERGIPVSMVDRTFCEDKVD
                              :     .     *.:  :        :::.: :::    *    :       .:  ::**

ref|YP_001488458.1|    TVTTNNRDITIQLLQQMYEKSYEHIAFFTEPVDGISPREERKEAY-EQTAMSKHK--KPI
ref|YP_080909.1|       AVTTNNREVTSQIVNLMYDKGYAQVGLFTEPIKGISPREERASAY-TEIALERNAGGTPL
ref|ZP_01665756.1|     TVTVDSDLGARLAIGHLVGLGHRRIAMFTLPCDQVSPRLERVRGYQAALAEYNIPFRPEL
RAAC00525              AIGTNNRDASREIAWQLFDLGYDCVVYLTEDERGIPTRTDRLEGY---LDACRVALREPV
ref|YP_841318.1|       LVALDNQTAVQEAAGHLVEAGYRRLLFISEPIKAISSRNERARAFQAFVAEH-VDTVGGT
ref|NP_347033.1|       SVKSNNYDITVETINYLIDAGFNSLCFFTTERLDNIKPRIEREARAFIDVCSKRLKKENYNI
                                :  :.            :  ..   :   ::        :  .*   :*    .:

ref|YP_001488458.1|    IKEIDLKQK---EQLREELVHF-VQTNQQKKAILAANGLLMLKLISELVELGLKIPEDIG
ref|YP_080909.1|       VYEADVKDK---ESLLQSV-KSFLEMKEGKKAILGNNGLLMLKIISCLYELGISIPEDVG
ref|ZP_01665756.1|     LVETDTQLETVIAKVRELLTRAPG---ERPTAIFGANNLMTMAIVKALKRLGVAIPRDMA
RAAC00525              VMRVRRGDP---ASFREALARVDACARKERTAVYTANGLVLMECYRPLRALGHKVPDAMG
ref|YP_841318.1|       VFEAQRGDDDALDEALRALRRGAG---QAPVAVLAANAVISLRVAASAARLGWQLGADLG
ref|NP_347033.1|       SVVDYSKAGNLEVNIYKFLNNYSG-----KKAIFAVNGVVLLHTLSAINKLNINVPKDLG
                                .  .:.        *:   *  ::         *.  .  :.

ref|YP_001488458.1|    VAGFDDTEWYKLIGPGITTVAQPSHEMGKAAMQKIKTRLEG---DESAPQTIQLDGEIIV
ref|YP_080909.1|       IAGFDDTEWYKLIGPGITTIAQPSHEMGRVAMERIIKRIEG---DESAPQTIQLEAELVL
ref|ZP_01665756.1|     VIGFDDWEWAELIDPPITVVAQPVYDMGVKAAAVLIKRIKAGKPPKKPATVVFAPQLVV-
RAAC00525              IATFDQPDWADLVDPPLTCVRQPVEEMGEAAGRIITARLRG---EAVAAEVLVVPSTVVM
ref|YP_841318.1|       LIGFDDPEWAALVGPGLSAISQPTDDIGRVATNCLIERLQG---TQLPPRRVLLPGTLVT
ref|NP_347033.1|       ICGYDNWGWAALIPPGITTISQPSYEMGSEAAKLVLDRIEG--KASLGAVCKTLSAKLEI
                       :  :*:  *   *:  *  ::  :  **   ::*   *   :   *:..        .      :

ref|YP_001488458.1|    RKS----
ref|YP_080909.1|       RQS----
ref|ZP_01665756.1|     RASCG--
RAAC00525              RGSTGRG
ref|YP_841318.1|       RGSTRR-
ref|NP_347033.1|       RGST---
                       * *
```

FIG. 130

```
ref|ZP_02320157.1|    ------------------------------------------------------------
ref|YP_013918.1|      ------------------------------------------------------------
ref|NP_470676.1|      ------------------------------------------------------------
ref|YP_849514.1|      ------------------------------------------------------------
ref|ZP_02330749.1|    ------------------------------------------------------------
RAAC01072             -----------------------------------------------------MGPKGVG ref|ZP_02320157.1|    ----ISKRQQDIYEFIKSEVKEKGYPPSVREIGEAVGLASSSTVHGHLARLEGKGLIRRD
ref|YP_013918.1|      ----ISKRQQDIYEFIKSEVKEKGYPPSVREIGEAVGLASSSTVHGHLARLEGKGLIRRD
ref|NP_470676.1|      ----ISKRQQDIYEFIKSEVKEKGYPPSVREIGEAVGLASSSTVHGHLARLEGKGLIRRD
ref|YP_849514.1|      ----ISKRQQDIYEFIKSEVKEKGYPPSVREIGEAVGLASSSTVHGHLARLEGKGLIRRD
ref|ZP_02330749.1|    ----LSQRQQAILEFIKNEVKEKGYPPSVREIGEAVGLASSSTVHGHLERLEKKGLIRRD
RAAC01072             TVSGLTARQRAILEFIRKNIREKGYPPSVREIGEAVGLASSSTVHGHLERLQQKGYLRRD
                          :: **:  * *:.:::************************** :  :* ref|ZP_02320157.1|    PTKPRAIEILSLEDEAETPN-VVNIPIIGKVTAGMPITAIENIDEYFPLPEYMATGETNV
ref|YP_013918.1|      PTKPRAIEILSLEDEAETPN-VVNIPIIGKVTAGMPITAIENIDEYFPLPEYMAAGETNV
ref|NP_470676.1|      PTKPRAIEILSLEDEAETPN-VVNIPIIGKVTAGMPITAIENIEEYFPLPEYMAAGETNV
ref|YP_849514.1|      PTKPRAIEILSLEDEAETPN-VVNIPIIGKVTAGMPITAIENIEEYFPLPEYMAAGETNV
ref|ZP_02330749.1|    PTKPRAIEILDMDSSSTFSFSVTRVPLIGKVTAGMPITATENIEDYFPLPSHYVG-DHNV
RAAC01072             PTKPRALELLVDDEE---PGDVVLAPIVGRVTAGLPISALEDIEGYLPLPRDVAKGDE-V
                      ******:*:*   :..    .  *.   *::*:**::*  *:*: *:***   .  :   * ref|ZP_02320157.1|    FMLEIDGESMINAGILDGDKVIVRQQSSAINGEIVVAMTDENEATCKRFYKEANHFRLQP
ref|YP_013918.1|      FMLEIDGESMINAGILDGDKVIVRQQSSAINGEIVVAMTDENEATCKRFYKEANHFRLQP
ref|NP_470676.1|      FMLEIDGESMINAGILDGDKVIVRQQSSAINGEIVVAMTDENEATCKRFYKEANHFRLQP
ref|YP_849514.1|      FMLEIDGESMINAGILDGDKVIVRQQNSAINGEIVVAMTDENEATCKRFYKEANHFRLQP
ref|ZP_02330749.1|    FMLSVLGDSMIETGIHDGDLVIVRQQQTADNGDIVVAMTEDDEATVKRFYKEKDHIRLQP
RAAC01072             FALRVVGESMINAGILDGDLAIVRRQTSADNGDIVVAMTEDEATIKRFYREDGRVRLQP
                      * *  : *:*:: * .*:* :* :*:::* ****:* .::**** ref|ZP_02320157.1|    ENDALEPILLNNVTILGKVIGLYRDIR
ref|YP_013918.1|      ENDALEPILLNNVTILGKVIGLYRDIR
ref|NP_470676.1|      ENDALEPIILNNVTILGKVIGLYRDI-
ref|YP_849514.1|      ENDALEPIILNNVTILGKVIGLYRDIR
ref|ZP_02330749.1|    ENSSMAPIILSNVSILGKVIGIFRNI-
RAAC01072             ENDAMSPLYFPNVTILGKVIGIFRQIR
                      **.:: *: : **:*******::*:*
```

FIG. 131

```
ref|YP_001124617.1|    ------------------------------------------------------------
ref|YP_146331.1|       --------------------------------------------------------DNEQ
ref|YP_849898.1|       ------------------------------------------------------------
ref|NP_471127.1|       ------------------------------------------------------------
ref|NP_465208.1|       ------------------------------------------------------------
RAAC01366              ---------------------------------------------------MKGGGDMQA ref|YP_001124617.1|    -KEALDMLKKTGIRITPQRHAILEYLISSMSHPTADEIYKALEGKFPNMSVATVYNNLRV
ref|YP_146331.1|       LKEALDMLKKTGIRITPQRHAILEYLISSMSHPTADEIYKALEGKFPNMSVATVYNNLRV
ref|YP_849898.1|       -KEAVDVLKKTGVRITPQRHAILEFLINSHTHPTADDIYRSLEGNFPNMSVATVYNNLRV
ref|NP_471127.1|       -KEAVDVLKKTGVRITPQRHAILEFLINSHTHPTADDIYRSLEGNFPNMSVATVYNNLRV
ref|NP_465208.1|       -KEAVDVLKKTGVRITPQRHAILEFLINSHTHPTADDIYRSLEGNFPNMSVATVYNNLRV
RAAC01366              QKDAVQLLKNAGLRVTPQREAILQFLLDYDGHATVDDIYTSLQDRFPSMSVSTVYNTVKQ
                        *:*:::**::*:*:****.***::*:.    *.*.*:**  *:...**.***:****.::

ref|YP_001124617.1|    FKEVGLVKELTYGDSSRFDFVTSNHYHVICEQCGKIVDFHYPALDEVEQLAA--HVTGF
ref|YP_146331.1|       FKEIGLVKELTYGDSSRFDFVTSNHYHVICEECGKIVDFHYPALDEVEQLAA--HVTGF
ref|YP_849898.1|       FRDAGLIKELSYGDASSRFDFSTSNHYHAICNVCGKIVDFHYPGLDEVEHFAA--HVTGY
ref|NP_471127.1|       FRDAGLIKELSYGDASSRFDFSTSNHYHAICNVCGKIVDFHYPGLDEVEHFAA--HVTGY
ref|NP_465208.1|       FRDAGLIKELSYGDASSRFDFSTSNHYHAICNVCGKIVDFHYPGLDEVEHFAA--HMTGY
RAAC01366              LSQVGLVKEIGVGEGASRFDINVEPHHHLVCTRCGALFDFY---LEEPIQLSVPPEARGF
                       : : **:**:  *:.:****:  .. *:* :*   **  :.**:    *:*  :::.  .  *:

ref|YP_001124617.1|    KVDHHRMEVYGVCPDCQNEK--
ref|YP_146331.1|       KVDHHRMEVYGVCPDCQK----
ref|YP_849898.1|       EIDNHRLEVYGTCPECKEKQIN
ref|NP_471127.1|       EIDNHRLEVYGTCPECKEKQ--
ref|NP_465208.1|       EIDNHRLEVYGICPACKEKQ--
RAAC01
```

FIG. 132

```
ref|YP_077070.1|          ----------------------QRLVAIMKLLSERPGELLPLSFFTERFGAAKSTISED
RAAC01431                 MPVCGRLRPRTRAELRRRAMQRHERLIRLTRRLVERPMAPIGISALAEAWGVAKSTLSED
ref|ZP_01666690.1|        ----------------------ERVVALTKLLVDRPHHLFSLGYFSELFGAAKSTISED
ref|YP_814057.1|          ----------------------ERLVDMVKYLLARPHTLIALPFFADRYGAAKSSISED
ref|NP_964223.1|          ----------------------ERLVDMVKYLLARPHTLIALPFFADRYGAAKSSISED
ref|ZP_01173986.1|        ----------------------ERLIDMTNYLLEHPRQLVSLTFFADRYGSAKSSISED
                                                :*::  : . *   :*    . :   :::  :* *::* ref|YP_077070.1|          LALVKEALEADGSGRLRTHAGAAGGVQYWPLPSREEEQETLLELCRLLSDPGRILPGGFV
RAAC01431                 VQLVREVLAEDGAGRVETLVGAQGGVRFVPQVARDRAEAFLWDVARRLASPDRVIAGEFL
ref|ZP_01666690.1|        ILTIKQALQSFGLGTLETVSGAAGGVRYLPQQEAAAINGLLTDLAERLKSADRIIPGGFL
ref|YP_814057.1|          LAILRQTLANDQNGILETVAGAAGGVRYIPFVGKKEATNYLHDLADRIEDPDRILPGNFV
ref|NP_964223.1|          LAILRQTLANDQNGILETVAGAAGGVRYIPFVGKKEATDYLHDLADRIEDPDRILPGNFV
ref|ZP_01173986.1|        LAIIKETFEQRGIGTLQTVPGAAGGVKYSVKVSDDEARPFISGLCEVIASPERLLPGGYL
                           :   :::.:       * :.*  ** ***::            :  :.    : .. *::.*  ::

ref|YP_077070.1|          YMTDLITHPIWSARIGAIMAARFIDAEPDVVLTVETKGIPLALMVARALGLPMVVARREG
RAAC01431                 YASDVLGDPDVIDTAGAMVASRFAHAGVEVVVTVETKGIPLAASAARYLHAPLAIVRREQ
ref|ZP_01666690.1|        YMSDILFDSQLMLQIGEVFMTRFQHLAPDCVMTVETKGIPLAFATARAFHVPLVIVRRGS
ref|YP_814057.1|          YLSDILGSPQDLQQIGQLIATKYAYSNVDYVMTIETKGIAIAQAVSRFLNVPFVMVRRRP
ref|NP_964223.1|          YLSDILGSPQDLRQIGQLIATKYAYSNIDYVMTIETKGIALAQAVSRFLNVPFVMVRRRP
ref|ZP_01173986.1|        YMTDILGDPAIVQKAGRVFASAFADADIDVVMTVATKGIPLAYAVGAYLNVPVVIVRRDS
                          * :*::   .       * :. : :      :  *:*: ****.:*   ..   :  *...:**

ref|YP_077070.1|          RVTEGPSVTLHYISGS-RRIHTMTVGLRALWRGARVLVVDDFMKAGATARAMVDVAGEMG
RAAC01431                 RVTEGASLTTHYVSGSAKRIQTMSLSTRLVPRGARALIVDDFMRAGATARAVAELIGEFG
ref|ZP_01666690.1|        KVTEGPAVSINYVTGSSRRIQTMSLAKRAVPAGARVLIIDDFMKAGGTARGLVDLAQEVG
ref|YP_814057.1|          KITEGSTISVNYVASSSERVEKMELAKRLLPEGSNVLIVDDFMKGGGTLTGMEELVKEFK
ref|NP_964223.1|          KITEGSTISVNYVASSSERVEKMELAKRLLPEGSNVLIVDDFMKGGGTLTGMEELVKEFK
ref|ZP_01173986.1|        RVTEGSTVSINYVSGSAKRIQTMVLSKRSLEEGSKVLIVDDFMKAGGTVNGMISMLEEFK
                          ::***.:::   :*::.*  .*:..*  :.    *   :*:..*:*****:.*.*   .:  .:    *.

ref|YP_077070.1|          ASVAGVGVFVSTAEPARKQVQRYVSLLTLEQVDEV--ARTVR--------------
RAAC01431                 GEVCGTAVFMATSQPAQKMVADYVALLEVGPVRES--GFEVRPNLGALERRVTHVD
ref|ZP_01666690.1|        ARVVGVGVLVATAEPQEKLVEDYVALLILHEVDEHTKKTDIRPAL-----------
ref|YP_814057.1|          GTVAGMCVLCETKYASQKVVDDYQSLIKITEVDRTKKLIKVRP-------------
ref|NP_964223.1|          GTVAGMCVLCETKYASQKVVDDYQSLIKITEV------------------------
ref|ZP_01173986.1|        AHVAGIAVLVEAEKAEERLVDEYLSLVQLADV-------------------------
                          . *  *  *:   :   . .: *   * :*: :   *
```

FIG. 133

```
ref|YP_074599.1|            -MTIRDVARRAGVGVATVSRVLNGTG-YVKAETRERVLAAAAELGYVPSQLARGLVRRLS
RAAC01505                   MVTIRDVARKAGVSVSTVSRVINGSG-YVGEDTERKVLLAMKELNYQPNRIARGLVSRRT
ref|YP_149084.1|            MATIRDVAKRAGVSVATVSRVLNQNG-YVNEETERRVRQAMKELNYKPNEVARALFKKTS
ref|YP_001127265.1|         MATIRDVAKRAGVSVATVSRVLNQNG-YVNEETEKRVRRAMKELNYKPSEVARALFKKTS
ref|YP_001661816.1|         -VTIKDIAKLANVSITTVSRVINNKSEGVSEETRNRILQLVKELGYQPNAIARGLVTKKT
ref|NP_621898.1|            -VTIKDIARLANVSVTTVSRVINNKPEGVSEETRQKILKLVKELGYQPNAIARGLVTKKT
                              *:*:*:   *.*.::*****:*  .    *  :*..::      **.*  *. :**.*.  : :

ref|YP_074599.1|            GTVGLVVPDITNPFFPLITRGVEDAASEAGYTVFLCNTDNDPVLEAQDVRKLREHRVDGI
RAAC01505                   STIGLLIPDVANPFFSEMARGVEDAAIAEGYSVLLCNSDWKSERELMYIDLLKGRWVDGI
ref|YP_149084.1|            KTVGLIVPDITNPFFPELVRAVEDVMNIYDYTVILCNSDEKVEKEREYIEVLKQKYVDGV
ref|YP_001127265.1|         KTVGLIVPDITNPFFPELVRAVEDVMNIYDYTVILCNSDEKAEKEREYIEVLKQKYVDGV
ref|YP_001661816.1|         KTIGLIIPDISNPFFPDIARGVEDSAHIYGYNVFLCNTDDNLEKESEYINALKEKYVDGI
ref|NP_621898.1|            KTIGLIIPDISNPFFPDIARGVEDSAHIYGYNVFLCNTDDNLEKESEYIRALKEKYVDGI
                             *:**::**::****. :.*.***       .*.*:***:*  .   *   :  *:  : ***:

ref|YP_074599.1|            IFVG-TTERRELVDQLLADDIPVVVMDRQLEHADVDTVTVDNVAGAQAACRHLIELGHRR
RAAC01505                   VIVG-SRSDSRVIEAAVG-DTPLVIVDRRSSEFRWS-VWTDNRQGAALVVEHLLKMGCSK
ref|YP_149084.1|            ILTTNQFAPEE--VEE--WDVPIVVLDRPLH-ERYPSVVADNYEGARLATRHLYEVGCRR
ref|YP_001127265.1|         ILTTNQLTPDE--VDE--WDVPIVVLDRPFN-EKYPSVVVDNYRGARLATRHLYDMGCRR
ref|YP_001661816.1|         IFTSSSIPKHEHIMELVKSGIPIVIMDRRVDSEDIYGVFLDNYEGGYIATKHLIDLGHKK
ref|NP_621898.1|            IFTSSSIPKHEHIIELVESGIPVVIMDRRVDSENIYGVFLDNYEGGYIATKHLIDLGHEK
                             ::.       .      . *:*::**     * ** *.  . .** .:*   :

ref|YP_074599.1|            IAHAAGHQSTRTGQDRCQGYRMALEEADIPYDPACVTWGDFTFESGFRVGQVLLGLSPRP
RAAC01505                   IVHIAGPSDSPSAQERRKGYEQAISQAGL---VAIVYEGDFRFASGFEIATMILEGSQRP
ref|YP_149084.1|            IAHIQGPNHVVNAMERFRGYQDEMRALGLG-DRQLVIQGNYQLKQAKE-AVMAALAEHDM
ref|YP_001127265.1|         IAHIQGPMYVVNAVERFRGYQDEMMELGIW-EQRLVIQGNYQLKQAKE-AVMAALAQQEI
ref|YP_001661816.1|         IACITGPLYTKSAKERLEGYKKALVENGMDVDERLIFEGDYKINSGIIGTEKLLGNNENV
ref|NP_621898.1|            IGCITGPLYTKSAKERLEGYKKALLDSGIKIDEKLIFEGDYKINGGIIGAERLLKDNKDM
                             *    *     ..  :*.**.  :   .:       :  *::  :  .       .

ref|YP_074599.1|            TAVFAGNDLIALGVIRAAEEAGLSVPDDLSVVGFDNIQMAALVRPGLTTVRQPAREMGRL
RAAC01505                   DGIFAANDLMAIGVLQAAVKLGVQVPHEVAIVGYDNIPSAGYVSPSLTTVHQPSYQMGVS
ref|YP_149084.1|            DGIFAGNDAMAVGALKAVQQCGLRVPDDIAIIGYDGIPLTEMTTPELSTVSQPIYEMGAM
ref|YP_001127265.1|         DGIFAGNDAMAVGALKAVQQCGLRVPDDIAIIGYDGIPLTEMTTPELSTVSQPIYDMGAI
ref|YP_001661816.1|         TAIFACNDLMAYGAYKTIRSYGYKIPDDISIVGFDDIQLSQILEPQLTTIKQPAYDMGLA
ref|NP_621898.1|            SAIFACNDLMAYGAYKTIRSFGYKIPDDISVVGFDDIQLSQILEPQLSTIKQPAYDMGLT
                             .:** **  :* *. ::   . *    :*.::::::*:*.*   :      *  *:: ** :**

ref|YP_074599.1|            AMTMLLERIRG---EFSGPGRRHVYPPELIVRGTT---------
RAAC01505                   AFDLLLEQFVT---NSGQSARKVKFEPKLVVRDSSLKCPSRNSV
ref|YP_149084.1|            AARILI-KQI---EGKPLEKLHYQLPVQLVVRQST---------
ref|YP_001127265.1|         AARILI-KQI---EGKPLEKLHYQLPVQLIVRQST---------
ref|YP_001661816.1|         AARMLI-KLVE---GKKLKKKIINFRPQLIIRQST---------
ref|NP_621898.1|            AARMLI-KLIE---GKKLKKKIINFRPQLVIRQST---------
                             *   :*: :                  :*::* ::
```

FIG. 134

```
ref|YP_001661816.1|      -----TIKDIAKLANVSITTVSRVINNKSEGVSEETRNRILQLVKELGYQPNAIARGLVT
ref|NP_621898.1|         -----TIKDIARLANVSVTTVSRVINNKPEGVSEETRQKILKLVKELGYQPNAIARGLVT
ref|ZP_01188648.1|       ---MITIYDVAKEAGVSPSTVSRVLNN-YNNVTETTRKKVEAACKKLKYVPNANASSLKK
ref|YP_074599.1|         -----TIRDVARRAGVGVATVSRVLNG-TGYVKAETRERVLAAAAELGYVPSQLARGLVR
ref|YP_147968.1|         ---MASIKDVAKRANVSTATVSRVLRN-AGNVTEETRQRVLEAIEALNYQPNVLGRYLRR
RAAC01078                MTRMTTMADVAKRAGVSIMTVSRVVNN-SGYVKPSTRQKVLAAMQELNYVP----KGGQS
                              :: *:*: *.*. *****:..  *.  **:::       *  * ref|YP_001661816.1|      KKTKTIGLIIPDISNPFFPDIARGVEDSAHIYGYNVFLCNTDDNLEKESEYINALKEKYV
ref|NP_621898.1|         KKTKTIGLIIPDISNPFFPDIARGVEDSAHIYGYNVFLCNTDDNLEKESEYIRALKEKYV
ref|ZP_01188648.1|       DNTKTLALIIPDIENPFFISILKGFDDKANKLGYDTILCNTDERLEKEKDYIKMVLKKRI
ref|YP_074599.1|         RLSGTVGLVVVPDITNPFFPLITRGVEDAASEAGYTVFLCNTDNDPVLEAQDVRKLREHRV
ref|YP_147968.1|         METETVLVVVPDITNPFFSKVLRGIEAVALEHGYQVLLGDTQNDVRLEEQYLNLLPQRQV
RAAC01078                SPHDTWMLIVPDITNPFFTFIARGMEDVARKHGFRVFIANTDEDLQKEQEYVQMCLDYQV
                              *  :::*** ****  : :*.:   *   *:  .::  :*::    * : :.  . :

ref|YP_001661816.1|      DG--IIFTSSS-IPKHEHIMELVKSGIPIVIMDRRVDSEDIYGVFLDNYEGGYIATKHLI
ref|NP_621898.1|         DG--IIFTSSS-IPKHEHIIELVESGIPVVIMDRRVDSENIYGVFLDNYEGGYIATKHLI
ref|ZP_01188648.1|       DG--VAISTVG-KTS-EHISEFSDRNIPYILLDRKVEGLDADIVCGDNYQGAIDLVNHLI
ref|YP_074599.1|         DG--IIFVGTT--ERRELVDQLLADDIPVVVMDRQLEHADVDTVTVDNVAGAQAACRHLI
ref|YP_147968.1|         DG--MIFLTAR--IRKELVEEMAR-QFPIVLACEYLEGADIPTVSIDNISSARKATEHLI
RAAC01078                RG--ALVVPVG-DPSRENLVRLTEHQVPFVLIDREIEGLDADLVKGDIRETSRRLVEHLL
                            *       .           *  .:    .*  ::  . ::   :   *   *   .   .**:

ref|YP_001661816.1|      DLGHKKIACITGPLYTKSAKERLEGYKKALVENGMDVDERLIFEG----DYKINSGIIGT
ref|NP_621898.1|         DLGHEKIGCITGPLYTKSAKERLEGYKKALLDSGIKIDEKLIFEG----DYKINGGIIGA
ref|ZP_01188648.1|       NNGHKDIAMITGPLHVSTSRERFEGYKTALNRAGISVEEDYIKIDYVSQDYSGEKAYEMT
ref|YP_074599.1|         ELGHRRIAHAAGHQSTRTGQDRCQGYRMALEEADIPYDPACVTWG----DFTFESGFRVG
ref|YP_147968.1|         RLGHRRIAHLSGPMNIILSRDRLRGYQQALAQHELEADAALVQEG----DFTYESGYNLT
RAAC01078                DLGHERIAAVVGPLHSASSRERLDGYRDALLHKGLPVDESLIFTA----PMTRDMDASFV
                          **. *.    *      .::* **: **     :   :       :           .  :

ref|YP_001661816.1|      EKLLGNNENVTAIFACNDLMAYGAYKTIRSYGYKIPDDISIVGFDDIQLSQILEPQLTTI
ref|NP_621898.1|         ERLLKDNKDMSAIFACNDLMAYGAYKTIRSFGYKIPDDISVVGFDDIQLSQILEPQLSTI
ref|ZP_01188648.1|       KELLGLNEPPTAIFVANNLMALEVYKALKEEGISVPDDLNLIYEIEPFFTVM
ref|YP_074599.1|         QVLLGLSPRPTAVFAGNDLIALGVIRAAEEAGLSVPDDLSVVGFDNIQMAALVRPGLTTV
ref|YP_147968.1|         LKLLALEKPPTAIFAANDEMAIGAIKAVRHRGGRVPDDVAVVGFDDIQMASIFEPSLTTI
RAAC01078                DALVGRSDAPTALFLGNMFQYAHIVRRLRGLGLSIPHDISVVSFGNTDDLASVDSLATAA
                          *:   .   :*:* *            :  .  * :*.*:::* *.: :    . . :.

ref|YP_001661816.1|      KQPAYDMGLAAARMLIKLVEGKK--LKK--KIINFRPQLIIRQST-----------
ref|NP_621898.1|         KQPAYDMGLTAARMLIKLIEGKK--LKK--KIINFRPQLVIRQST-----------
ref|ZP_01188648.1|       KQPAYTMGEAAAEILIKRIEMSDNGHRK--RKIVFEPELIIRKSS-----------
ref|YP_074599.1|         RQPAREMGRLAMTMLLERIRGEFSGPGR---RHVYPPELIVRGTT-----------
ref|YP_147968.1|         AQPMFEIGQKAMELLLALIEGT-SARRR---QLVLPDRLVIRDS------------
RAAC01078                VQPAYNYGSLGAQLLLERIEGVRKTSTR----IVLHSEMVVRSSTAPPPVRMTKKR
                          **   *   .  :*:  :.           :            .:::*  :
```

FIG. 135

```
ref|YP_001391734.1|       ----------------------------------------------------------
ref|YP_001254935.1|       ----------------------------------------------------------
ref|YP_001308325.1|       ----------------------------------------------------------
ref|YP_518781.1|          ----------------------------------------------------------
ref|ZP_01171531.1|        ----------------------------------------------------------
RAAC01972                 ------------------------------------------MRGRSRRPRGLAVREG ref|YP_001391734.1|       -------------------------------EPVDFEDICDLLSDVLACNVYIISRKG
ref|YP_001254935.1|       -------------------------------EPVDFEDICDLLSDVLACNVYIISRKG
ref|YP_001308325.1|       -------------------------------EPVAFQDICTLLSEVLECNVYIISKKG
ref|YP_518781.1|          -------------------------------AGHSVDFDEMANVLSESIQSNCYIVGRRG
ref|ZP_01171531.1|        -------------------------------AGKPVNFKEMAETLSEVIEANIFVVSRRG
RAAC01972                 TKRRRMPGEGQGDEIVSLLEQVQELGQLLHRSNEQVEFQEVAEFLSRLMQSNVYIVGRKG
                                                         .  *  *.::.   **    : .*  :::.:* ref|YP_001391734.1|       KILGSKFYS-GFECEEVREVVLKENRFPDFYNNKLLNVNETLSNSP--NHDK----CVFD
ref|YP_001254935.1|       KILGSKFYS-GFECDEVREVVLKENRFPDFYNNKLLNVNETLSNSP--NHDK----CVFD
ref|YP_001308325.1|       KVLGYTFGK-DFECEAMKKKVIEDKKFPEDYNKTLLEVNETLSNLP--NEGR----CVFQ
ref|YP_518781.1|          KILGYSFMQ-NFGCNTMEDIVVHTERFPESYNEGLLKVTETRSNTT--QVANG---CVFN
ref|ZP_01171531.1|        KLLGFAVNQ-QIENERMKK-MLEDRQFPEEYTKSLFNIQETSSNLD--VESD---YTAFP
RAAC01972                 KILGYGVAE-HELTEEWLNIMTREQRFPGDFNKHLLRIEQTIANLTDEQKKP---LYVFS
                          *:    .        .    :    . : . ..:   :.:  *:..  :*  :*                      .* ref|YP_001391734.1|       NLKDCSINNKLSTIVPINGNRERLGTLLLARFDKEFTDEDLILAEYSATIIGLEILRSKQ
ref|YP_001254935.1|       NLKDCSINNKLSTIVPINGNRERLGTLLLARFDKEFTDEDLVLAEYSATIIGLEILRSKQ
ref|YP_001308325.1|       EIGKCKKVDKLSTIVPIIGSRERLGTLILARFGNPFTDEDLVIVEYSATIVGMEMLRAMQ
ref|YP_518781.1|          EKERCHFNNKITTILPILGGGERVGTLVLAKFDQDFSEADLILAEYGATVVGMEILRIKA
ref|ZP_01171531.1|        VENKELFKNGLTTIVPIIGGGERLGTLILARLQEQFHDDDLILGEYGATVVGMEILREKA
RAAC01972                 PEENESFRSKHLMITPIIGARERQGTLLFARSQRPFNEDDQILAEYAATVVALEIVHSRQ
                                .     *  **  *     **   ***::*:      .  *    :    *:   **. **::.: .*:::

ref|YP_001391734.1|       DQIEEEARKKAVVQLAIGTLSYSELEAVEHIFNEL-DGTEGLLVASKIADKVGITRSVIV
ref|YP_001254935.1|       DQIEEEARKKAVVQLAIGTLSYSELEAVEHIFNEL-DGTEGLLVASKIADKVGITRSVIV
ref|YP_001308325.1|       DEITEDTRKKAVVQLAIGTLSYSELEAVEHIFNEL-NGNEGLLVASKIADKVGITRSVIV
ref|YP_518781.1|          ERAEEEARKKAAVQIAVGTLSYSELEAVEHIF-AELGGGDGLLVASKIADRVGITRSVIV
ref|ZP_01171531.1|        EEIEEEARSKAVVQMAISSLSYSELEAIEHIFEEL-NGKEGLLVASKIADRVGITRSVIV
RAAC01972                 QQKEEESRQRALAHLAVESLSFSELQAAKYLLDAVRNSPEGIVVSSQIADHGVTRSVIV
                          :.   *::*.:* .:::*: ::*:*  ::::           ..  :*.:*:*:***:  *:****** ref|YP_001391734.1|       NALRKFESAGVIESRSLGMKGTHIRILNDKLLEELKK----
ref|YP_001254935.1|       NALRKFESAGVIESRSLGMKGTHIRILNDKLLEELKK----
ref|YP_001308325.1|       NALRKFESAGVIESRSLGMKGTYIRILNEKLIDELKK----
ref|YP_518781.1|          NALRKFESAGVIESKSLGMKGTYIRVLNDYLLEELDK----
ref|ZP_01171531.1|        NALRKLESAGVIESRSLGMKGTYIKVLN-------------
RAAC01972                 NSIRKLESAGTIESRSLGMKGTHLRILNPYVEEEINRQFER
                          *::**:****.:***.****:******.:::.:**
```

FIG. 136

```
ref|NP_241876.1|         ----------------LAIIYYSSTGTNYQLAQWAEEAAKEAGAEVKVLKVAETAPDAAI
ref|YP_174035.1|         ------------MANVKTAVIYYSSTGTNYQLAKWAKESAEKEGAEVRLLKFPELAPDAAI
ref|YP_079193.1|         ------------MSNVKLAVVFYSMGGTNYQLAKWAAEGAKEAGADVKVLKVQELAPQSVI
ref|ZP_01169176.1|       ------------LMTVKLAIVYYSSTGTNYQMAQWAAEGAKEAGAEATIYKVQELAPESVI
ref|YP_001488917.1|      ------------MENVKLAVIYYSSTGTNYQMAKWAEAGAKEAGAEVKVLKVAELAPEAVV
RAAC00076                MKRETRSGGNTMSNVHLTILYYSATGTNYRMAQIAAEAARELGAEVRVRKVAELAPREVI
                                         :::::**  ****::*:  *    .*.:  **:.  : *.  * **    .:

ref|NP_241876.1|         DSNPAWRAHVDATKDVPAVTLDDLVWADAIMFSIPTRFGNVPSQVKAFLDTTGGLWFEGK
ref|YP_174035.1|         DSNPAWRAHVEATKDVPEVTPDDMEWADSYIFSVPSRFGVLPAQAKQFFDTLGGLWAQGK
ref|YP_079193.1|         EGNEVWKATVDATKDIPVVTSEDIEWADAIIFSTPTRFGNMASQMKQFLDTQGGLWANGK
ref|ZP_01169176.1|       EGVPAWKAHLEETKDVPVVTPDDIAEADAIIFSTPTRFGNMAAQMKQFLDTTGGIWGAGK
ref|YP_001488917.1|      ASNPAWKAHLDETKDIPEVQLSDLEWADAIIFSMPTRFGNLPAQMKQFLDTTGGLWFQGK
RAAC00076                ETSPAWKAHVEATHVPVATPDDVAWADAVIFSVPSRFGNIPSQMKQFLDTLGPLWAKGL
                             .*:*  ::    *  .:*  .   .*:   :  :  *:*** :.:* * *:**  : *     * ref|NP_241876.1|         LANKVVSAMASASNAHGGQEATVLSLYTTMYHWGAIVAAPGYTAPETFAAGGNPYGTSVT
ref|YP_174035.1|         LANKVVSAMSSASNPHGGQEATILSVYTTMYHWGAIVVAPGYTDQSAFTSGGNPYGTSVT
ref|YP_079193.1|         TVNKVVSAMSSAQNPHGGQEATILSLYTSMMHWGAIIASPGYTDPVLFGAGGNPYGTSVT
ref|ZP_01169176.1|       TVNKVVSGMTSAQNPHGGQEATILSLYTTMYHWGAIVVTPGYSDQSLFPAGGNPYGASVT
ref|YP_001488917.1|      LANKAVSAMTSAQNPNGGQEQTILSLYTTMFHWGAIIAAPGYTDDSLYGAGGNPYGVSVT
RAAC00076                TANKVVSAMSSAQNPHGGQEATILSLYTSMYHWGAIIAAPGFTDASAYASGGNPYGTSVT
                          ...*:**.*.:**** *:::* *** :.:::       :  :****.* ref|NP_241876.1|         VDQEGNMKEDVKA---AVAHQAKRTIQVAEWVKQG-----
ref|YP_174035.1|         IDQDGNQIEDVEQ---AVKQQAKRTVTVAKAIVTG-----
ref|YP_079193.1|         VDQDGKMIEDVEA---AVKHQAKRTVTVAEWVKKG-----
ref|ZP_01169176.1|       VDQSNEIVGDKDAYKGAIKYQAKRVIGIAESVKNG-----
ref|YP_001488917.1|      VDQNGKIQEDAEA---AAKHQAKRTVNVAEWIKKGQ----
RAAC00076                LSENGEIDPGAQD---AIRHQARRTVTIASWVKQGQAVTV
                          :.:..:    . .        *      **:*.: :*.  :  *
```

FIG. 137

```
ref|ZP_02327651.1|           ---------------------------------LQIEFEQRRRALI
sp|O32720|SP2AA_PAEPO        ---------------------------------LQIEMEHHRGVLI
ref|NP_833792.1|             ---------------------------------LSMQLEVKRDVLC
ref|NP_846529.1|             ---------------------------------LSMQLEVKRDVLC
ref|YP_001646701.1|          ---------------------------------LSMHLEVKRDVLC
RAAC02144                    ----------------------MNFLTRPHKERGCRVSVETKLERGIVV
                                                              :.:. :  .*   :

ref|ZP_02327651.1|           VRLQGELDHHTADMVKTRMEEAIAKGDARNLVLSLRDLSFMDSSGLGVIL
sp|O32720|SP2AA_PAEPO        VRLSGELDHHTSDMVRMQMDEAIQRRQCEHIVLSLKNLQFMDSSGLGVIL
ref|NP_833792.1|             VRLEGELDHHTAEELRTKVTDMIETHGVHHIVLSLENLSFMDSSGLGVIL
ref|NP_846529.1|             VRLAGELDHHTAEELRTKVTDMIETHGVHHIVLSLENLSFMDSSGLGVIL
ref|YP_001646701.1|          VRLEGELDHHTAEELRTKVTDMIETHGVHHIILSLENLTFMDSSGLGVIL
RAAC02144                    IELKGELDHHAVEQMRDRIEQQLAEHGYRGLVMSFRNIDFMDSSGLGLIL
                             :.* ******:  :  ::  :: : :      .  :::*:.:: ********:**

ref|ZP_02327651.1|           GRYKQITGRGGKMIVCDVNPSIYRLFELSGLFKIVAIEDNERKAISSL--
sp|O32720|SP2AA_PAEPO        GRYKLINQKGGEMAVCDVNPPVHRLLDMSGLFKIMPIYDNEVNALTEL--
ref|NP_833792.1|             GRYKHVKGLGGEMVVCAISPPVKRLFEMSGLFKIVRLEESEAHALATL--
ref|NP_846529.1|             GRYKHVKGLGGEMVVCAISPPVKRLFEMSGLFKIVRLEESEAHALATL--
ref|YP_001646701.1|          GRYKHVKGLGGEMVVCAISPPVKRLFEMSGLFKIVRLEESEAHALATL--
RAAC02144                    GRYRSVSEHGGKMALCEVNPTLRRLFEMSGLLKVIPVYDSEEAAVAAILG
                             ***: :.   **:* :* :.*.: **:::***:*:: : :.*  *:: :

ref|ZP_02327651.1|           -
sp|O32720|SP2AA_PAEPO        -
ref|NP_833792.1|             -
ref|NP_846529.1|             -
ref|YP_001646701.1|          -
RAAC02144                    A
```

FIG. 138A

```
ref|YP_001125957.1|    -HRLA---ETMKTVLDAAYEGVVVVDGNGMVREINRAYCQFLGIRREDAIGKHVTEVIEN
ref|YP_147806.1|       -HRLA---ETMKTVLDAAYEGVVVVDEDGVVREINRAYCQFLGIRREEAIGKHVTEVIEN
ref|ZP_01666100.1|     ----------LESAIESMFEGFVAVDKNGYITMMNQAYGEFLGVDAKEVIGRHVTEVIEN
RAAC02439              MHELAASGDVLRLILDSMYEGIVLVDAKGHIVEINQAYLKLLNMERDRVIGRHVTEVIEN
ref|ZP_01695872.1|     MAQTKNTAEILNAVLESAYEGIAVVDENGILIEFNEAYSRFTGIKREDAIGKHVTEVIEN
ref|NP_693661.1|       ------SAEIVEVILESAYEGVAMVDRNGIIVEFNDAYSRFTGVDKKEAIGHPVQEIIEN
                                :.   :::  :..    .* :    :*  .:  .:   . .: * *:*** ref|YP_001125957.1|    TRLHICVQSGIPERGYIQKIYGQPMVVHRIPIWRDGKVIGAVGMLIFQGVSEVYAIFQRL
ref|YP_147806.1|       TRLHICVQSGIPERGYIQKIYGQPMVVHRISIWRDGKVIGAIGMLIFQGVSEVYEIFRRL
ref|ZP_01666100.1|     TRMHIVAQTGKPEIGEVQRIGKHAVVVTRKPIIQDGEVVGAVGKILFKDVKDFKMLARKL
RAAC02439              TRLHRVVETGIPERGQLQRIRQHDMVVHRIPIWQGGKVVGAIGVLIFESIRDLYEIIERL
ref|ZP_01695872.1|     TNLHVTVKTAIPERGVIQYIQGQAMVVHRIPIWKGGRVVGAIGMLIFEGVSELYQIFERL
ref|NP_693661.1|       TNLHQTVKTGIAERGVIQYIQGQPMVVHRIPVWRNEELVGAIGMLIFEGVTELYQIYDRY
                       *.:*  .::. .* *  :* *    :  :**  *  .:  :.  ..::**:* ::*:.:  :.   :

ref|YP_001125957.1|    QELSR----EASRKEKNEAEASKQEAVASAAVGVERIIGRHPTIAAVKQMIRRAARVPST
ref|YP_147806.1|       QELSR----EASRKEKQETEAKPQETAASAPKGIERIIGRHPAIAAVKQMIRRAARVPST
ref|ZP_01666100.1|     NSLQS----ELEY-YKEELRK---VHGGK--YTIESIVGQSEKMEWLKTIAAKAAKGNST
RAAC02439              QEHAP----QVPS-ARPETEQGSEAHQVRWAYRIDDFLGQSRAVLDLRRMARKAAQTPVT
ref|ZP_01695872.1|     QQDSL---SARKE-KTGSKKMPDQAGFT-------QILGTSESISRVKRLARRAARTSAT
ref|NP_693661.1|       QEKKQ-----KMITEKHSRKEDSNPGQPD--NYLEQIIGQSEELTKLKRMTRKVAQTEAT
                       :.        . .            .   :*         :   :: :  .*:     * ref|YP_001125957.1|    VLITGESGTGKEVVARAIHEAGAHADGPFVSVNCAAIPEALLEAELFGYEDGAFTGAKKG
ref|YP_147806.1|       VLITGESGTGKEVVARAIHEAGPHADGPFVSVNCAAIPESLLEAELFGYEDGAFTGAKKG
ref|ZP_01666100.1|     VLILGESGTGKELFAHAIHNASARRHGPFIKVNCAALPESLLESELFGYDEGAFTGARKG
RAAC02439              VLITGESGTGKEVLAQGIHFESNRANGPFISVNCAAIPDSLLEAELFGYDEGAFTGAKRG
ref|ZP_01695872.1|     VLITGESGTGKELFAKSIHQLSTYARGLFITVNCGAIPEPLFESELFGYEEGAFTGAKKG
ref|NP_693661.1|       VLITGDSGTGKELFAKSIHQLSDYKSGPFVCVNCGAIPEQLFESELFGYEDGSFTGAKRG
                       *** *:******:.*:.**    .   * *: ***.*:*: *:******::*:****:.:* ref|YP_001125957.1|    GKPGKFQLAHGGTLFLDEIGDMPLAMQAKILRVLEEKKVEKVGGLSETEVDVRIIAATNK
ref|YP_147806.1|       GKPGKFQLAHGGTLFLDEIGDMPLAMQAKILRVLEEKKVEKVGGLSGTEVDVRIIAATNK
ref|ZP_01666100.1|     GKPGKIELANGGTFFLDEIGDMTLAMQAKLLRVLQEREIERVGGTKTNKVDVRIIAATNR
RAAC02439              GKPGQIELAHMGTLFLDEIGDMPLSMQAKLLRVLEDRQVQRVGGTVKREVNLRLISATNR
ref|ZP_01695872.1|     GKPGKFELAENGTLFLDEIGELSPAMQTKLLRAIQEKEAERVGGVKKYKTNVRIVAATNR
ref|NP_693661.1|       GKKGKFKLADNGTLFLDEIGEMPLAMQTKLLRVIQEKEYEKVGGLTKQPLKARVVAATNR
                       ** *::::**. **:******::. :**:*:*:**.:::::  : **:*     . *:::***:

ref|YP_001125957.1|    PLEEMVRDGTFREDLFYRLNIIRIHLPPLRERKTDIPALLAHHMERLCRQFGVVSKSFAK
ref|YP_147806.1|       PLEEMVRNGTFREDLFYRLNIIRIHLPPLRERKTDIPALLAYHMERMCRQFGVALKSFTK
ref|ZP_01666100.1|     DLEKMIERGEFRQDLYYRLNIISLHIPPLRERKEDIPLLCTALLKKINVQVQHWVDGVSP
RAAC02439              DLERMVEEGRFREDLYYRLNIIRLHIPPLRERKEDIPLLLAHYLDMTCERLGKPRMHLSS
ref|ZP_01695872.1|     NLEEMVEAGTFRADLYYRLNIIRIHLPPLRERKEDIPGLVSHFLKAFCRRYDLPEKRISS
ref|NP_693661.1|       NLKVMVEEGTFREDLYYRINVIELYIPPLRNRERDIPLLISSYLLTICKKYNMKKKEITP
                       *:  *:. * **  **::*:* ::.:****:*  *** *    :   :         .:

ref|YP_001125957.1|    EAMEVLINYSWPGNIRELVNVVEWLISMVE--GENIEREHLPAYL-------STIHPSVT
ref|YP_147806.1|       EAMEVLVHYSWPGNVRELVNVVEWLISMVE--GEKVEREHLPSYL-------STVQPAAS
ref|ZP_01666100.1|     EAMELLLAYDWPGNVRELENVLERAVNLMEEDERQILPEHLPPALKK-IHKAKDLDDGLK
RAAC02439              EVVERLLAYDWPGNVRELHMVEVLVSLC--DSAYVRLDDFPPHLHKLLQERSSRSPAIT
ref|ZP_01695872.1|     EAVAAMMAYGWKGNVRELANTVERLVTLAD--GPEISRGDLPEAIHEAQPAKDIYAESLI
ref|NP_693661.1|       EAMAVLMKYKWYGNIRELNTIEKLVILTE--NDMIDYHHLPNYMKR---EEFTIDNRLS
                       *.:     ::  :  * * **:***  :    :*     : :             .:*    :
```

FIG. 138B

```
ref|YP_001125957.1|      PMP---------------DGGAN---------IADQWKEIVYQSERERIAAALVAANGNK
ref|YP_147806.1|         SLP---------------NGGVK---------MADRWKEMVYQSERERIAAALVAAGGNK
ref|ZP_01666100.1|       DLA---------------GILCD-------------------TEKQAIYKALEATGGNK
RAAC02439                PSR---------------SPACDAVPGPAVGSPGAGARERMMQVERELIEAALRESGGNK
ref|ZP_01695872.1|       -SRA--------------------------------REAGEAQEKALIIRALKNAGGNK
ref|NP_693661.1|         PIHQ-------------------------------VKQQEHIRESELIRLTLEQTGGNK
                                                                 *    *   :*  :.*** ref|YP_001125957.1|      AEAARRLGIHRSTLYEKLKKYG--
ref|YP_147806.1|         AEAARRLGIHRSTLYEKLKKYGL-
ref|ZP_01666100.1|       SKAAKLLGIHRSGFYQKLHKYNI-
RAAC02439                SLAAKRLGVHRSTLYDKIKKLGIL
ref|ZP_01695872.1|       TKAAELLGIHRTTLYQKIKKYNL-
ref|NP_693661.1|         SKAAQKLGIHRTTLYQKLKK----
                         : **. **:**: :*:*::*
```

FIG. 139

```
ref|YP_001488778.1|      ----------------MTFTAQLREETEPLFEAIYQHPFVRGLAEGKLEKKQIIHYVKQ
ref|YP_081277.1|         ----------------MSFSAELRREADPIFEAIFEHPFVLGLASGRLEKEQLIHYVKQ
ref|YP_174256.1|         ----------------MSFTAELRKTADPIYKAIFSHPFVQGIGKGSLPADSLIHYVKQ
ref|YP_804091.1|         ------------------FSARLKAIAQPVLADIENHPFVRGIQAGAVPAAALMVYVEQ
RAAC00944                MGPSRVPLWPPAEEALLMSFSASLIAMSNPILDAILRHPFVRGIAEGNLSKAAAIRYVSQ
ref|YP_711801.1|         ------------------FSARLWASTEPVYEAILRHPFLTGLTDGTLPRAAFAHFVIQ
                                           *:*  *    ::*:   *  ***: *:   *  :        :* * ref|YP_001488778.1|      DAEYLQAFIKIYAAALSRCTDKEDIAFFHQQIEFVLDSETHPHQNLCRVAGVSYDGLQG-
ref|YP_081277.1|         DYEYLNAFIQIYGIAISKCQNRKDMEMFHEQISFVLDSEVHPKNLCRAAGVEYETLQG-
ref|YP_174256.1|         DFEYLNTFMQIYGIAISRCENREDMAMFAEQIGFILHSETHPHHNFCKVAGVRYEDLQY-
ref|YP_804091.1|         DTCFLDAFAKVYAGALSKCTTKDQMRFFEEQIRYTLNDEAGAHQILCDIAGQKLSDHQH-
RAAC00944                DQPYLETYLRVFAHAAALAPRHEDVADFHGRMSLLLGGETQAHDNLLRYAGATPHDVEG-
ref|YP_711801.1|         DAHYLRDYARALAVCAAKAPTEDDVRALANDAAEAVAAEQAMHVDLLDALGGPAPGDPAP
                         *   :*   ::   .  .:   .     ..:: :         :  *    *   :    * ref|YP_001488778.1|      --------APLAPSAHHYIHHMLQVAKEGTLGEMIAVLLPCPWTYWEIGKRMLTDVQPDP
ref|YP_081277.1|         --------YPLAPSAHHYVRHMLTAAHEGTLGEILAVLLPCPWTYWEIGKKLMKDVQPDP
ref|YP_174256.1|         --------EPLAPTAHHYTRHMLDVAHRGSLAEILAVLLPCPWTYQAIGDYLYETFQPKA
ref|YP_804091.1|         --------AKQRPITYLNEHLFNALRTGDLIDLIAAMLPCPWTYTEISQQI--VDGAAP
RAAC00944                --------QPKLPTLHHYESHLLASAARGDFAELVAAILPCHHVYVEIGQRLEPILEEKP
ref|YP_711801.1|         GGTPPGGVATVAPTTRAYTSYLLATVYGGSFLEGLAAVLPCYWIYARVGARL--LADSSP
                                  *       *  :::       *   : : :*..:***   *  :.  :      .

ref|YP_001488778.1|      SHPFYEWITFYG----GLTDSITVELCKRLDQLAEAASEKEKEKMKQHFILSCQLEYKFW
ref|YP_081277.1|         SHPFYDWICFYGN----RTDSITTKFCARLDEWAETAGKAEKEKMKELFLQSCQLEYGFW
ref|YP_174256.1|         NHPFFDWISFYRS---NGEMGVTKQFCKRLDELAAHATEQEKERMQDHFLKSCQLEYSFW
ref|YP_804091.1|         DNPFLPWIEFYQPQPGQIDGSMVKTLFGMVDELAIGLSEERQHEIEQRFLRSCELEYEFW
RAAC00944                DHPFAAWIRFYAD---PGMQDATHRLFAMIDREAAHFSTERARRVEAAFVASCHLEYRFF
ref|YP_711801.1|         DPVYARWIAAYGD---PAFQAVADRVVALTDRVGAFASEPELVRAADHFAVTARYEWMFW
                         . :  ** *          .              *. .         *    * :.. *: *:

ref|YP_001488778.1|      DMAFTVEEW------------
ref|YP_081277.1|         EMAYTVEDW------------
ref|YP_174256.1|         EMAYVKEKW------------
ref|YP_804091.1|         EQAYYQKDW------------
RAAC00944                DMAYRGESWLPKEALSDVSTP
ref|YP_711801.1|         DAAWRRETW------------
                         :  *:  :  *
```

FIG. 140A

```
ref|NP_646484.1|          ------------------------------------------------------------
ref|YP_001332652.1|       ------------------------------------------------------------
ref|NP_372249.1|          ------------------------------------------------------------
ref|NP_764957.1|          ------------------------------------------------------------
ref|ZP_01695369.1|        ----------------------------------------------------------MI
RAAC02632                 ----------------------------------------------------------MF ref|NP_646484.1|          KKILFDVDGVFLSEERCFDVSALTVYELLMDKCYLGLHSHIDWETLT--DNDIQDIRNRI
ref|YP_001332652.1|       KKILFDVDGVFLSEERCFDVSALTVYELLMDKCYLGLHSHIDWETLT--DNDIQDIRNRI
ref|NP_372249.1|          KKILFDVDGIFLSEERCFDVSALTVYELLMDKCYLGLHSHIDWETLT--DNDIQDIRNRI
ref|NP_764957.1|          KAILFDVDGVFLSEERCFDVSAITVAELLSSPDFLNCDIDIHFDGNLTEND-INKIRRNV
ref|ZP_01695369.1|        QTVLFDVDGVLLSEERYFDASGLTVWELIHSGHYLGLAPEQFKTTLTDEE--IRRIRADV
RAAC02632                 RTILFDVDGVMLSEERYFDASALTVHELLTSQRFLGLSSVSPAFSPAPAEDAIRAIRRDV
                          :  :******::***** **.*.:** **:.  . :*.           :  *. ** :

ref|NP_646484.1|          FQKDKILNKLKSLGLNSNWDMLFIVFSIHLIDILKKLSHDEIEAFMYQ-----DEPVELK
ref|YP_001332652.1|       FQKDKILNKLKSLGLNSNWDMLFIVFSIHLIDILKKLSHDEIEAFMYQ-----DEPVELK
ref|NP_372249.1|          FQKDKILNKLKSLGLNSNWDMLFIVFSIHLIDILKKLSHDEIEAFMYQ-----DEPVELK
ref|NP_764957.1|          FNNDRILNQLKSLGLNSNWDMLFIVFSIHLIDKAKQLKPSLRDQLLDE-----LLFTKET
ref|ZP_01695369.1|        FQHDEVLRFLKSRGMNANWDMIYLTFTCQLLHLLSQIKEKEAGRIRGW---LASEIGDVT
RAAC02632                 FRYDAVLEGLKNIGVNANWDMVYFVFVAEWVAALERAREASEEAVDRARSVLREGFSEAS
                          *. *  :*. **. *:*:****:::.*     .:   .:          .      . .

ref|NP_646484.1|          LQN---ISTNLADCFNLNEQLPLQFLDNVKVGKNNIYAALEEFATTELHVSDATLFSLKG
ref|YP_001332652.1|       LQN---ISTNLADCFNLNEQLPLQFLDNVKVGKNNIYAALEEFATTELHVSDATLFSLKG
ref|NP_372249.1|          LQN---ISTNLADCFNLNEQLPLQFLDNVKVGKNNIYAALEEFATTELHVSDATLFSLKG
ref|NP_764957.1|          LKE---IAKDLTDKT-INYSLPYDVIASFRNGKDAIYEDLEVYAKNQLELNNTSLFKLKS
ref|ZP_01695369.1|        LHE----MREVLAHYPVE-TDYSIFLNWFAKRPETKQDLLKVLDQLAYEIFGLTDTQLGK
RAAC02632                 LRAIGGLLREALPGYVIAWKGYDALYEGASSRSDLMERAREALARYAPEAD---------
                          *:          :        :           :            :      .

ref|NP_646484.1|          --------ALWTLAQEVYQEWYLGSKLYEDVEKKIARTTFKTGYIYQEIILRPVDEVKVL
ref|YP_001332652.1|       --------ALWTLAQEVYQEWYLGSKLYEDVEKKIARTTFKTGYIYQEIILRPVDEVKVL
ref|NP_372249.1|          --------ALWTLAQEVYQEWYLGSKLYEDVEKKIARTTFKTGYIYQEIILRPVDEVKVL
ref|NP_764957.1|          --------ALWTLAKDIYQEWYLGKALFNQVEYKKDIQDFKKGFIYDEVILKPIEEIQLL
ref|ZP_01695369.1|        ------KGALWSVCEHASQEWYVGDQNIVASTGKPSVQTGKKGFLDEEIPLAEPEKIGAL
RAAC02632                 ------AHALWQVGQETFQEWYLGD----AYTGK---ETGKAGFLTSEYPIVDPAAFAAL
                                  * : :.  **:*.     *     *  *:: .*  :     . * ref|NP_646484.1|          LNDLKGAGFELGIATGRPYTETVVPFENLGLLPYFEADFIATASDVLEAENMYPQARPLG
ref|YP_001332652.1|       LNDLKGAGFELGIATGRPYTETVVPFENLGLLPYFEADFIATASDVLEAENMYPQARPLG
ref|NP_372249.1|          LNDLKGAGFELGIATGRPYTETVVPFENLGLLPYFEADFIATASDVLEAENMYPQARPLG
ref|NP_764957.1|          LQNLIEAGYQIAIATGRPRTETIIPFQSLGLKSYFKDEHIVTASEVLLAEKQFPQYQPLG
ref|ZP_01695369.1|        FSFLAEKGLKLGVGTGRPQLETYGPFRALGWLPLFHEEHIVTADDVLKAEEELGGHTPLA
RAAC02632                 LADLKAAGVTLGIATGRPEIETRVPLEHFGWLSYFDPARVTNASDVVAAEERVPHARPLS
                          :  *   *    :::.**** **  *:. :*   *.     :...*.:*:  **:  **.

ref|NP_646484.1|          KPNPFSYIAALYGN-NRDKYESYINKQDNIVN-KDDVFIVGDSLADLLSAQKIGATFIGT
ref|YP_001332652.1|       KPNPFSYIAALYGN-NRDKYESYSNKQDNIVN-KDDVFIVGDSLADLLSAQKIGATFIGT
ref|NP_372249.1|          KPNPFSYIAALYGN-NRDKYESYINKQDNIVN-KDDVFIVGDSLADLLSAQKIGATFIGT
ref|NP_764957.1|          KPNPFSYIATLNGN-YNDQYERYATKQEDIVN-KDEVYIVGDSLADLLSAKKIGATFIGT
ref|ZP_01695369.1|        KPNPFTYLLALKGK--NTPARDCT-ECSLPLENGQEILIVGDSLADLLAAQKIGAQFAGI
RAAC02632                 KPHPFSYLRSLMGE--ADVEKLLTVELPIPGIRG-EVLVVGDSIADKLAADRLGASFAAV
                          **:**:*:  :* *:          :       ::.:****:** *:*.::** * .
```

FIG. 140B

```
ref|NP_646484.1|         LTGLKGKDAAGELEAHHADYVINHLGELRGVL------
ref|YP_001332652.1|      LTGLKGKDAAGELEAHHADYVINHLGELRGVL------
ref|NP_372249.1|         LTGLKGKDAAGELEAHHADYVINHLGELRGVL------
ref|NP_764957.1|         LTGLKGKAAHSELVANGADHVVEDITKIRKIL------
ref|ZP_01695369.1|       LTGLSGKEAKAEFEEHGADYIFENVADLKNI-------
RAAC02632                LTGLEGQAARPKFERLGADYILNHVLELRRVLSLASVE
                         ****.*: *   ::     **::.:.: .:: :
```

FIG. 141

```
ref|ZP_02329050.1|        ------VKVADLVRTFKLEVISGEEGLKRTITVADLYRPGLEMAGYFNYHPQERVQLLGK
gb|AAX09759.1|            ------VKVSELVNQFGLEVISGEQGLKRAITVDDLYRPGLEMAGYFEYHPPERVQILGK
ref|YP_148935.1|          ------VRTKDIIEQFQLELVSGAEGIYRPITTSDLSRPGIEMAGYFAYYPAERLQLLGR
ref|YP_001127122.1|       ------VRTKDIIEQFQLELVSGAEGIYRPITTSDLSRPGIEMAGYFAYYPAERLQLLGR
ref|YP_001376898.1|       ------VRTKDLIEQFQLELVSGEEGIHRPIDTSDLSRPGIEMAGFFTYYPADRVQLLGK
RAAC02474                 MANLRGVSVRQLVRDLDLHVFNEDADLDRMIYTRDINRPGLALAGYLRYHPAERVQILGR
                                * . ::: . : *.: . .   .: * *  . *: *** :  :**::  *:*  :*:*:*:

ref|ZP_02329050.1|        TEMSFYETLTGPIRQRRARQLCTSPETPCIIITRGLDIPDEIIEEAAKHHLPVLRSKVAT
gb|AAX09759.1|            TELAFFEMLPEKERKDRMERLCSSDETPCIIVTRSWKVPEELIEISSEKQIPVLRSSMAT
ref|YP_148935.1|          TELSFYETLTPEEKKSRMERLCT-DITPGIIVSRGLEVPPELIEASERQSVPVMRSTMKT
ref|YP_001127122.1|       TELSFYETLTPEEKRARMQRLCT-DITPGIIVSRGLDVPPELIEASERQSVPVMRSTMKT
ref|YP_001376898.1|       TELTFFDTLTNDQKQERMKALCT-EETPCIIVTRNQDVPKELLQASRESGVPLLRSSQTT
RAAC02474                 TELSFLRGLNEKERALRAFAFCSYQQTPCIIITRGDTPPPVLLEEAASRRIPVLGTPMVT
                          **::*   *     :    *  :*:     ::*.  *   :::  :   :*::  :    * ref|ZP_02329050.1|        TILASRLTNYLENKLAPSTTIHGVLVDVYGVGMLITGGSGIGKSETALELVKRGHRLVAD
gb|AAX09759.1|            AILSSRITSFLERKLAPTATIHGVLVDVYGVGMLITGSSGIGKSETALELVKRGHRLIAD
ref|YP_148935.1|          TRLSSRLTNYLESKLAPTTAVHGVLVDVYGVGVLITGKSGVGKSETALELVKRGHRLVAD
ref|YP_001127122.1|       TRLSSRLTNYLESKLAPTTAVHGVLVDVYGVGVLITGKSGVGKSETALELVKRGHRLVAD
ref|YP_001376898.1|       TRLSSRLTNYLEGKLAPTTAVHGVLVDVYGVGVLIIGQSGVGKSETALELVKRGHRLVAD
RAAC02474                 TRLTARISNYLEDKLAPETLQHGVLVDVYGIGILIIGSSGIGKSETGLELIKRGHRLVAD
                          : *::*::: .:** ****  :  *********:*:** * **:***** .***:*****:**

ref|ZP_02329050.1|        DAVEIRQTADYVLSGNAPELIRHLLEIRGVGIINVMTLFGAGAVRNEKKISVVVKLETWQ
gb|AAX09759.1|            DAVEIRQTSDNQLHGTAPELIRHLLEIRGVGIINVMTLFGAGSIRNNKRISLVVRLEAWQ
ref|YP_148935.1|          DCVEIRQEDEDTLVGSAPELIEHLLEIRGLGIINMMTLFGAGAVRTHKRISLVVDLELWD
ref|YP_001127122.1|       DCVEIRQEDEDTLIGSAPELIEHLLEIRGLGIINMMTLFGAGAVLPHKRISLVIDLELWD
ref|YP_001376898.1|       DSVEIRQEDEDTLVGSSPDLIEHLLEIRGLGIINVMTLFGAGAVRNYKRITLVINLEIWD
RAAC02474                 DAVVIRQISDDYLVGSAPPLLQNLIEIRGLGVLNAMTLFGAGAVRTHKRISMVVHLEAWR
                          *.* ***   :    * .:* *:..:*:****:*::* *******::    *:*::*: ** * ref|ZP_02329050.1|        QDKQYDRLGLDEETTRIIDTDLPLVTIPVRPGRNLAVIIEVAAMNYRLKRMGYNAALQFT
gb|AAX09759.1|            QEKQYDRLGLDEETTRIIDTDVPLVTIPVRPGRNLAVIIEVAAMNFRLKRMGYNAALQFT
ref|YP_148935.1|          PEKQYDRLGLEEEKVKILDTELPKLTIPVRPGRNLAVIVEVAAMNFRLKRLGVNAAEEFS
ref|YP_001127122.1|       PEKQYDRLGLEEEKMKILDIELPRLTIPVRPGRNLAVIVEVAAMNFRLKRMGVNAAEEFS
ref|YP_001376898.1|       QNKNYDRLGLEEETLDTELTKITLPVRPGRNLAVIIEVAAMNFRLKRMGVNAAQQFS
RAAC02474                 DNHAYDRLGIETETMKILDIELPKVTVPVRPGRNLAVIVEVAAMNFRLKGMGLDAAKQFA
                          :: *****::  *. . :*:*  ::  .: :************:*****:*** .: :** :*:

ref|ZP_02329050.1|        NRLTETIA-------
gb|AAX09759.1|            TKLTETIS-------
ref|YP_148935.1|          ARLSDAI--------
ref|YP_001127122.1|       ARLSDAI--------
ref|YP_001376898.1|       ERLMSAI--------
RAAC02474                 AELEQMIAAQSEGSA
                           .*  .  *
```

FIG. 142

```
ref|NP_244107.1|        MNTTIYDVAREAGVSMATVSRVVNGNPNVKPATRKKVLEAIERLGYRPNAVARGLASKRT
ref|YP_176259.1|        MNTTIYDVAREAGVSMATVSRVVNGNPNVKPTTRKKVLEAIERLNYRPNAVARGLASKRT
ref|YP_148663.1|        MTVTIYDVAREANVSMATVSRVVNGNPNVKPSTRKKVLEAIERLGYRPNAVARGLASKKT
ref|YP_001126805.1|     MTVTIYDVAREANVSMATVSRVVNGNPNVKPSTRKKVLEAIERLGYRPNAVARGLASKKT
ref|ZP_01188060.1|      MKPTIKDVARKANVSVATVSRVLNNQPGYSVETEKKVLEAIDELGYHPNALARGLVGKRT
RAAC00625               MRATIRDVAKAAGVSAATVSRALNRPDLVDPETLERVRKAMEEMSYQPSAIARGLSARRS
                        *  ** ***: *.** *****.:*        *  ::* :*::.:.*:*.*:**** .::

ref|NP_244107.1|        TTVGVVIPDISSIFFAELARGIEDIATMYKYNIILCNSDQNKEKEIHLINTLLEKQVDGI
ref|YP_176259.1|        TTVGVIIPDISSIFFSELARGIEDIATMYKYNIILCNSDQNKDKEIHLINTLLEKQVDGI
ref|YP_148663.1|        TTVGVIIPDISSIFFAELARGIEDIATMYKYNIILSNSDQNKEKELHLLNTMLAKQVDGL
ref|YP_001126805.1|     TTVGVIIPDISSIFFAELARGIEDIATMYKYNIILSNSDQNKDKELHLLNTMLAKQVDGI
ref|ZP_01188060.1|      KTLGVLIPRISNMVSSQIMNGIEDAAHKNDHSVIICNTDNDGQKTMVYLDVLREKRVDGI
RAAC00625               DTLGLIVPGITDFFFNELYKGIDRASQQYGMKVLLYDSEHSRERAFEGFSILSGYQVSGI
                        *:*:::* *:..:  .**: :            .:: ::::. ::  :. :  :*.*:

ref|NP_244107.1|        VFMGGEITNEHAEEFKRAHVPVVLAATLDAEK-EIP-SVNIDYKQAAFDAVTYLIEKGHT
ref|YP_176259.1|        VFMGGEITEEHAEQFKRAPVPIVLAATLDDEKS-FP-SVNIDYTQAAEDAIQFLIEKGHK
ref|YP_148663.1|        LFMGGTITDEHVAEFQKSSVPIVLAATMGPNEIP---SVNIDYEQAAFEAVTYLLEKGNR
ref|YP_001126805.1|     LFMGGTITEEHVAEFQKSSVPIVLAATIEPNET-IP-SVNIDYEQAAFEAVTYLLERGNR
ref|ZP_01188060.1|      IVVSEMLTEEYANKLVELKVPVILISTIDETGQFP--HIKVNDEQAAYQATEYLISKGHK
RAAC00625               IFTSKLVTEDYDPILQRVNIPVVLTLTQSAAKTPLT-AFRIDEVRAMFDVVAYLVSRGHR
                        :.. . :*:::   :.  :*::*  *        ..:: :*  :. :*::*:*:

ref|NP_244107.1|        SIGMVSGSL-EDPVNGYQKYAGYREALEERGVAFDESMVVIGDYTYDSGIDAM-NVFTK-
ref|YP_176259.1|        RIGMLSGSL-EDPINGYQKFAGYRQALQKNNIEFDENLIVIGDYTYDSGMEAM-DAFL--
ref|YP_148663.1|        RIVYVTGPT-DDPIN-QRKLAGYRRALEEHGAPYEEELVIEGDNSYDSGLEAYEKITE--
ref|YP_001126805.1|     RVAYVTGPT-DDPIN-QRKLAGYRRALEEHGVPYDEELVVEGDNSYDSGLEAYEKIAE--
ref|ZP_01188060.1|      NIAMISGTP-EDMVAGKPRLDGYKKALRENGLPVKEENIVFGDFWFDSGKECMERLLNN-
RAAC00625               QIAMIAGKLWDDRTG-ELRLEGYREGLRHFGIEYCEARVEFGQYRFDDGYQAMQRLLER-
                         :  ::*   :*     :   **:..*...  *    :  *: :*.* ::

ref|NP_244107.1|        -LEKRP--TAIFVATDEMALGVIHGAQDHGLNIPDDIEVIGFDNTRLATMVRPTLSTVVQ
ref|YP_176259.1|        ALDEKP--TALFASNDEMALGVIHGIQDRGYDVPGDIEVLGFDNTRLATMVRPTLTTVVQ
ref|YP_148663.1|        -LAERP--TAVFAGTDEMALGIIHSDHGGRVPDELEVVGFDNTRLATMVRPRLTTVVQ
ref|YP_001126805.1|     -LAERP--TAVFAGTDEMALGIIHSAQDQGVRVPDELEVVGFDNTRLATMVRPRLTTVVQ
ref|ZP_01188060.1|      --NQGI--TAIFVASDEMAAGALSTAYKSGIRVPEDISIIGFDNTQLAEMTIPPLTTVSQ
RAAC00625               -IRDVP-FTAVCTASDEMALGAIRCLNDHGYRVPDDISVMGFDDLPIARMVTPRLTTVAQ
                          .  : ...** * :    . *  :* ::.::***   :* *. * *:** * ref|NP_244107.1|        PIYDIGAVSMRLLTKYMNK----EEVSEHI--VELPHRIEFRQSTR---
ref|YP_176259.1|        PLYDIGAVSMRLLTKLMNK----EEVDNYT--VTLPHRIESRGSTK---
ref|YP_148663.1|        PMYDIGAVAMRLLTKYMNK----EPVDHHI--VVLPHRLEVRESTK---
ref|YP_001126805.1|     PMYDIGAVAMRLLTKYMNK----EHVDNHI--VVLPHRLEVRESTK---
ref|ZP_01188060.1|      PFYQMGYKGLKLLLKAI------KGKEVNS--AILPHVIVERETVKKV-
RAAC00625               PFHEIGEEAVKWLIRAASQ----PPSPSEIGDYLLPHRLVERESVRSIS
                        *::::*  .::  *  :             *** :  *  :.:
```

FIG. 143

```
ref|YP_001488326.1|      --------------MVEKTVTIQLKTGLQARPAALFVQEANRFGADIFLEKDGKKVNAKS
ref|ZP_01860336.1|       -------------MIEQKVEVKLKTGLQARPAALFVQEANRFSSEVFLERNGKKVNAKS
ref|NP_693386.1|         --------------MVEKLVTVELDTGLQARPAAQFVQEANRFSSHVFLEKDDKKINAKS
ref|NP_834817.1|         -------------MVQKRVQVSLKNGLQARPAALFVQEANRFHADIFIEKDGKTVNAKS
ref|ZP_01697803.1|       -------------MIEKQLEVKLKSGLQARPAAQFVQEATRFSSEIFLEKEGRKVNAKS
RAAC00733                -------------MVEKVLTVNLPQGLAARPAAEFVKRASSFSSQIRIGKNGHFVDAKS
                                      *::: : :.*   * :.*. *  :.: : ::.: ::*** ref|YP_001488326.1|      IMGLMSLAISSGVTITLIADGADEQEAIEALTDFVNQE---
ref|ZP_01860336.1|       IMGLMSLAVSSGTEITLIADGTDEEQAVKHLTEFVQKES--
ref|NP_693386.1|         IMGLMSLAITKGEQIKLIAEGPDEDTAIEHL----------
ref|NP_834817.1|         IMGIMSLAIGTGSMITITTEGSDAEEALEALA---------
ref|ZP_01697803.1|       IMGLMTLAAGHGETVTLSVDGSDEEEAFEHLANYI------
RAAC00733                VLGVMSMAIARGESVTLQAEGSDAERAVETLAELLSRDTFE
                         ::*:*::*    *   :.:  ..:*.* : *.: *
```

FIG. 144

```
ref|NP_244433.1|        ----MVEKQVEVKLKTGLQARPAALFVQEANRFTSEIFIEKDGKKVNAKSIMGLMSLAIG
ref|YP_001488326.1|     ----MVEKTVTIQLKTGLQARPAALFVQEANRFGADIFLEKDGKKVNAKSIMGLMSLAIS
ref|ZP_01171669.1|      ----MVEKQVEVKLRTGLQARPAALFVQEANRFSSDIFLEKDGKKVNAKSIMGLMSLAVS
ref|ZP_01860336.1|      ------------------------FVQEANRFSSEVFLERNGKKVNAKSIMGLMSLAVS
ref|ZP_02327791.1|      ------------------------FVQEANKFSSEIFVEKDEKKVNAKSIMGIMSLAIS
RAAC02466               MVMKMFEKETIVRLRGGLFARAAAKFVQEATRFKSEVFVERDGKTVNAKSIMGVMSLAIP
                                                *****.:* :::*:*:: *.********:****:

ref|NP_244433.1|        SGSTITLITEGNDEQEAMEALIAFIEKE----
ref|YP_001488326.1|     SGVTITLIADGADEQEAIEALTDFVNQE----
ref|ZP_01171669.1|      TGSVVNLVADGSDEEEALEELSQYIQQE----
ref|ZP_01860336.1|      SGTEITLIADGTDEEQAVKHLTEFVQKE----
ref|ZP_02327791.1|      TGTEIYISAEGSDDEQAVNALVSLVSKEEL--
RAAC02466               SGERVIIRASGTDEQAAVHQLTKLIESEELFV
                        :*   :  : :.* *:: *:. *    :..*
```

FIG. 145

```
ref|YP_001124914.1|    ------------------------------------------------------------
ref|YP_146760.1|       ------------------------------------------------------------
ref|YP_001319371.1|    ------------------------------------------------------------
ref|ZP_00742387.1|     ------------------------------------------------------------
ref|ZP_01723416.1|     ------------------------------------------------------------
RAAC02678              MGVRLRGGRADGGRAHQAVARQVPRGRVSVSHPHRARVGLSPGGERVKERAASRGSDDDF ref|YP_001124914.1|    ------------------------------------------------------------
ref|YP_146760.1|       ------------------------------------------------------------
ref|YP_001319371.1|    ------------------------------------------------------------
ref|ZP_00742387.1|     ------------------------------------------------------------
ref|ZP_01723416.1|     ------------------------------------------------------------
RAAC02678              RARHQRWQWREALDRLLWMSCWSFVLLSASYGVVRLMGRALGWRPVPYGQLMIIGGVGVV ref|YP_001124914.1|    --------------------------AINRIAKGDF--RVNLQVDWGGR--HHPFAELVT
ref|YP_146760.1|       --------------------------AINRIAKGDF--RVNLQADWGGR--NHPFAELVT
ref|YP_001319371.1|    --------------------------ALESIAKGNF--NVRLDDKFKK---DESFSRLVK
ref|ZP_00742387.1|     --------------------------IQKIAKGDFSVKIRNEEKY-----DGEIGVLVK
ref|ZP_01723416.1|     --------------------------ALRQMAKGDFNIQ--LDVK-GNK--EDQFGQLIH
RAAC02678              MLALVALLWNALGFDRDDRLFFRILDSLSEIGRGNFSARAMLEVRRGFP--DHPMNQLVL
                                                 : ..:*:*   .   :            . :  *:

ref|YP_001124914.1|    RINDMAANLQAMEDMRQEFISNVSHEIGSPLTSIRGFARALKNENLSQEQRMHYLDIIET
ref|YP_146760.1|       RINDMAANLQAMEEMRQEFISNVSHEIGSPLTSIRGFARALKNEDLSREQRLHYLDIIET
ref|YP_001319371.1|    SVNMMASGLDQMEKMRQEFISNVSHEIQSPLASIQGFAQLLQNDELSPEERKHYLSIIET
ref|ZP_00742387.1|     SINDMTDELNTMEKMRQEFVSNVSHEIQSPLTSIKGFARALQDDNLSEEKRKHYLTIIET
ref|ZP_01723416.1|     GINHMAVELGELERMRQEFISNVSHEIQSPLTSINGFAKALKNIHLPEEKRQHYLEIIEL
RAAC02678              HVREMAEGLERIEQMRQEFVANVSHEMQTPLTSILGFVKALKSDGLSEGERRHYLDIIEA
                        :. *:  *   :* ***:: *: :: .:  *:. *.  :* * * ref|YP_001124914.1|    ECVRLSKLSENLLRLAMLDSERYPLHPTSYRLDTQLQTLILHCEPQWAEKDVDMCAVMEK
ref|YP_146760.1|       ECVRLSKLSENLLRLAMLDSDHYPFHPTSYRLDTQLQTLILHCEPQWAEKELNMCVLFEK
ref|YP_001319371.1|    ESKRLSKLSDSLLKLAILESDSMRFEPKAYRLDKQLRNLILACEPQWREKRINMEAFLDE
ref|ZP_00742387.1|     ETTRLSKLSQNLLKLTLLESEEYTPERVSYRLDQQLKQIVLNSEPLWAEKEIELDLDLEK
ref|ZP_01723416.1|     ESNRLSKISDNLLKLTSLESQHHPFETTTYRLDNVILALEPNWVAKQLDFDLHLDN
RAAC02678              ESERLSRLADNLLKLTSLESGHHPVTLTRFRLDRQLREVAIACEPLWTEKGLFLDMQVEP
                       *    ***::::.**:*: *:*        :*** **:  : :  ** *   *  :     .:

ref|YP_001124914.1|    VSITADEDLLSQVWLNLIHNAIKFTPKGGTITVQVQRRGEQAIVTISDTGPGIPKHDQPR
ref|YP_146760.1|       VIITADEDLLSQVWLNLIHNAIKFTPKGGTITIQLQRRGEQAIVTVSDTGPGINEHDQLR
ref|YP_001319371.1|    VTITADEDMMSQVWINLIYNSIKFTPEGGSVRVDLNQHGKTIVCKISDTGIGIPEEDQKH
ref|ZP_00742387.1|     VHVTADQESMSQVWINLIHNSIKFTPSGGTITIQLKEHETVVEVRICDSGIGISEEQKQH
ref|ZP_01723416.1|     ITITADEDLLNQVWMNLLTNSIKFTSDRGAITLTMTQHLDTITIIVQDTGIGLSEEQQMH
RAAC02678              VELEGDEDLLGQVWMNLLSNAIKFTEPGGRIQVRLEKEETGVCVSVADTGIGIRPEDVSR
                       :   :  .*::  :.***:**:  *:****    *  :    .  :      : *:* *:  .:   :

ref|YP_001124914.1|    IFERFYKVDKSRHRAAGGSGLGLAIAKQIVDMHHGTISVQSEPGEGATFTVELP------
ref|YP_146760.1|       IFERFYKADKSRHRAAGGSGLGLSIAKKIVDIHHGIISVQSQPGEGATFTVELP------
ref|YP_001319371.1|    IFERFYKADKSRERSKKGGGLGLSITKKIIDMHYGDISVQSKSGTGTTFTVSLP------
ref|ZP_00742387.1|     IFERFYKADSSRNASGGSGLGLAIVKKVLDLHQGEIKVESEEGKGTEFIVRIP------
ref|ZP_01723416.1|     IFERFYKADQSRTAANGGSGLGLAIVKKIIDMHHGTIAVESKLGKFTAFLITLP------
RAAC02678              VFTRFFKADRSRGKP--GNGLGLAIAKRIVEMHRGDISVESEPGRGSTFKVHLPYTQGGR
                       :* **:*.* **    .  *.*****:*.*::::*  * *  *:*: *    :  * : :*
```

FIG. 146

```
ref|YP_001394884.1|     --------------------------------------------------DLMFLST
ref|ZP_01574787.1|      ---------------------------------------EIGTYGDNYLNEHDIAFIND
ref|ZP_02185068.1|      ----------------------------------------ISYMGPTAYSEHDALFIAD
ref|YP_001559227.1|     ----------------------------------------ISYYGPYFLSENDFKFLSA
RAAC02507               MSLRRKIILAFFLTLSIMLVALAFILQAEVHRHFLSVVCPEINSVSPSLTQQIEVHFEQA
ref|YP_517080.1|        ------------------------------------------------------FVSA
                                                                              * ref|YP_001394884.1|     LNR-ILISVGIISLCLALILGVIISGSLSRPILRVIESAEEISKGDYSTRIN-ENSNIIE
ref|ZP_01574787.1|      LYK-LLWAVGLFSLILSLLFGTVMSKRLVSPIARVINTAKSISKGFYSDRIT-EKSNTRE
ref|ZP_02185068.1|      MKN-NLIIVAIVALILSIFFAALVAKKISGPIVRVKDFTREIAKGDY-TSLSPEKTDIKE
ref|YP_001559227.1|     LNT-ILVSIGSVSLLFAVYIGWMLARKISGPITKTVKMTTEIAEGNYEIRFS-EHTGTKE
RAAC02507               LTQSLLWTV-LIFVVATAGVAVLVSRAITQRIFVMQKQALEIARGKWGTTIP--VEGHDE
ref|YP_517080.1|        IYQ-SLLFAGALALIIGILLSYWTSRRLISPLQNLTKAAQRVGEGHLDEHVS--VMTKDE
                          :    *     :  .   :   :  .. .  : ..*   .      * ref|YP_001394884.1|     INNLTSTINNLAETLQNQENLRKRLTADVSHELRTPLTTLQSHMEAILDGIWEPTQDRIN
ref|ZP_01574787.1|      INQLTVSINDLAENMEKQETLRRRLTGDVAHELRTPLATLQSHMEAMIDGIWSADSERLK
ref|ZP_02185068.1|      LDELISSVNALSVQLENQQDIRNQLSSDIAHEIRTPLTTLKGSLEAMIDGIWEITDDRLQ
ref|YP_001559227.1|     LDALVSSINNLASSLEKQEGIRKQLTSDVSHELRTPLTTIGTHIEAMIEGVWEPTTERLK
RAAC02507               LSSLANTLNSLSKQLHKQEELRRNLIQDLAHELRTPLTTLRSHIQAFYDGLWEPNRERLY
ref|YP_517080.1|        VGQLAIAFNGMADSLKKQEHLRKQFTADIAHELRTPLTSIRSYIEAFQDGVLPADKENLT
                        :. *   :.*  ::  .:*: :*..: *::**:****:::   ::*:  :*:    :.:

ref|YP_001394884.1|     SCHGEIMRINRMVNDLEKLAE--YEGENLI----LNKSEFNISEVVKNIMLNFENEYVSK
ref|ZP_01574787.1|      SCHEEIVRISKMVGDLERLAK--YESENIT----LNMDTFDITKLAKRQVQNFETEFLCK
ref|ZP_02185068.1|      SCYDEVNRITRLIGSIDKINE--IESHQDS----LNKTSFDLYALAENISSNFEALFVKK
ref|YP_001559227.1|     SCYEEINRITNLVKDLEQL--AKVENDNLK----LNITSVNILEVIDTIKDNFETEIYNK
RAAC02507               SCLEEIQRFEALVTSVERLYEADVAVHAAR----RDLSSADVNQVAQSVIQLFEPRCAEL
ref|YP_517080.1|        IINEEIERLVGLSSDLKDLNVAEMG--ALK----LNFTQVDITELIDKTVNKLIPLIQEK
                          *: *:   :  .:. :                :   ::  :  .    :

ref|YP_001394884.1|     EI-------DFIFNSRDI--FICADKDKISQIIINLISNALKYTRQGGKVLIQVDNKNEY
ref|ZP_01574787.1|      GL-------ELELTGPSCLVY--ADKDKISQVFVNLLSNALKYTPKGGSVELHIQDNNNF
ref|ZP_02185068.1|      NI-------YYALNGD--PLFITADKDKISQVITNLLSNAVKFTPPEGTITLKIRNEENQ
ref|YP_001559227.1|     SL-------DVSVIGTAS--TILVDKERISQVIINLLSNAIKYTPDFGKIVISLEDYETN
RAAC02507               GIR------LELRTPDVPVWVTARAQHVSQILWNLLDNAVKFTPSGGNIVVEVGHQDGK
ref|YP_517080.1|        GIA------FEWEKP-ASVFIEGDEYHLTRLFYNLIHNAYKFTESNGRISIQMELRQSD
                        :              :::::: **: ** *:*   *   :  :   :

ref|YP_001394884.1|     LELIVQDNGQGIPKEDLPYIFERFYRADKSRNRLTGGAGIGLTITKSLVEAHKGKITVES
ref|ZP_01574787.1|      IEISVEDNGLGIPEEDLPYIFERFYRADKSRDRLTGGSGIGLTICKSIVLAHGGDIYAQS
ref|ZP_02185068.1|      ALLTIADTGEGIHPKEINRIFERFYMSDLSRNSFLGGQGIGLSIVKSIIKAHNGTITVKS
ref|YP_001559227.1|     LVIQMKDNGIGIPEEELPFIFERFYRADKSRNRRTGGAGIGLAIVKSVVHSGGKVEVSS
RAAC02507               PFLSVKDSGVGIPAEEIDNIFERFYRVDKSRDRKTGGSGLGLAIVKQLVELSRGFVQVNS
ref|YP_517080.1|        VRISVCDSGIGIPKEDLPFIFERFYRAEKSRSRETGGTGIGLALVQQITQLHRGTLDVES
                        : :   *.*      ::: **   :  .    ** *:**::  :.:     *  :   ..* ref|YP_001394884.1|     ELNKGTTFKVSIP-
ref|ZP_01574787.1|      NPGKGTKFIFTVPK
ref|ZP_02185068.1|      DYGKGSTFTVILP-
ref|YP_001559227.1|     KLETGTVFRVILP-
RAAC02507               RVGRGSTFTVVWPE
ref|YP_517080.1|        NPGQGSKFTVVLP-
                          *: * . *
```

FIG. 147A

```
ref|ZP_01667455.1|        MFQRTLRRLSIINSVVFLLIFLTFGAVLYGYVAYRLFDKVDDAMRFKAENFKIVNGRAIL
ref|YP_146183.1|          ------------------------------------------------------------
RAAC00906                 MFRKTALRLVLLYTVVFAGILLLLFSAVVYAFTDHRVRADEIATMSTAAANLRACRDEQIL
ref|ZP_01515931.1|        ------------------------------------------------------------
ref|YP_001637100.1|       ------------------------------------------------------------
ref|YP_001430381.1|       ------------------------------------------------------------ ref|ZP_01667455.1|        PGRVRFLFDPRIIILVRDSQGRVTSSFPSEVAELERL------------AALASQVDAGK
ref|YP_146183.1|          ------------------------------------------------------------
RAAC00906                 PGDR---DDDGEASPLHRGHSSGPGPDGDRLLAEVDETREQHLVYVLLSGTRVVLQTPAGS
ref|ZP_01515931.1|        ------------------------------------------------------------
ref|YP_001637100.1|       ------------------------------------------------------------
ref|YP_001430381.1|       ------------------------------------------------------------ ref|ZP_01667455.1|        VHISEVDSHA----------YRLISLPYRYEENVLQTERGPIVVKDVIAVSIV-----DS
ref|YP_146183.1|          ------------------------------------------------------------
RAAC00906                 LTASEASIVARDGLGARPRGVSVAGVPYLGMKVELP---RPVRIGDASANAAVILYNRAQ
ref|ZP_01515931.1|        --------------------------------------------GPAALQLGRVLNDQEQ
ref|YP_001637100.1|       ------------------------------------------------------------
ref|YP_001430381.1|       ------------------------------------------------------------ ref|ZP_01667455.1|        EVALLRNLFMIIVSGLVIGMLIIIMAGYYLARRAMVPIQAAWEKQQQFVADASHELRTPL
ref|YP_146183.1|          ---------------------------MSKRALIPIEEAYERQRQFVADASHELRTPL
RAAC00906                 DVAFLRELLTILSVSAGFFAVASAGVGFALASRALRPIRRSFEEQRRFVAHASHELRTPL
ref|ZP_01515931.1|        ---VLYQLLTGLVGFGIVGAVMIGIASWWLAGRALRPAEEAWTRQLRFISSASHELRAPL
ref|YP_001637100.1|       ---------------------------LAGRSLRPAEEAWVRQTRFIASASHELRAPL
ref|YP_001430381.1|       ---------------------------LAGRALRPAQEAWERQQRFIASASHELRAPL
                                                     ::  *::  *  .  ::  .*  :*::  ******:**

ref|ZP_01667455.1|        AVIKSNAELMLRHPDHTIEDESIRVTN-IVREVRRMTRLVADLLTLARADANQSELQLG-
ref|YP_146183.1|          SVVFSSVEALALEEDVMKNDFARRLLDRLREELKRITKLMNDLLTLARADAKNAALELSK
RAAC00906                 AVMRLQIDRMFRHPGETILDMSEVIAS-LARETSRLQRLVNDLLTLAKADEGEAVLRLR-
ref|ZP_01515931.1|        TLIRASAEVALRNAKDE--DQRELLTD-VLSESDHMRRLVDDLLTLSRLDSGSLTLQRQ-
ref|YP_001637100.1|       TLIRASAEVALRHADDP--DQRELLSD-VLSESDHMRRLVDDLLTLSRLDSGALVLQRQ-
ref|YP_001430381.1|       TLIRASAEVALRDTPSDTADQYELLGD-ILAESDHMRRLVDDLLTLTRLDSGQLKLVIE-
                           :::    . :       *     :  .  *   ::  :*:  *****:: *     * ref|ZP_01667455.1|        -AVSLSELVDAVSEQFKPLAQLEGHTLTVAVYEQLELVGDRERLYQLLVILLDNAVKYTP
ref|YP_146183.1|          QTFDFRPHAERTFQLVSELAAKKQITMHFHAPEQALVTADPDKLTQLLYILLDNAIKYTP
RAAC00906                 -PVDLATIAREAALRFAPLAEEKGVQLRVSAAETP-IVADPDRLLELLSILVDNAIAFTP
ref|ZP_01515931.1|        -PITLNDFLADLHRHVSRLGEERGITITLAQARGT-VIADPDRLRQILLILIDNALRYTP
ref|YP_001637100.1|       -PVSLPSFLADLHRQVRRLGEEKGIAIQLAPITGT-VLADPDRLRQVLLILIDNALRYTP
ref|YP_001430381.1|       -PVNLADLLSRVHRQVARLGEQRGITIELTTVGGV-VQADAERLQQVLLIALDNALRHTP
                              .. :       . *.   ..    ::*  *      .  :*   *  :***: .**

ref|ZP_01667455.1|        PPGHILITGVRQGSHILLTVEDSGQGIPPEDLPRVFDRFYRGDKARSREK--GGTGLGLA
ref|YP_146183.1|          EGGEVTLSIRTEPKQFILSVKDTGIGIPPEDIGRIFDRFYRVDKTRSRQQ--GGHGLGLS
RAAC00906                 AGGWVEIDAHASGSAAVLAVRDTGRGIPPEHLPRVFDRFYQADPSRTTR----GAGLGLS
ref|ZP_01515931.1|        TGGTITLNAELAGKQVRISVRDTGCGITPEHLPHLFERFYRADQARNRSSNTNAGLGLS
ref|YP_001637100.1|       SGGVITIATEPAGKQIRLSVSDNGCGIAPEHLPHLFERFYRVDVARNRSD--GHAGLGLA
ref|YP_001430381.1|       SGGTITLAAAPTGRMVQITVTDTGSGIAPEHLPHIFERFYRADPARGREN--GNAGLGLS
                            * : :           ::* *.* **.**.:  ::*:***  * :*          ****:
```

FIG. 147B

```
ref|ZP_01667455.1|      IAKWIVEKHGGKIWVES--KVGVGTKFSVLLP------------------------
ref|YP_146183.1|        IAKWIVEAHGGTIHVQS--QLGQGSEFLVRLP------------------------
RAAC00906               IAKWIAEAHGGQIRIFSPGSHGTGTEVEVRLPQSRSAEPGRGRFARLLAICYKKNSS
ref|ZP_01515931.1|      IAKGLVEAHGGTIGIES--EVNKGT-------------------------------
ref|YP_001637100.1|     IAKGLVEAHSGAIGIES--EVNRGT-------------------------------
ref|YP_001430381.1|     IAKGLVEAMHGRITVTS--ALGAGTTVSVALPQGET--------------------
                        *** :.*   * * : *    . *:
```

FIG. 148

```
ref|YP_005108.1|         --DDGEGIPEEHLPHLFERFYRVDKARDRERGGSGLGLAIVKAILEAHGGEVWVESQVGK
ref|YP_144769.1|         --DDGEGIPEEHLPHLFERFYRVDKARDRERGGSGLGLAIVKAILEAHGGEVWVESQVGK
ref|ZP_01773683.1|       --DSGIGIPEKDLPRLFERFYRVDEARSRDNGGTGLGLSIVKHIVQAHGGTLEVKSEQGK
ref|YP_001157480.1|      VADTGPGIPAQHLPHIFERFYRVDTARDRGNGGSGIGLAIVRAVVSAHGGRVRAENVPGG
RAAC02211                MADNGVGIPKVHHPHVFERFYRVDEARSRAKGGAGLGLAICKAIVEAHGGRMEWESEPGE
ref|YP_001124914.1|      ISDTGPGIPKHDQPRIFERFYKVDKSRHRAAGGSGLGLAIAKQIVDMHHGTISVQSEPGE
                              *  *  ***    .  *::***:  :*  *   **:*:**:*  :  ::.  * *  :   :.    * ref|YP_005108.1|         GTAFSFSLPASGP-----
ref|YP_144769.1|         GTAFSFSLPASGP-----
ref|ZP_01773683.1|       GSVFSFTLPIA-------
ref|YP_001157480.1|      GAMVKVVLPPAG------
RAAC02211                GAVFTVTLPVAGPDGDGA
ref|YP_001124914.1|      GATFTVELPIRGP-----
                         *:   ...  **
```

```
FIG. 149A
ref|ZP_00739567.1|       ------------------------------------------------------------
ref|NP_830390.1|         ------------------------------------------------------------
ref|ZP_01696335.1|       ------------------------------------------------------------
ref|YP_001037228.1|      ------------------------------------------------------------
RAAC01489                MFKRLSLRLTLLTVVLLVVLYSITSLALYGIIRGFVMRSIDFNLRQAAYRVAN-TAVLTG
ref|ZP_01667455.1|       ------------------------LYGYVAYRLFDKVDDAMRFKAENFKIVNGRAILPG ref|ZP_00739567.1|       ------TWNGKIVKIEGDN--RKFRSIFEENLEKFSPKKLGELQD------IEVQGRYFR
ref|NP_830390.1|         ------TWNGKIVKIEGDN--RKFRSIFEENLESFSPEKLEELQD------IEVQGRYFR
ref|ZP_01696335.1|       ------------------------------------------------------------
ref|YP_001037228.1|      ------------------------------------------------------------
RAAC01489                IPSFASTGSPEINFVLADN--GVYTSIADPDLASALENRLNRAVDRPTFFNFTYQGEHYR
ref|ZP_01667455.1|       RVRFLF--DPRIIILVRDSQGRVTSSFPSEVAELERLAALASQVDAGKVHISEVDSHAYR ref|ZP_00739567.1|       AFSL----------QKDGEIVQIVRDI---TAEERMLNTLFLILVIGCSIGSLCAIGIG
ref|NP_830390.1|         AFSLQ----------KDGEIVQIVRDI---TAEEGMLNTLFLILVIGCSIGSLCAIGIG
ref|ZP_01696335.1|       ---------------------------------------------------------AVIAG
ref|YP_001037228.1|      --------------------YIIVFLDY---TVEEKMYKPLIIISIYIVLLSIVLVFTVS
RAAC01489                VYDLP------IAAGSGGPAYVATILDD---TQTVRAMSDLRSVIVIVGLFGICGATLVG
ref|ZP_01667455.1|       LISLPYRYEENVLQTERGPIVVKDVIAVSIVDSEVALLRNLFMIIVSGLVIGMLIIIMAG
                                                                                    .

ref|ZP_00739567.1|       FFLAGRALVPIQNSWEKQQQFVSDASHELRTPLAVIQSKTDVLFQSPSATIEEKAMDIST
ref|NP_830390.1|         FFLAGRALVPIQSSWEKQQQFVSDASHELRTPLAVIQSKTDVLFQSPSATIEEKAMDIST
ref|ZP_01696335.1|       LVLAERALKPIKAAWDKQTQFVSDASHEIRTPLAVIQSRVELLLRKPNETVRDVLQDIST
ref|YP_001037228.1|      FFLANRSIKPIKTSWEKQTAFIADASHELRTPLAVIQSNLEIVMENENETVGSQMKWLGN
RAAC01489                FILSDRMLQPIRRAFQRQLEFVADASHELRTPLAVIQSNLGIVMEHTDQTVEENLEWLNN
ref|ZP_01667455.1|       YYLARRAMVPIQAAWEKQQQFVADASHELRTPLAVIKSNAELMLRHPDHTIEDESIRVTN
                              *:  * : **:  ::::*  *::*****:*******:*.  .::.   . *: .    : .

ref|ZP_00739567.1|       ISKECRRLSKLVSNLLLLARSDSN-QIEMDKKTFELDKLLEEIVAPYKEIASYQEKEMIL
ref|NP_830390.1|         ISKECRRLSKLVSNLLLLARSDSN-QIEMDKKIFELDKLLEEIVAPYKEIASYQEKEMML
ref|ZP_01696335.1|       VLNECRRLTKLVSNLLTLARSDSD-KIEIERKPFYLDELLREIMDHFSELAAIQGKTLIL
ref|YP_001037228.1|      IQSELERMKKLVDDLLFLARADAEDEMPKEY--FDLSRLVHKIYDEFTPLCQKKSLEFLL
RAAC01489                AHGEARRLAKLVQDLLTLARSDSE-RMPVERRPVALNDLLERIHDLYETIAEMRGIELTV
ref|ZP_01667455.1|       IVREVRRMTRLVADLLTLARADAN-QSELQLGAVSLSELVDAVSEQFKPLAQLEGHTLTV
                                *  .*: :** :** ***:*:: .    :  :  *. *:   :    : :.     : :

ref|ZP_00739567.1|       KVERGVSFMGDRERIHQMMVILLDNAMKYTNEGGHIQIDCTQMSSSIRIQVKDDGIGVKE
ref|NP_830390.1|         KVERGVSFMGDRERIHQMMVILLDNAMKYTNEGGHIQIDCTQTSSSIRIQVKDDGIGVKE
ref|ZP_01696335.1|       KSAPPVTFSGDRDRIHQLIVILLDNAMKYTGDGGKIELACFESKNHVGISVQDNGIGLKE
ref|YP_001037228.1|      DAKDNIVFYGNEFRIKQLITILLDNAIKFTGEGGKIILKLKVHANSIQLSVSDTGEGIAK
RAAC01489                RAEEPLVVLGDRDRLHQLLVILLDNAMKFTDAGGKVEIAATRNRNQAILSVRDTGIGIAK
ref|ZP_01667455.1|       AVYEQLELVGDRERLYQLLVILLDNAVKYTPPPGHILITGVRQGSHILLTVEDSGQIPP
                            :  . *:.  *:  *:::.**:***:*:*     *::  :         .      : * * * *:

ref|ZP_00739567.1|       EDIPKLFDRFYQGDKARS---T-SEGAGLGLSIANWIVEKHYGKISVESRW-GNGTCFEV
ref|NP_830390.1|         EDIPKLFDRFYQGDKARS---T-SEGAGLGLSIANWIVEKHYGKISVESKW-GDGTCFEV
ref|ZP_01696335.1|       EDREKIFDRFFQVSKSRTK----TESLGLGLSIAKWIVEKHSGKIRVDSK-LGEGTTFTI
ref|YP_001037228.1|      EHIDKIFDRFYRVDKSRSRNHG---GSGLGLAIAKCIVNEHKGTIDVFSE-VSRGTEFTV
RAAC01489                EHLERVFDRFYTVDTARS-RHGEAKGTGLGLSIAKWIVEAHGGRISIASEGIGKGTTVRV
ref|ZP_01667455.1|       EDLPRVFDRFYRGDKARSR---EKGGTGLGLAIAKWIVEKHGGKIWVESK-VGVGTKFSV
                         *.  ::****:  ..:*:         .  ****:**:  **: *  *  :  *.  .**  . :
```

FIG. 149B

```
ref|ZP_00739567.1|      IFPKNQK----------------
ref|NP_830390.1|        IFPKNQK----------------
ref|ZP_01696335.1|      TFPKKKRKDA-------------
ref|YP_001037228.1|     SLP--------------------
RAAC01489               ELPLSPKRAAGSDEGDVTAKSEA
ref|ZP_01667455.1|      LLPV-------------------
                          :*
```

FIG. 150A

```
ref|ZP_01697157.1|      ------------------------------------IEVSNRLIEKDYDSRVRVNASGELR-Q
ref|ZP_02329946.1|      ---------------------------------------------------------------
ref|YP_001212380.1|     ---------------------------------------------------------------
RAAC02391               MIPFAIGLGVGLAIGALFALWQMSWFRSLRRYLLDAMDAIVQGRYDVRMYEYRSRPAEIA
ref|ZP_00539202.1|      ------------------YSSTKRFLRPIAEATEVLHELSHGNYKSRVYELTAPDESRD
ref|NP_693085.1|        -----------------------------------VDRLIEGNYSARFYNGNSP-EMEE ref|ZP_01697157.1|      LTKA-INNLAHNLKQQMNEIDENEQQLTAVLENMDSGVMLIQTSGRIMLVNRAMEEMTGL
ref|ZP_02329946.1|      --RT-INRMAENLQIQMQHIRENEYRLQGVLENMVSGVMMVDQRGTITLVNRSAEDILGY
ref|YP_001212380.1|     --RS-INYLARQLKNNIEDVIAEKNRIKAILSSMSDGVIAMDAWGRMILINPVVEELFRI
RAAC02391               IFRH-FNRMAERIQETLADLSQERDILRHILQNMTTGVIYLRSDGQVQMVNHAAERLFRR
ref|ZP_00539202.1|      LGKS-INLLARNLENASSGEAMQRARLESLIEYMGAGLMLIDEKGYVLLVNRTYREMFNI
ref|NP_693085.1|        LSVK-VNTLARNMSEIAIQEQMQSEQLTTIVDNMQSGLVLIDEKGYVHVVNRKFLEMFGE
                          .*  :*..:.         :    :  ::. *  *::  :    *  :  ::*   :

ref|ZP_01697157.1|      SSGELIGKRH------IEAGKSFGLSQLIDRSLKTGERFRDEVHL---YYPKERILDAHI
ref|ZP_02329946.1|      SSHELLNKSY------LDAGFQLEFTALLADAIETHTRVREELML---HFPQEQILEVHV
ref|YP_001212380.1|     TMAASRGKNI------LRVIRNYDLEKLLNQALETGRCMQKQIQI---LAPEPRVFQVHV
RAAC02391               PVEQWKDRDH------WTVFRNYQLGSAIDHALLFGTPWSGEFQIRDGVTAVRLVPISA
ref|ZP_00539202.1|      -YGQSNGQLY------YRVLPNEKMSQVIEDVYLTEKPNRKQSSVRFGLNS--RTFMVSA
ref|NP_693085.1|        EESNYRGHLY------YDVFENENVHETVQKTFLYEETVKKSFVHREGLNKIY--VEVVG
                         .:                  .   .    .   :

ref|ZP_01697157.1|      APYVGESGELR-GVVAVLHDVTETRRLEQIRSEFVANVSHELKTPVTSVKGFAETLLDGA
ref|ZP_02329946.1|      SPIVQGDGQ-RKGVLVVLHDITAVRRLERIRSEFVANVSHELKTPVAAVKGFAETLMAGA
ref|YP_001212380.1|     IP-LQNSGAERGGVVALLRDITERKILQEMRSEFVANVSHELRTPLTSIRGFAETLLDGA
RAAC02391               APRMRNKADGRHDVLMLVNDVSEWRRLERMRSDFVANVSHELKTPIAAIRGFAETLLDGD
ref|ZP_00539202.1|      AP-IFGKNGRVQGTTVVFNDITEIKKLEQMRKDFVANVSHELKTPLTSIKGFAETLLDGA
ref|NP_693085.1|        AP-IFNERNMLKGAVLVLYDITELKKLEKMRKDFVANVSHELRTPITSIRGFAETLLDNN
                         *   .     ..  :. *::    :  *:..*.:*********.**::::: ******:  .

ref|ZP_01697157.1|      MYDEATLREFLKIIYDESDRLHRLISDILDLSRIEQHRILLKMEQLNVVDVVAETVQTMR
ref|ZP_02329946.1|      LEDKEMARSFLQIIYDESDRLNRLIGDILELSKIESKRIPLQFSPVDVESIVENSIQMMK
ref|YP_001212380.1|     LEEPDTARRFLEIINSETERLSRLIDELLNSRLESHKWVPKRQPVNMGELIKRAVAILQ
RAAC02391               VDE-EAREKFLRTIYEESLRMGNLVSDLLELSKLEASDSHVDPVAVDLYEVLVRAVDRVR
ref|ZP_00539202.1|      QDVPEIREQFLNIIHDESERMQTLVEDLLELSRLEQDNYQLETTIVDVTSLLHETATLLQ
ref|NP_693085.1|        ITDPAT-KEFMEIIYKESHRLQLLIEDLLALSRLEREDFRLLIDNYDVRQMVEEILPQLH
                          . *:. *  .*: *:   *:  ::* **::*       ::  .::  .   ::

ref|ZP_01697157.1|      KRIEKK--QLELVLPQKRHVMMEADKDRLRQILLNLVTNAIAYTPDKGRIEI------SL
ref|ZP_02329946.1|      AEAEKK--HITLESCVENELYIEADEDRLRQILINLLSNGISYTPEGGRVSIGVEFVPSL
ref|YP_001212380.1|     PRAVEKNLAIKINLP-EDLPVVQGDPDMLSQVLLNLIENAVVYTQAGGEVSIS-------
PVANEK                  --EITIELPREQRLHVWAEPDLLLQVFLNLLTNAIHYSPPKSRVCVT-------
ref|ZP_00539202.1|      RKATEK--QMTIHLETEEEVFIRADLNRLKQVVVNLVANALNYTPNGGNVWIS-------
ref|NP_693085.1|        QKAENK--NLTFDLEVPDQLTMRADKDRMKQVLINLIDNSIHYTPSGGDICLA-------
                         :*    : :         :  .: : : *::**: *. *:     . : :

ref|ZP_01697157.1|      IER-ENE-LDLIVSDTGIGISEKDLPRIFERFYRVDKARSRQSGGTGLGLAIVKHLVESY
ref|ZP_02329946.1|      DDNPDNERMRIRISDTGIGIPEKDLPRIFERFYRVDKARSRSSGGTGLGLSIVKHL----
ref|YP_001212380.1|     -AAATQDEMKVDVKDNGIGIPPESLSRVFERFYRVDKARSREQGGTGLGLSIVKHIIDA-
RAAC02391               -WDVLVDRVKVHVKDNGIGIPKESLPRVFERFYRVHKDRSRASGGTGLGLAIVKHIVTAL
ref|ZP_00539202.1|      -LEDGEEAVMLRIKDDGIGIHPKEMQRIFERFYRVDKARSRNSGGTGLGLAIVKHII---
ref|NP_693085.1|        -ISEETDVIHFQVKDSGIGMDEKSQTRVFERFYRVDKARSRNTGGTGLGLAIVKHIV---
                           :  :  .  :.*  ***:    .  *:******.*  ***  ******:****:
```

FIG. 150B

```
ref|ZP_01697157.1|      HGKIRVESEEGKGSTFIVTLPRTQTRP
ref|ZP_02329946.1|      ---------------------------
ref|YP_001212380.1|     ---------------------------
RAAC02391               GGEVGVESEEGKGSDFWFTLSRLDARP
ref|ZP_00539202.1|      ---------------------------
ref|NP_693085.1|        ---------------------------
```

FIG. 151A

```
ref|YP_147095.1|            ---QYLDLFIDESKEHLQAINERLLELEKTPEDMSVVNDIFRSAHTLKGMSATMGFEDLA
ref|YP_001125215.1|         ---QYLDIFIDESKEHLQTINERLLELEQTPGDMALVNEIFRSAHTLKGMSATMGFEDLA
ref|ZP_01171502.1|          ---QYLEVFIEESKEHLQANEHLLELEKNPADLKIINEIFRSAHTLKGMSATMGYEDLA
ref|ZP_01861001.1|          --NQYLEVFIEESKEHLQTCNEQLLELEKNPENLAIVNEIFRSAHTLKGMAATMGYEDLA
ref|YP_001486785.1|         --NQYLDIFLDESREHLQTCNEKLLDLEKNPTDLQLVNDIFRAAHTLKGMSATMGYADMA
RAAC02885                   MHDEYLEAFLAESMENVERLEAFCLTLEREGSKPDLLDEMFRAAHTLKGMSATMGFSKLA
                                :**: *: ** *:::    :   * :  .  :::::::****:**:  ..:* ref|YP_147095.1|            NLTHQMENVLDGIRNRRLSVTPELLDVIFEAVDHLEAMISSIA-AGGDGTRDVRRTVEQL
ref|YP_001125215.1|         NLTHQLENVLDGIRNQRLIVTPELLDVVFQAVDHLEAMIISIA-SGGDGKRDVGETVEQL
ref|ZP_01171502.1|          RLTHQMENVLDAIRNQKIGVTPELLDTVFLAVDDLEAMVLSIS-EGGDGKRDVSTAVKQL
ref|ZP_01861001.1|          SLTHQMENVLDAIRNSKIQVSSLILDVVFMAVDDLEAMVMSIA-EGGDGKRDVTEIVKKL
ref|YP_001486785.1|         QLTHHHLENMFDAIRNEQMIVTPESMDTMFEALDHLEAMVQSIA-EGGDGKRDVTEISKKL
RAAC02885                   ALTHRVEDLLGTLRDERVRLEPRHVDALLLAVDRMRARIQAIGVSAKEPDEPDDDAMDAL
                            ***::*:::. :*:   ::  :  . :*.::  *:*  :.*  :  :*.    .   :    . * ref|YP_147095.1|            KRIE--QGEMPNKQAAREEPP----------LEHAYGEFEYHVLEQAKEQGFSVYEIRV
ref|YP_001125215.1|         KRIE--QGEMPNKPTAGEQLP----------LEHTYGEFEYHVLQQAKDQGFSIYEIRV
ref|ZP_01171502.1|          ELIE--NGQTPLMESRQEAAAAAAAEAEVPAELRSDYDEFERTVLSQSKEQGFDVFEISI
ref|ZP_01861001.1|          ALIE--KGESLDNLQAQSEAAAAVLEAEPSNTHTAQYDQFERTVIEQSKEQGFQCFEISV
ref|YP_001486785.1|         DVTGSHAEAAPSVETADVSAAS---------ANDLDYNEFERTVLDEAREQGFKCYELNV
RAAC02885                   AGAL--RGGADVGGTREEDSKP----------FANLSDWANRAAAEGKE----LYTVHI
                                            .::   .    :.::      :  :  :

ref|YP_147095.1|            RLRDDCLLKAARVYMVFEQLNEVGEIVKATPPVE---MLEEEQFDR--EFLVTVVSKAPA
ref|YP_001125215.1|         RLRKDCMLKAARVYMVFEQLNEAGEIVKSTPPAD---MLEEEKFDQ--EFLVTVVSKTPA
ref|ZP_01171502.1|          SLREDCLLKAARVFMVFEVLEKSGEIIKSNPPVD---VLEEEQFDS--AFTVTLVTKEPK
ref|ZP_01861001.1|          SLREDCLLKAARVFMVFEVLEKCGEVIKSVPAVD---VLEEENFDQ--DFLVSIVSKDSQ
ref|YP_001486785.1|         TLSDACLLKAVRVYMIFERLNEAGEVVKTVPNAE---LLESEDFES--EFSISYLSKQPM
RAAC02885                   RLAPDCVMPGVRLAMAYQALKASAILMAAHPAEEN---VMAGQVEATEAFAAVMVAPGEI
                               *   *:: ..*: *  ::  *:  . :: : *  . ... *   ::

ref|YP_147095.1|            DELQKRLMGISEIDDVKVS-----------MLSSNEPSAES--EKAAAP---QQPAAME
ref|YP_001125215.1|         DELRMRLMSISEIDEVEIA-----------AVTVDEPSAKSGEQDDLEP---PVSTAIG
ref|ZP_01171502.1|          EEIQAKIMKVSEIEKAEIINIDL---------MPASPAEEEPAPAPGIIQPVEEP-
ref|ZP_01861001.1|          EDIKKKVMKVSEVHKVDVRLVDL-EKGKESDSQITEQPSASTEDATDRVTGKQANVASVP
ref|YP_001486785.1|         DEVKKIVMTISEVEQVEIS-----------EVSAFEEASPAEKQEAKPEQEKEEVSVPAA
RAAC02885                   DRVRQGVLDVTDVSSCEVS----------------KVSESHSAPKEDAPRAEGDAPIE
                              :  ::   :: ::::. .:                    :

ref|YP_147095.1|            QAAAVQAEAEAPEKQTAKQATKTIRVNIERLDRLMNLFEELVVDRGRLEQISRELNHAEL
ref|YP_001125215.1|         QVAATQTKAEAAEKLAAKQAGKTIRVNIERLDMLMNLFEELVVDRGRLEQISRDLNHPEL
ref|ZP_01171502.1|          ---KEESRNGAPAKQASSK---TIRVNIERLDILMNLFEELVIDRGRLEQISKELNNQEL
ref|ZP_01861001.1|          VVKKEEKKESAPSKQANTG-NKTIRVNIERLDILMNLFEELVIDRGRLEQISKELNHPEL
ref|YP_001486785.1|         KAPANDAPKANGNNVAAAGGTKTIRVNIDRLDSLMNLFEELVIDRGRLEQIAKELENNEL
RAAC02885                   PRVSRHANGSSPAG-ADLRRDATLRVPVRKVDALMNTLSDLVITKTRLATLVSSADDPAL
                                .           :       *:**  : ::* * :.:: : **     : .:.  * ref|YP_147095.1|            TETVERMSRISSDLQTIILNMRMVPVETVFNRFPRMVRQLARELGKKVRLDIIGADTELD
ref|YP_001125215.1|         TETVERMSRISSDLQTIILNMRMVPVETVFNRFPRMVRQLARELGKKVRLDVIGAETELD
ref|ZP_01171502.1|          HETVERMSRISGDLQNIILNMRMVPVETVFNRFPRMVRQLARDLNKKINLEIVGAETELD
ref|ZP_01861001.1|          NETVERMSRISGDLQNIILNMRMVPVETVFNRFPRMIRQLARDLNKKIELEIIGAETELD
ref|YP_001486785.1|         TDTVERMTRISGDLQSIILNMRMVPVETVFNRFPRMIRQLTKELNKKIELIIEGAETELD
RAAC02885                   KEAVERLDRLTGDIQDGLMRLRMVPVETIFHRYPRMMRDLEHRLQREFDFVMTGLDTEMD
                              ::***: *::.*:*    :::.:*******:*:*:***:*   :  *   :::. :    : **:*
```

FIG. 151B

```
ref|YP_147095.1|        RTVIDEIGDPLVHLIRNALDHGIEAPDVRVARGKPEEGTVQLRAYHSGNHVFIEIEDDGA
ref|YP_001125215.1|     RTVIDEIGDPLVHLIRNALDHGIEAPDIRVACGKPEEGTVKLRAYHSGNHVFIEIEDDGA
ref|ZP_01171502.1|      RTVIDEIGDPLVHLIRNALDHGVETPEVRKANGKNEEGTVVLKAYHSGNHVFIELIDDGA
ref|ZP_01861001.1|      RTVIDEIGDPLVHLLRNAIDHGIEAPEIRRQNGKPEEGTVTLKAYHSGNHVFIEISDNGG
ref|YP_001486785.1|     RTVIDEIGDPLLHLLRNSLDHGIESPEERVKKGKPEKGTVLLKAYHSGNHVFIEVEDDGG
RAAC02885               RVVLEEMGEVIVHLLRNAVDHGLEPPEARESQGKPRRGIVRLAAYTASGHVYLEVSDDGR
                        *.*::*:*:  :::::***:*.*: *    ** ..* * *  :..::*: *:* ref|YP_147095.1|        GISREKVLQKAKSRGIVSPQAAEHLNDQQIYELIFAPGFSTAEQVSDISGRGVGLDVVKS
ref|YP_001125215.1|     GISREKVLQKAIDRGIVSAEEAAHLTDQQVYGLIFSPGFSTADRISDISGRGVGLDVVKS
ref|ZP_01171502.1|      GINRDKVLQKAVKNGIITEQAGASLTDKQVYELIFASGFSTADKISDVSGRGVGLDVVKS
ref|ZP_01861001.1|      GISREKVLKKAISQGIVTEESAAALTDRQVYELILASGFSTAETISDISGRGVGLDVVKA
ref|YP_001486785.1|     GINRKKVLEKALERGVITDREAETLEDHQIDSLIFAAGFSTADTISDISGRGVGLDVVKN
RAAC02885               GIDRGRVLETAVAKGWITPEEGAAMSDESVYALLFRPGFSTAERVSDISGRGVGLDAVRE
                        **.* :**:.*  .* :: . .   : *..:  *:: .*****: :**:********.*:

ref|YP_147095.1|        TIESLGGTVSVDSQPGKGSLFSIQLPLTLSIISVLLVQIAEETYAIPLSSIIETALVKKE
ref|YP_001125215.1|     TIQSLGGTVTVDSQPGKGSLFSIQLPLTLSIISVLLVQIAAETYAIPLSSIMETALVKKE
ref|ZP_01171502.1|      TIESLGGTVTIDSQEGKGSTFSIQLPLTLSIISVMLIEVQKEKYAIPLSSIIETAIIKKE
ref|ZP_01861001.1|      TIESLGGSITIDSVLGEGSTFSIQLPLTLSIISVMLVEVEKEKYAIPLSSIIETAIIKKE
ref|YP_001486785.1|     KLESLGGSVSINSTEGQGSLFSIQLPLTLSIISVLLVKLEEETFAIPISSIIETAVIKKS
RAAC02885               KVEALGGQIRLNSVLGAGTTFTIELPLTLAILSALLVSVRGQVFAIPTANVDEVRRVTRD
                        .::.***  :  ::*   *  *: *:*:*****:*:*..*:.:   : :*** :.: *. .:.:

ref|YP_147095.1|        EIFSAHNQPVIDFRGKIVPLVRLKDVFAVP-GVADDGDAVAVVIVRKGEKLAALAVDSFI
ref|YP_001125215.1|     DIFSAHNQPVIDFRGKVVPLVRLKDVFSVP-NASDEGDAVAAVIVRKGEKLAALAVDSFI
ref|ZP_01171502.1|      DIMNAHNQKVIDFRGKVVPLLFLKDVFAVPVHLEEDGY-YSVVIVRKGDKMAGLVVDSFI
ref|ZP_01861001.1|      DILNAHNQKVIDFRGKVVPLFLEDVFEIPKQEGDDFY--SVVIVRKGDRMAGLVVDSFI
ref|YP_001486785.1|     DILQTHDREVIDFRGFIVPVVYLKKQFHVP-NANELEEELHIIVVRKGDKLTAFVVDSFI
RAAC02885               DVRHVQERPVFQDSAGIVPIVDLAERLGLG--SRRDAYPQTAVVCRDGKRRLALVVDHVL
                        ::   .::: *::  . :**:: *  . :   :        :: *.*.:  ..:.**  .:

ref|YP_147095.1|        GQQEVVLKSLGNYLSSVFAISGATILGDGRVALIIDCNAL----
ref|YP_001125215.1|     GQQEVVLKSLGNYLSSVFAISGATILGDGRVALIIDCNAL----
ref|ZP_01171502.1|      GQQEIVLKSLGGYLNDIFAISGATILGDGQVALIVDCNALIN--
ref|ZP_01861001.1|      GQQEVVLKSLGNYLTDVFAISGATILGDGQVALIVDCNAL----
ref|YP_001486785.1|     GQQEVVLKSLGDYLPNVFAISGATILGDGQVALIVDCNAL----
RAAC02885               DELEIVNKPLGRYLQGVREFAGATILGDGRVSLILDVRSIANPA
                        .: *:* *.** **  .:  ::********:*:**:*  .::
```

FIG. 152

```
ref|YP_001125206.1|      -MARILVVDDAAFMRMMIKDILTKNGHEVVAEAADGRQAIEKYKETRPDIVTMDITMPEM
ref|ZP_01696550.1|       ----ILIVDDAAFMRMMIKDILTKNGYDVVAEAGDGAQAIEKYKEHRPDLVTMDITMPEV
ref|ZP_01860990.1|       MANKILIVDDAAFMRMMIKDILTKNGFEVVGEAADGNQAVEKYKELSPDLVTMDITMPEK
ref|NP_243310.1|         --ARILIVDDASFMRMMIKDILTKNGYDVVGEAHDGEQAVEKYKELSPDLVTMDITMPEK
RAAC02876                -MANILVVDDAAFMRMMIKDILTKNGHVVVGEAADGAQAVERYQELRPDLVTMDITMPEV
ref|YP_001410204.1|      -MAKVLVVDDAAFMRMMLKDILTKAGHEVVGEAANGVEAVEKYKELKPDVVTMDITMPEM
                          :*:**:*:**** *. . :* :*:*:*:*   :****** ref|YP_001125206.1|      DGITALKEIKKIDSNAKVIMCSAMGQQAMVIDAIQAGAKDFVVKPFQADRVIEAINKTL-
ref|ZP_01696550.1|       DGISALKEIKKIDPDAKVIMCSAMGQQAMVIDAIQAGAKDFIVKPFQADRVIEAIQKTL-
ref|ZP_01860990.1|       DGIAALKEIKSLDANAKIIMCSAMGQQAMVIDAIQAGAKDFIVKPFQADRVIEAIQKAL-
ref|NP_243310.1|         DGIAALKDIRAIDPNAKVIMCSAMGQQAMVIDAIQAGAKDFIVKPFQADRVIDAIQKTL-
RAAC02876                DGIEAIKRIRQIDPNARIIVCSAMGQQAMVIEAIQAGAKDFIVKPFQADRVVEAVQKALR
ref|YP_001410204.1|      NGIDAIKEIKKFDPNATVIVCSAMGQQAMVIEAIQAGAKDFIVKPFQAARVIEAIQKVLK
                         :** *:* *: :*.:* :*:**********:*******.****** **::*::*.*
```

FIG 153

```
ref|ZP_01696550.1|       ----------------IEKYKEHRPDLVTMDITMPEVDGISALKEIKKIDPDAKVIMCSA
ref|NP_243310.1|         ----------------VEKYKELSPDLVTMDITMPEKDGIAALKDIRAIDPNAKVIMCSA
ref|ZP_01725653.1|       ----------------VEKYNELKPDLVTMDITMPEMDGIAALKAIKGSDPSATVIMCSA
ref|YP_753552.1|         ----------------IEKYKELKPDLVTMDITMPEMDGIAAVKEIKAVDPAARIIMCSA
ref|YP_001559801.1|      ----------------VERYNETKPDLVMMDITMPEMDGIQALKKIKSVDPNATVIMCSA
RAAC00987                MKLSMKLPTVTKQWSVIRRYQECKPDLVTMDLTMPNVDGIQAIKKIRAIDPDA-------
                                         :.:*:*  ** :*: * *:* *:   ** * ref|ZP_01696550.1|       MGQQAMVIDAIQAGAKDFIVKPFQADRVIEAIQKTL-
ref|NP_243310.1|         MGQQAMVIDAIQAGAKDFIVKPFQADRVIDAIQKTL-
ref|ZP_01725653.1|       MGQQAMVIDAIQAGAKDFIVKPFQADRVIEAIQKAL-
ref|YP_753552.1|         MGQQAMVIDAIQAGAKDFIVKPFQPERVIEAVSKAL-
ref|YP_001559801.1|      MGQQAMVIESIQSGAKDFIVKPFQADRVLEAVKKAI-
RAAC00987                -------------------KPFQIDRVISAVDKALN
                                            ****  **:..*:.*::
```

FIG. 154A

```
ref|YP_148131.1|         ----SVVGKLWFTILLLVSCVLFILSILLIKFLEDYYVQEAENDLTRLATKVAEVMHDYR
ref|YP_001126300.1|      ----SVVGKLWFTILLLVSCVLFILTILLIKFFEEYYVQEAENDLTRLATKVAEVMHDYR
ref|NP_390192.1|         ----SVVGKLWFTILSLVLIVLFILTVLLLEFIENYHVEEAENDLTQLANKVAVILENHE
ref|YP_001487274.1|      ----SVVGKLWLTILFLVLIVLSILTVLLLEFIENYHVEEAKSDLTQMANKVAVILESHD
ref|YP_079616.1|         ----SVVGKLWFTILLLVSFVLFILTFFLLEFIENYHVDEAEADLTKLASKVAVIMENHK
RAAC02162                MIPNSIVAKMWLTIVGMVFVIQALLSVLLQQVFNKYIVTREEASLTQLALTIESVLATAT
                             *:*.*:*:**: :*   :  :*::.:*  *::*  *  . :  .**::*  .:  ::

ref|YP_148131.1|         DEQLARSIAWTLVDNRTKAVIVADESHYWYSPGDAG-LDNMPLSSIRQDRDLRRVLTDGK
ref|YP_001126300.1|      DEQLARSIAWTLVDNRSKAIIVADESHYWYSPGEAD-LKDMPLSSIREDSDLRRVLTDQE
ref|NP_390192.1|         DQALARSITWELADNLTSIAIIQDEKNHWYSPNDKNRLSSITVEQIQHDKDLNKALKDHK
ref|YP_001487274.1|      DQSLARSITSELADKLTSIAIIQEDGLEWYSSEKDGKLPAITKKQIEADSDLNQALKDRK
ref|YP_079616.1|         DQETARSITWELADELTSIAVIKNENEYWYSPREHQKVASITLKDIKNDPDLNEALRKHQ
RAAC02162                DRSIKEQVASDIAKRVERATVVYGIP---YTANAALKAAYDAMTPAER-----QALSRGQ
                         *.   ..::  :...     ::   *:.    .    .   .      ..*      :

ref|YP_148131.1|         TMKKRLYMPERHPKEKLPRDMIIVGVPMSMPDGSRGAVFIYQSLEAIADATERTKELIFL
ref|YP_001126300.1|      TVKKRLYATEWEQNGKPQHDMIIVGVPMSMPDGSRGAVFIYQSLEAIADATEHTKELIFL
ref|NP_390192.1|         KVSKRTGLSDTDTDNE----RLIVGVPYEK-DGKKGMVFLSQSLLAVKDTTKHTTRYIFL
ref|YP_001487274.1|      KISKRAEPNAGNHKDE----RIVVGVPFEA-NGKKGMVFLSQSLLAVEQTTKHTTRYIFL
ref|YP_079616.1|         KVQKRTVIS--NQKND----QLIVGVPYGK-GEDEGMVFLSQSLLAVKDTTQHTTRYILF
RAAC02162                PVTLRGALGKVNRLTV------YVQIPSAR-SPQPGMLAVSQDTSVLDEPLREIRNMVLF
                          :  *    .          . * :*. .   . * :*.   .: :.....  :::

ref|YP_148131.1|         AAFIAIVMTTFFAFFLSTRITAPLRKMRQAAFEMARGHFDMKVPILTNDEIGGLAMAFNQ
ref|YP_001126300.1|      AAFIAIVMTTFFAFFLSTRITAPLRKMRQAAFEVARGHFDTKVPILTNDEIGGLAMAFNQ
ref|NP_390192.1|         AAGIAIVLTTFFAFFLSSRVTYPLRKMREGAQDLAKGKFDTKIPILTQDEIGELATAFNQ
ref|YP_001487274.1|      AAGIAIVLTTIFAFFLSTRVTYPLRKMKEGAQDLAKGKFDTKIPILTQDEIGELAIAFNQ
ref|YP_079616.1|         AAAIAIVLTTIFAFFLSSRITYPLRKMRQGAQDLAKGKFDTKIPILTQDEIGELAIAFNQ
RAAC02162                DTVLGVILATGFAFVISKNLSRPLVDMTRAAEEMARGHYRQRVRVVTKDEVGRLGHTFNA
                         :  :..:::.* ***.:*..:: **  .*  ..*  ::*:*:: ::  ::*:**:* *. :**

ref|YP_148131.1|         MGRRLQFNINALNQEKEQLASILSSMADGVITFNRDGEILITNPPAERFLQAWYFEQGND
ref|YP_001126300.1|      MGRRLQFNINALNQEKEQLASILSSMADGVITFSREGEILITNPPAERFLQAWYFEQGND
ref|NP_390192.1|         MGRQLNFHINALNQEKEQLSNILSSMADGVITINIDGTILVTNPPAERFLQAWYYEQNMN
ref|YP_001487274.1|      MGKQLTFHITALNQEKEHLSNILSSMADGVITINIDGTILMTNPPAERFLQAWYYEQNMK
ref|YP_079616.1|         MGRQLKFHITALNQEKEHLSNILSSMADGVITINIDGTILVTNPPAERFLQAWYYEQNMN
RAAC02162                LARQLAETIEQLSMEREGLQRILSSLQDGVVATDLDGRVVLANPPAKRHLRHLSVAERGI
                         :.::*    *  *.*:*  *    ****: ***::  . :* :::.:****:*.*:       :

ref|YP_148131.1|         AEAMAPLPPQVKELFARVVREEKEQSTEVTLQGRTWVILMTPLYGK--TMVRGAVAVLRD
ref|YP_001126300.1|      AETMAPLPPQVKELFARVVREEKEQSTEVTIQGRTWVILMTPLYGK--TMVRGAVAVLRD
ref|NP_390192.1|         IKEGDNLPPEARELFQNAVSTEKEQMIEMTLQGRSWVLLMSPLYAE--SHVRGAVAVLRD
ref|YP_001487274.1|      IKDGDELPPEARELFHTAVSTEKEQMIEVTLQGRTWVLLMSPLYNQQD--VRGAVAVLRD
ref|YP_079616.1|         VKEGHELPPEARELFQNTVSTEKEQMIEMTLQGRTWVLLMSPLYNQ--SHVRGAVAVLRD
RAAC02162                VDE-ERLPDRLMSLWVRVREQQDAVYREDTWDGRTIGITMLPLYETDGTTLRGALCVLRD
                         .    **  .  .*:   :.    * * :**:    : * *     :*:.**** ref|YP_148131.1|         MTEERRLDKLRKDFIANVSHELRTPIAMLQGYSEAIIDDIAASEKEKKEMAKVIYDESLR
ref|YP_001126300.1|      MTEERRLDKLRKDFIANVSHELRTPIAMLQGYSEAIIDDIAASEEEKKEMAKVIYDESLR
ref|NP_390192.1|         MTEERRLDKLREDFIANVSHELRTPISMLQGYSEAIVDDIASSEEDRKEIAQIIYDESLR
ref|YP_001487274.1|      MTEERRLDKLRKDFIANVSHELRTPIAMLQGYSEAIIDDIASSEEEKKEIAQIIYDESLR
ref|YP_079616.1|         MTEERRLDKLRKDFIANVSHELRTPISMLQGYSEAIVDDIASSEEEKKEIAQVIYDESLR
RAAC02162                ITEERRLDRLRKDFIANVSHELRTPLSMLQGYTEALLDDISDPDMRRELTEIIHDETLR
                         :******:**:************::******:***::****:..  :::*:::**:**
```

FIG. 154B

```
ref|YP_148131.1|         MGRLVNDLLDLARMEAGHIELEYEQVKLVPYIERVIRKFYGLAK-EKQIELTAEFRDRDI
ref|YP_001126300.1|      MGRLVNDLLDLARMEAGHIELQYEQVELVPYVERVIRKFYGLAK-EKQIELTAEFRDENI
ref|NP_390192.1|         MGRLVNDLLDLARMESGHTGLHYEKINVNEFLEKIIRKFSGVAKEK-NIALDHDISLTEE
ref|YP_001487274.1|      MGRLVNDLLDLARMEAGHITLNLESTDTEELTEKIYRKFLGIAKEK-QVDLTYDIQV-DE
ref|YP_079616.1|         MGRLVNDLLDLARMEAGHISLNVEPVELREFFERVFRKFYGVAGDK-NITLSHNLDLHEA
RAAC02162                MKRLVNDLLNLAQLESGQFKLHFARVDLTQVMRRVARKFQALASDE--DHLTFEVSIPDH
                         * *******:**::*:*:  *.        .::  *** .:*   :    *  :.   :

ref|YP_148131.1|         EIAL--DPDRIEQVLTNLIDNAIRHTESGGTVRLIIEPSGDGVTIHVQDSGSGIPEEDLP
ref|YP_001126300.1|      EIAF--DPDRIEQVLTNLIDNAIRHTEAGGTVRLIIERSGDGVTIHVQDSGSGIPEEDLP
ref|NP_390192.1|         EFMF--DEDKMEQVFTNLIDNALRHTSAGGSVSISVHSVKDGLKIDIKDSGSGIPEEDLP
ref|YP_001487274.1|      PHFV-LDPDKMEQVFTNLIDNAIRHTPEGGEVHFSVQSVESGLKMDVKDSGSGIPEEDLP
ref|YP_079616.1|         KFVF--DPDKMEQVLTNLIDNAIRHTNAGGTVHVDVQSAESGLKIAVKDSGSGIPEEDLP
RAAC02162                PVMVDGDEDRLEQVFTNLLDNAFRHTAQG-TIRFELDIRHDYAYVRVADTGSGIPEEDVP
                          . *::*:*:*:*   *   :.:.   .   : : *:********:* ref|YP_148131.1|         FVFERFYKADKARTRGRSGTGLGLAIAKNIVEAHKGLITVHSKLNEGTTFSFYLPARGP-
ref|YP_001126300.1|      FVFERFYKADKARTRGRSGTGLGLAIAKNIVETHKGRITVHSKLNEGTTFSFYLPAHGPK
ref|NP_390192.1|         FIFERFYKADKARTRGRAGTGLGLAIVKNIVEAHNGSITVHSRIDKGTTFSFYIP-----
ref|YP_001487274.1|      FIFERFYKADKARTRGRSGTGLGLAIVKNIVEAHQGSIHAHSKAGTGTHFTFYIP-----
ref|YP_079616.1|         FIFERFYKADKARTRGKGGTGLGLAIVKNIVDAHNGSITVHSMLNEGTSFTFYIPRNKQD
RAAC02162                YIFERFYKADKARTRSRSGTGLGLAIARQLVIEHRGEILVESHLGEGTTFTVVLPLASPN
                         ::**********.:.******.:::*   *.*  *  ..*   .  **  *:. :* ref|YP_148131.1|         ---------
ref|YP_001126300.1|      E--------
ref|NP_390192.1|         ---------
ref|YP_001487274.1|      ---------
ref|YP_079616.1|         D--------
RAAC02162                DHGEGESVS
```

FIG. 155

```
ref|YP_955166.1|         -------ILGYLGPNWFASVMGTGIVATAGASLPVHVPGLRGFALVVWVLSALWLLVLIF
ref|YP_001133548.1|      ---DRPSILGYLGPNWFASVMGTGIVATAGASLPVHMPGLRGFATAVWVLSALWLVVLIL
ref|YP_907563.1|         -----VEVLGNIGPNWFASVMGTGIVAVAGATLPVHVVGLRAFTQVVWVIAAALLLALIV
ref|ZP_00997175.1|       ------------GPNWFAAVMGTGIVANAVATLPVQVPGLLAFARVVWALDVLLLALILA
ref|YP_829143.1|         --------------NWFASIMGTGIVATAAATLPLQFPGLRTGATVVWALASMLLILLTT
RAAC00012                MGGDGMHIIRQFGVNWFTTVMGIGIVAALTYTSPIHLPFQHAVGEILFIGVNVVFVFAFA
                                      ***:::** ****    : *::.          ::         :

ref|YP_955166.1|         ATFAHWLRNPVVARSHVRNPQMAHFYGAAPMALLTVGSGALLVGRDLIGERAAVDLAWVL
ref|YP_001133548.1|      AMLAHWLRNPTVARGHVRNPTMAHFYGAAPMALLTVGSGALLVGEDLIGARLAVDLAWAL
ref|YP_907563.1|         LVGGHWLRHPTVARSHARNPQMAHFYGAAPMALMTVGADAVLAGGPLIGERLAVDLDWVL
ref|ZP_00997175.1|       ATAVHWVQHHDTARSHLDHPVMSHFYGAPAMALMTVGAGALLVGQPVVGRSVAIDMASAL
ref|YP_829143.1|         ATVVHWIRHRETAQSHHSHPVMAHFYGAPPMALLTVGAGTLLLGKDVLGEQLALGIDTVL
RAAC00012                MWILRWLLTPDAAIDDFRHPGRALFYGAFAMGINVVGNDYFLIGTHMMPKHTAIAISFAI
                            :*:       .*  ..   :*   : ****  .*.:  .**   ..*  *   ::      *:  :    ..:

ref|YP_955166.1|         WTTGTLGALFTAMTIPYLMFTQYRVEPDAAFGGWLMPVVPPMVAAATGSLLIPHMAEGPG
ref|YP_001133548.1|      WVAGTLGGLFTAMTIPYLMFTQYRVEPDAAFGGWLMPVVPPMVAAATGSLLIPHMAEGVG
ref|YP_907563.1|         WTAGTIGGLFTAVSIPFLMFTQHRVEPDAAFGGWLMPVVPPMVSAATGALLLPHMPAGSG
ref|ZP_00997175.1|       WVSGTLLGLWTAVAVPVKAFTTHEVAPDAAFGGWLMPVVPPMVSAATGPLLLPHLPAGQW
ref|YP_829143.1|         WVAGTVLGLASAVAVPYLQFTRHQVTQDSAFGGWLMPVVPPMVSASTGALLLPYVPAGQA
RAAC00012                WLAGVAASVFSVIVVPYLLFTEHKVERDETVASWLIPLVPPIVAAATGTNLIPYAG-GPG
                         * :*.   .: :.:  :*     **  ::.*   * :...**:*:***:*:*:**. *:*:     * ref|YP_955166.1|         -RATMLYGCYAMFGLSLVASLIIITMVWSRLAHYGTSGTARVPTLWIVLGPLGQSI-TVA
ref|YP_001133548.1|      -RATMLYGCYAMFGLSLVASLIIITMVWSRLAHFGTSGTARVPTLWIVLGPLGQSI-TVA
ref|YP_907563.1|         -RETMLYGCYAMFGLSLNIIAMIWSRLVLYGTSGTARVPTLWIVLGPLGQSI-TAA
ref|ZP_00997175.1|       -QLAMQLACTMMFGLTLVASLIVITLIWGRLVHHKVGASAAVPTLWIVLGPLGQSV-TAA
ref|YP_829143.1|         -RLSLLMGCYAMFGLSLLASIIITTLIWNRLAGHKIGAAAAVPTLWIVLGPLGQSI-TAA
RAAC00012                AQFSMTAGIVALFGMTFFLFIMTSALVYSRLVFHRRLSGQEAPTLWIEIGPIGMAMGTFC
                          : ::    .    :**::.   :   ::::.**. .      .*****  :**:*  ::   *  .

ref|YP_955166.1|         GL-LGTDAAL-AVDA-----RLADGMAVFAVLYGVPVWGFAVLWI---ALAAALT---VR
ref|YP_001133548.1|      GL-LGTDAAL-AVDEN-----LADGMRVFAVLYGVPVWGFAMLWI---GLATALT---VR
ref|YP_907563.1|         GL-LGAAAATGAVDHE-----LAETMQAFAIIFGVPVWGFAMLWI---ALSTALT---VR
ref|ZP_00997175.1|       HT-LGVAAPTVLPEP-------FGSAFTAMGLVFGLPMWGFAMLW---LAIAATVT---LR
ref|YP_829143.1|         NL-LGGNAHLAVSGT-------LAQAMEALGVLYGVPVLGFALMW---AALATAIT---IR
RAAC00012                GIPLNAPHVFGPYFG---------GLRDLGAVFSIAMWGVGVWWILLSALYTFLH---LT
                          *.                        :  :. ::.:.: *..: *      .: : :      :

ref|YP_955166.1|         TLR---RGMPFALTWWSLTFPVGTFVTGTAQLALHTGL--PAFRYAAAVAYLGLLCTWL-
ref|YP_001133548.1|      TLR---RGMPFALTWWSLTFPVGTFVTGTTQLAVHTSL--PAFRYAAAIAYIGLLCTWL-
ref|YP_907563.1|         TLR---RGMPFALTWWSLTFPVGTFVTGTSQLALHTHL--PAFRVAAAAYAGLLATWV-
ref|ZP_00997175.1|       TAR---SGLPFTLGWWSFTFPAGTVVTGTSGLAAATGA--TFLQFTALALYAGLVLAWA-
ref|YP_829143.1|         TAR---RGLPFSLTWWSFTFPIGTCVTGLTGLAAHTHL--AVFDAMAVAGYTLLVAAWI-
RAAC00012                PKG---DGLPFHLGWWSYVFPIGSFTNGTYALHRLLGH-----PFFAVAGLVQLGILWLC
                         .      *:** * *  *: ..*    *          *        *      * ref|YP_955166.1|         --LVAVRTVRG--GLRGGL-----------------
ref|YP_001133548.1|      --LVAVRTLRV--GIGRG-----------------
ref|YP_907563.1|         --LVAIRTVRG--SLRGNLL----------------
ref|ZP_00997175.1|       --TVAFRTARG--AWDGRLLR---------------
ref|YP_829143.1|         --IVAARTFHGS-ILQGTLFQ---------------
RAAC00012                FAIVIVRTVHG--VAAGHLIQWRRDHAHRHELKARRA
```

FIG. 156A

```
emb|CAG29823.1|         MTGGEVIRPT GGSGRRGRLR VFIGAAPGVG KTYTMLREAR RLREEGTDVV IGWVETHGRP
ref|NP_923516.1|        ---------- -----RGRLK LYLGYTPGVG KTVRMLQEAR RLRRGVDLV VGWVETHGRP
ref|ZP_02329377.1|      ---------- -----RGRLK IYLGAVSGSG KTYHMLREAQ SLKENGIDVV LCAVSTLNRP
ref|ZP_02329377.1|      ---------- ----RRGVFK VYIGAAPGVG KTYTMLREGN DLARMGIDVI VGLLETHGRR
ref|ZP_02329377.1|      ---------- ------GRLK IYLGAVSGSG KTYHMLREAQ SLKENGIDVV LCAVSTLNRP
RAAC02761               MTGGEVIRPT GGSGRRGRLR VFIGAAPGVG KTYTMLREAR RLREEGTDVV IGWVETHGRP
Clustal Consensus                         *  :: :::*  ..* *  :*..  * .* *::  :  :.* .* emb|CAG29823.1|         ATEKLLEGLE VIPPRVLKVG QATFEEPDLD AIVARRPEVC VIDELAHTNP PGAMHEKRYE
ref|NP_923516.1|        DTEALLADLE VMAPRQVAYQ GVIIPELDLE AILQRRPATV LIDELAHTNA PGSRHRKRYE
ref|ZP_02329377.1|      ETARQASGLE TIPSIDWTKD GVIQQDLNLV ALVERNPEVV LVDGLAHRNR QGALFPTRLG
ref|ZP_02329377.1|      ETAEQLGNLG MIPRRKIDYR GTTLEEMDTD AIIERAPDVV LVDELAHTNV PGSRHNKRFE
ref|ZP_02329377.1|      ETARQASGLE TIPSIDWTKD GVIQQDLNLV ALVERNPEVV LVDGLAHRNR QGALFPTRLG
RAAC02761               ATEKLLEGLE VIPPRVLKVG QATFEEPDLD AIVARRPEVC VIDELAHTNP PGAMHEKRYE
Clustal Consensus         *      .*    :.           . :  :    *:: *  *     ::*  *** *    *:  . .* emb|CAG29823.1|         DVMYLLDRGI SVMTAFNIQH LESVRDEVQQ QLGIRVREVV PEWFLREADE VTVIDVTPET
ref|NP_923516.1|        DVEVLLDDAGV SVMSAMNIQH LESVAEAAGR LIGAVVHETV PDRLLRSAEE VQLVDASPEA
ref|ZP_02329377.1|      DISFLLEKGI SVITTVNVYE LEGVRELARK LAGVEVKTTV PSGTLEMADE VRLIDVTPET
ref|ZP_02329377.1|      DVLDILNAGI SVITTVNVQH LESLNDAVEQ ITGVRVRETV PDSILWMADE VELIDVPPQT
ref|ZP_02329377.1|      DISFLLEKGI SVITTVNVYE LEGVRELARK LAGVEVKTTV PSGTLEMADE VRLIDVTPET
RAAC02761               DVMYLLDRGI SVMTAFNIQH LESVRDEVQQ QLGIRVREVV PEWFLREADE VTVIDVTPET
Clustal Consensus       *:   :*: *:  **:::.*: . **.:  :  .   :    *  *: .* *.  *  *:* *  ::*..*::

emb|CAG29823.1|         LRQRLRDGEI YPPEKVDAAL QNFFRVDRLA WLRQMSLRAV ADDVDERLEH SYERRAIPGP
ref|NP_923516.1|        VLERLQRG-- -DAARYIPPG SPFLRRSTLV YLRELALRAV AEVVDADILS --GKNGVAGP
ref|ZP_02329377.1|      ILKRLEEGNL P-----GQKE HHLFLKGNIG VLRELALRLV AEDVNGSLEK YRKSKGLSGP
ref|ZP_02329377.1|      LRQRMKEGRI YSMEKVEQAL GHFFKIGNLI ALRELALREI ADDVDERLES WERKESLRGP
ref|ZP_02329377.1|      ILKRLEEGNL P-----GQKE HHLFLKGNIG VLRELALRLV AEDVNGSLEK YRKSKGLSGP
RAAC02761               LRQRLRDGEI YPPEKVDAAL QNFFRVDRLA WLRQMSLRAV ADDVDERLEH SYERRAIPGP
Clustal Consensus        : :*:.  *                ::   . :       **:::** : *: *:   :        ..: **

emb|CAG29823.1|         VGAKEVVLVC VSHPDRAATL IERGRRMAMR MKGDLHVVYA AETDEDRMTE RARAEVDELR
ref|NP_923516.1|        AGVRERVLAA VSTNPASARL IRRGARIAER LDAELFVAYV ETG--RPLAP PEAQTLQEHR
ref|ZP_02329377.1|      SGAGERILVS TQYHWNGSIY VRRGQQIANR LNGDLYVICF QHTG-KPLSK EQAAFKRSLK
ref|ZP_02329377.1|      WRREETIFVC VKLNDHAERI IRRGFRIAFR LKARWHVAYL HHG----SGM EDEARLKELK
ref|ZP_02329377.1|      SGAGERILVS TQYHWNGSIY VRRGQQIANR LNGDLYVICF QHTG-KPLSK EQAAFKRSLK
RAAC02761               VGAKEVVLVC VSHPDRAATL IERGRRMAMR MKGDLHVVYA AETDEDRMTE RARAEVDELR
Clustal Consensus              *  ::..  ..     .        :.** ::* *  :..  .*                                .  :

emb|CAG29823.1|         RLAEFHGAEW VLEP-KRDRP VGEVILRVAR RVNATQVVLG QPRKGASPRR LMAWHHPVQY
ref|NP_923516.1|        AATEAAAGEF VQLQ-NRD-- VAGALIDFAL QKNITQVIVG ESLR--SPAE ELVRGSVINT
ref|ZP_02329377.1|      KLVDKIGAVF VELPFPGRRK LADSLLDYAM KNSVTRIVLG HSKH--TRIQ ELWQGSIIND
ref|ZP_02329377.1|      GLTERLGGSF EVITGQGKKD PADLLLAKAN EYNSTQMILG KSCS--PSWR DRWQGSLVKR
ref|ZP_02329377.1|      KLVDKIGAVF VELPFPGRRK LADSLLDYAM KNSVTRIVLG HSKH--TRIQ ELWQGSIIND
RAAC02761               RLAEFHGAEW VLEP-KRDRP VGEVILRVAR RVNATQVVLG QPRKGASPRR LMAWHHPVQY
Clustal Consensus        .:   ..  :                  .  ::   *    . .  *::::*   ..     .                  ::

emb|CAG29823.1|         LLKHLQYVDL RVVG------ ------WRPL SPAAREQRNW ASERVVRE-- RKLP--GKLT
ref|NP_923516.1|        LLRTTSNIDV LIVGE----- -AESSMVGPL TPVAAQPPFA VGCLLVGADS RRAHGCGRHK
ref|ZP_02329377.1|      ILRKMTRTDL FVVADRAERD GERILPAKRK VGTKKAELYR RHSKQEMQKE IEKIRRGVFK
ref|ZP_02329377.1|      LLRGARHMDV LVV------- ---------- ---------- ---------- ----------
ref|ZP_02329377.1|      ILRKMTRTDL FVVA------ ---------- ---------- ---------- ----------
RAAC02761               LLKHLQYVDL RVVG------ ------WRPL SPAAREQRNW ASERVVRE-- RKLP--GKLT
Clustal Consensus       :*:        *:     :*
```

FIG. 156B

```
emb|CAG29823.1|      LYIGAAPGVG KTYRMLQDAH DWKVRGIDVV IGLIETHGRP ETEAQIGDLE RIPKRRIEYG
ref|NP_923516.1|     IYLGAAPGVG KTFAMLQEAH HLHASGIDVV CGVIETHGRA ETAALIENLE VVPKRAIGYQ
ref|ZP_02329377.1|   VYIGAAPGVG KTYTMLREGN DLARMGIDVI VGLLETHGRR ETAEQLGNLG MIPRRKIDYR
ref|ZP_02329377.1|   ---------- ---------- ---------- ---------- ---------- ----------
ref|ZP_02329377.1|   ---------- ---------- ---------- ---------- ---------- ----------

RAAC02761            LYIGAAPGVG KTYRMLQDAH DWKVRGIDVV IGLIETHGRP ETEAQIGDLE RIPKRRIEYG
Clustal Consensus emb|CAG29823.1|      GKVYEEPDLA AILARRPQVV LMDELAHTNA PGSMFKKRYQ DILYLLEHGV DVVSAVNVQH
ref|NP_923516.1|     GRTFLELDVE AVLRRRPAVV LVDELAHTNI AGAGNTKRFQ DVEVLLGAGI DVVSTLNIQH
ref|ZP_02329377.1|   GTTLEEMDTD AIIERAPDVV LVDELAHTNV PGSRHNKRFE DVLDILNAGI SVITTVNVQH
ref|ZP_02329377.1|   ---------- ---------- ---------- ---------- ---------- ----------
ref|ZP_02329377.1|   ---------- ---------- ---------- ---------- ---------- ----------
RAAC02761            GKVYEEPDLA AILARRPQVV LMDELAHTNA PGSMFKKRYQ DILYLLEHGV DVVSAVNVQH
Clustal Consensus emb|CAG29823.1|      LESLKDRVEH ITGATIRERV PDWFVKLASE VKLIDVSPET LVERLLEGKI YPPEKVEQAL
ref|NP_923516.1|     LESLNTLVER TTGVKVRETL PDLVVEAADE VVLVDLPTGE LTQRLREGKI YAQAKVEQAL
ref|ZP_02329377.1|   LESLNDAVEQ ITGVRVRETV PDSILWMADE VELIDVPPQT LRQRMKEGRI YSMEKVEQAL
ref|ZP_02329377.1|   ---------- ---------- ---------- ---------- ---------- ----------
ref|ZP_02329377.1|   ---------- ---------- ---------- ---------- ---------- ----------
RAAC02761            LESLKDRVEH ITGATIRERV PDWFVKLASE VKLIDVSPET LVERLLEGKI YPPEKVEQAL
Clustal Consensus emb|CAG29823.1|      SNFFQLAHLA ALREIALREV ADVVDGRLAP PPPADPE--- -----RILVC VNYRPHSEAL
ref|NP_923516.1|     ANFFRPENLS ALRELALREV ADDCTTRKLE EAAHGPGG-- -----RVLVC INLRPNAEQL
ref|ZP_02329377.1|   GHFFKIGNLI ALRELALREI ADDVDERLES WERKESLRGP WRREETIFVC VKLNDHAERI
ref|ZP_02329377.1|   ---------- ---------- ---------- ---------- ---------- ----------
ref|ZP_02329377.1|   ---------- ---------- ---------- ---------- ---------- ----------
RAAC02761            SNFFQLAHLA ALREIALREV ADVVDGRLAP PPPADPE--- -----RILVC VNYRPHSEAL
Clustal Consensus emb|CAG29823.1|      IRRGWRIADR LQAKLYVLVV QTEFPLSSQS ERDFAAVRDL AEQFGAEFLL RPALHKSVGQ
ref|NP_923516.1|     IRRGARIASR LSAPLVVAHI GAHD--DGPT ARAVERLGEL TRQLGGEFIE RPAAANQVPE
ref|ZP_02329377.1|   IRRGFRIAFR LKARWHVAYL HHGSGMEDEA RLKELKGLTE RLGGSFEVIT GQGKKDPADL
ref|ZP_02329377.1|   ---------- ---------- ---------- ---------- ---------- ----------
ref|ZP_02329377.1|   ---------- ---------- ---------- ---------- ---------- ----------
RAAC02761            IRRGWRIADR LQAKLYVLVV QTEFPLSSQS ERDFAAVRDL AEQFGAEFLL RPALHKSVGQ
Clustal Consensus emb|CAG29823.1|      VIVETAESES VSQIVMGQPL NRGLGARFAH RPITYVLNRA EFVDLHIVAY AGRWSQPSA
ref|NP_923516.1|     QIDALAHEQG VTLLVMGESR RSRWEKLLHG CVIEQVVRRV RNLDVLIV-- ---------
ref|ZP_02329377.1|   LLAKANEYNS TQMILGKSCS PSWRDRWQGS LVKRLLRGAR HMDVLVV--- ---------
ref|ZP_02329377.1|   ---------- ---------- ---------- ---------- ---------- ---------
ref|ZP_02329377.1|   ---------- ---------- ---------- ---------- ---------- ---------
RAAC02761            VIVETAESES VSQIVMGQPL NRGLGARFAH RPITYVLNRA EFVDLHIVAY AGRWSQPSA
Clustal Consensus
```

FIG. 157

```
ref|YP_897521.1|        MEGKILIVDDQYGIRVLLHEVFQKEGYQTFQAANGFQALDIVKKDNPDLVVLDMKIPGMD
ref|ZP_00744427.1|      MEGKILIVDDQYGIRVLLHEVFQKEGYQTFQAANGFQALDIVKKDNPDLVVLDMKIPGMD
ref|YP_001647908.1|     MEGKILIVDDQYGIRVLLHEVFQKEGYQTFQAANGFQALDIVKKDNPDLVVLDMKIPGMD
ref|YP_001377039.1|     MEGKILIVDDQYGIRVLLHEVFQKEGYQTFQAANGFQALDIVKKDNPDLVILDMKIPGMD
ref|NP_244654.1|        ---KILVVDDQYGIRVLLNEILQKDGYQMFQAANGIQALAIVEEETPDLVLLDMKIPGMD
RAAC00477               MAYKVLVVDDQFGIRVLLHEVLQREGYEVFQASNGPSALSIVEREQPDLVLLDMKIPGMD
                           *:**:****:*::*::: *: . ..: :******* ref|YP_897521.1|        GIEILKHVKEIDESIKVILMTAYGELDMIQEAKDLGALMHFAKPFDIDEIRQAVRNELAV
ref|ZP_00744427.1|      GIEILKHVKEIDESIKVILMTAYGELDMIQEAKDLGALMHFAKPFDIDEIRQAVRNELAV
ref|YP_001647908.1|     GIEILKHVKEIDESIKVILMTAYGELDMIQEAKDLGALMHFAKPFDIDEIRQAVRDQLAV
ref|YP_001377039.1|     GIEILKHVKEINADIKVILMTAYGELDMIQEAKDLGALMHFAKPFDIDEIRQAVRNEI--
ref|NP_244654.1|        GLEILRRIKDMNPNIEVIMMTAYGELNMINEAMQLGAVTHFAKPFDIDDVRAVIAENMKS
RAAC00477               GLEILRNLRKLGVDAKVIMMTAYGELDLIHEAMEMGAVAHFTKPFDIDELRRTVREHLEA
                        *:***:..::.:.  . :**:*******::*:** ::**: **:******::*  .: ..:

ref|YP_897521.1|        EA---
ref|ZP_00744427.1|      EA---
ref|YP_001647908.1|     EA---
ref|YP_001377039.1|     -----
ref|NP_244654.1|        -----
RAAC00477               RAQAE
```

FIG. 158A

```
ref|YP_848463.1|      MRFFQSVQFKLVIMYLLLIIVAMQVIGAYFVRELEGQLEKNFQNSITNSITLLDYNAREE
ref|ZP_01695448.1|    ---FQSIHFKFVLIYILLIVVAMEIIGVYFINKLENQLETNFKKSIYDQVNVLEYSIEDL
ref|ZP_02169265.1|    ---FKSIHVKIVTIYVLLILIAMQVIGVYFTQQLEDQLVENFYETLDERANLLAYNVQQE
ref|ZP_00539458.1|    ---FKSIQWKLVVIYALLILVAMQVIGVYFVRSLEKQYITNFSKSVEDRAGLVAYNVGKE
ref|NP_694373.1|      ---FRSIQLKFIIIYILLLIIAVQVIGSFFTDRLNEELTRNFKTTVGERVEMLSHNLEQA
RAAC00019             MMRFRSLRVKLVMVYTLLILFAVELIGAYFVQALTSSLVRNQAQTARTQAQLMATLIAPE
                         *:*::  *::  :*  **::.  *:::**   :*         *        :       ::

ref|YP_848463.1|      IIKNSDNSV----KLQNDIRELLVDFSR---ASSNLIEVRIVDEK-GKILGTSNLNNQGI
ref|ZP_01695448.1|    LTKKQNQAA----DITLKVRKVLGDFK-----STDVSEIRLIDAHSGVILGTS-SNDQSI
ref|ZP_02169265.1|    MSRDEDEEE---QSLRVRTDNVLGELFN-----MENAQARVVDQF-SNVVTVTNPEEDIY
ref|ZP_00539458.1|    FDKTGDDEAS-KRQLSESLGQLLSEFSSGSTSRNDILEVQIIDQD-SIIQATSDEDNQSA
ref|NP_694373.1|      FARDRSEESGTIESLEEEIRRIINDINR----GNASTTINVVDNQ-SRVRGTNVLDDQNQ
RAAC00019             LAPGARVSN----SAVSNLLQSVPQFLN--------GTVYVLNQS---GYVMYTTAGGAL
                     :                .       . :  :: :                :::

ref|YP_848463.1|      VGQKSNDPLVKRTLSLGTTSEDKIYKDESNKNNRVWVNVSSIKNKGEVIGAIYLVADIES
ref|ZP_01695448.1|    VGQKTTEDIVKSVRVTGQP-EDQIYLDKQTG-DRMWVLASPIKANGELIGIIYLVSKIET
ref|ZP_02169265.1|    IGQRTTNFRIIRALG-GSTEEAVLRNENTGHRTRVLAVPVE-TEENQVVGAIYIEASMEE
ref|ZP_00539458.1|    VGQRATNSLIKKAQATSSSRVDTVLDPTTEDKIRIFAVPVTSERTGATTGMIYVRASMES
ref|NP_694373.1|      IGQKLAHPMVRDALLFNSTDDSIFYEKDTDSRVYVYVKPILGEDN-MAVGAIFYKSSLEE
RAAC00019             VGQKRIDSVATQALLHHTFAQSVRYDP--LSKSHLLAVAVPVTLHGTYLGVLEYVLSIQS
                     :**:       .                          :   .                 *  :           ..:

ref|YP_848463.1|      VYKQVDDITNIFITGTLIAMVITAILGILLSRTITKPIVEMKRQAYAMARGNYSRKVKVY
ref|ZP_01695448.1|    VYRQVQAINQIFMTGTVIAVLVTALLGIITARTISKPLSEIRKQAMAMARGNFARKVKVI
ref|ZP_02169265.1|    IYEQMAQTNQILLTGTMISLVLTAALGIFLSRTITRPIVEMRRQADFLGKGDFSQNVEVY
ref|ZP_00539458.1|    IYSQMQQVTRILATGTVIALVITSILGVLLSRTITRPISDMRRQAIEMRGNFSRKVKVY
ref|NP_694373.1|      VYGQIEDINNIFLQGSILAITISAIIGILVARTITKPIMEMREQALIMANGDFTQKVNVY
RAAC00019             TYETIHQATTIFYTGSIAVLAIVMILGAIVARALTRPVMEVTRQAEVMARGDFSQRLEAM
                        *     :  .  *:   *::    :  :    :*  : :*::::*:  ::  .**    :  .*::::.::.

ref|YP_848463.1|      GVDEIGELADSFNTLTKRVQEAQAMTEGERRKLSSVLAYMTDGVIATDRRGKVILINTPA
ref|ZP_01695448.1|    GNDEIGQLAYSFNHMTKKLQEAQASTEGERRKLDSILTHMTDGVIATDRRGRIILINEPA
ref|ZP_02169265.1|    GDDEIGQLSATFNELTNKLEEAHATTEGERRKLSSVLTHMTDGVIATDREGQIILMNRRA
ref|ZP_00539458.1|    SDDEIGQLARSFNELTDELLEANATTEAERRKLTSVLENMTDGVIATDRTLRVILMNDQA
ref|NP_694373.1|      GRDEIGQLAETFNDLNSRLKHSYATIEEERRKLSSILANMSDGVIATDNDGSVTLMNDAA
RAAC00019             SNDEIGDLVASINHLADELEEAIAANRLEQERLRAVITSMGEGVIVLDSSGQVLMMNRAA
                      . ****:*   ::*  ..:  .: *     .  *:..:*  :::   *  :***. *       : ::* * ref|YP_848463.1|      EKML----RVK---HESANGRSIIDVLDIGDSYQFEDLMEVDGSLTMDRSTLDKPYILRA
ref|ZP_01695448.1|    AEML----DVS---RETVLSQPLISVLKIENEHKFDDLLTEQDSVILDFSTEEEPYILRA
ref|ZP_02169265.1|    EELT----GYS---QEEAIGYDLVGMLNLAHFMKLSDLYNMDDPILLDFEHHDEELILEA
ref|ZP_00539458.1|    KDIV----GVD---ESGIVGTNLKDLLALGDDFMIPEDGTMP-PRLLDFSSEDELFLVRA
ref|NP_694373.1|      AKLIGE-------NPEDLIGDSVIDVLHLEGKEIDLSELHSNGSMIIDFSNEDTPFLIRA
RAAC00019             RQMLS----------QAAGGEEEAIRQLELDRLMQG--------DVATGVREVRVIGNT
                     .:              .    :    :          : :                :         :      :.:

ref|YP_848463.1|      NFSVI---QRET---GFNNGVIAVLHDITDQEKVDQERRDFVSNVSHELRTPLTSMHSYL
ref|ZP_01695448.1|    NFSVI---QNEA---GFVSGLITVLHDVTEQEKIDMERREFVANVSHELRTPLTTMRSYL
ref|ZP_02169265.1|    NFSVI---EKEN---GRKNGLIAVLHDTEQERIEQERREFVANVSHELRTPLTSMKSYL
ref|ZP_00539458.1|    FFSPV---KKHS---GPITGMIVLHDVTEQEQVEQDRREFVANVSHELRTPLTTMRSYL
ref|NP_694373.1|      NFSTVVD-EEEE-----VTGFITVISDVTEQQKMEQERRDFVSNVSHELRTPLTTMKSYL
RAAC00019             IPHVILTSVQRR---GQVDGYVAVVRDVTEQEKLDQARRDFVSNVSHELRTPLTTVKSYL
                       *    :      ..         * : *: *:*:*::::     **:**:************:::***
```

FIG. 158B

```
ref|YP_848463.1|      EALSDGAWEDKEIAPRFLEVTQNET--------ERMIRLVNDLLKLSRMDGGREHLE-KS
ref|ZP_01695448.1|    EALTDGAWKDEKIAPQFLGVTQNET--------ERMIRLVNDLLKLSKMDSKDEHLN-KE
ref|ZP_02169265.1|    EALLDGAVNDSDVAPQFLQVTSNET--------DRMIRLVNDLLQLSKMDARDDHML-MA
ref|ZP_00539458.1|    EALAEGAYQDEELAPRFLETTQNET--------ERMIRLVTDLLQLSKMDSKEYKMN-KV
ref|NP_694373.1|      EALSDGAWENKEIAPRFLDVTQKET--------NRMIRMVNDLLQLSKMDSDELPMH-KQ
RAAC00019             EVMRDLGDDEAETKREFLEVIARET--------DRMVRLTRDLLLLSGLDRGGPRSVEMR
                      *.: :   . .:  .      .   .                :**:*:. *  :* ref|YP_848463.1|      FVNFTD-FFNHIIDRFEMM-KKETIMFKRHIP-KEPVIIEIDEDKVMQVLDNIISNANKY
ref|ZP_01695448.1|    WVNFVE-FFHHVIDRFEM-AKQQNVTFKRKLP-NTEIFVEIDEDKMTQVLYNIISNALKY
ref|ZP_02169265.1|    EVNIVN-MIHHVIDRFEMSNKQENIQFRRRLPD-VPLSVMGDRDKLVQLLDNMVSNAVKY
ref|ZP_00539458.1|    RFDYIQ-FLNDILDRHDM-TKPERIRFRRKI-MKRKVYIRGDQDKLIQVADNILTNAIKY
ref|NP_694373.1|      REEFTS-YLYQVLDRYEMN-KPESIHMEKNIPNTK-AYVWMDRDKITQVLDNVITNAIKY
RAAC00019             AIPVHG-LLEGVVERFQLQAAKQELSLRVHLPQRRDVCVYGDEDMVNRVLDNVLSNALKY
                              :  :::*.::       :  : :.   .:             :   *.*  :  ::    *:::** **

ref|YP_848463.1|      SPDGGRISFYLKKFEDEIEISIADEGLGVPEEDLANVFDRFFRVDKARSREMGGTGLGLA
ref|ZP_01695448.1|    SPEGGQITFKLRELNEKIEVSISDQGVGIPKENVKKIFERFYRVDKARSRKLGGTGLGLA
ref|ZP_02169265.1|    SPEGGVITITLKQEKERLIVSVKDEGVGIPKENLPHVFDRFYRVDKARSRSLGGTGLGLA
ref|ZP_00539458.1|    SPEGGTITVRTMLRAKRIVISIKDEGVGIPKANLQKIFERFYRVDKARARKIGGTGLGLS
ref|NP_694373.1|      SPDGGKIRVKLDIRRHYLLVSIQDQGMGIAYDKLDKIFERFYRVDKARNRKLGGTGLGLA
RAAC00019             TPPGGRIEVRADVTAQHVTFIISDTGIGIPPEDLPHVFERFYREKGRSRRGGGTGLGLA
                      :*  ** *  .        .   :   :   *  *:*:.  .:  ::*:**:**:*.*  *  *******:

ref|YP_848463.1|      IAREVIEAHGGRIWAERNKSKGTVIKFTL--------
ref|ZP_01695448.1|    IAKEMVEMHGGSIWASSKEGKGTTIYFTLPYEPAQED
ref|ZP_02169265.1|    IAKEIVEVHGGHIWVSSDWGKGTTFFFSL--------
ref|ZP_00539458.1|    IAKDVVSAHGGDIWAESEWGRGTTIYFTL--------
ref|NP_694373.1|      ITKELVEAHHGQIWAQSSEGKGTTILFTL--------
RAAC00019             LAREMVERMGGEIRMESEPQRGTTVYVTLRRAEEDAV
                      ::::::.     * *    . . :**.. .:*
```

FIG. 159

```
ref|ZP_01169692.1|      MDKKILVVDDEKPIADILQFNLKKEGYEVHCAYDGNEALEKVEEVKPDLILLDIMLPQRD
ref|ZP_01695449.1|      MDKKILVVDDEKPIADILQFNLTKEGYTVYCAYDGEEALEKVEEVQPDLIVLDIMLPKRD
ref|YP_001127497.1|     MEKRILVVDDEKPIADILQFNLQKEGYEVICAYDGEEALQKVEETMPDLILLDIMLPLKD
ref|YP_149327.1|        MEKRILVVDDEKPIADILQFNLQKEGYEVICAYDGEEALQKVEETMPDLILLDIMLPLKD
ref|YP_534941.1|        ----ILVVDDEKPISDIVKFNLTKEGYDVYTAYDGEEALQQVKEVPDLILLDLMLPKID
RAAC00020               MPAHILVVEDEEPIANILRFALEREGYRVSCAYDGAEALERWRALQPDLILLDVMLPEVD
                             **::**::*::*  *  :***  *  ** *::   .    **::***   * ref|ZP_01169692.1|      GMEVCREVRKKYEMPIIMLTAKDSEIDKVLGLELGADDYVTKPFSNRELIARVKANLRRH
ref|ZP_01695449.1|      GMEVCREVRKKYNMPIIMVTAKDSEIDKVLGLELGADDYVTKPFSTRELIARVKANLRRH
ref|YP_001127497.1|     GMEVCREVRKKYDMPIIMLTAKDSEIDKVLGLELGADDYVTKPFSTRELLARVKANLRRH
ref|YP_149327.1|        GMEVCREVRKKYDMPIIMLTAKDSEIDKVLGLELGADDYVTKPFSTRELLARVKANLRRH
ref|YP_534941.1|        GLEVAREVRKTHDMPIIMVTAKDSEIDKVLGLELGADDYVTKPFSNRELVARVKANLRRQ
RAAC00020               GFDVLRAIRQASGVPVIILTAKDDEVDKVLGLELGADDYVTKPFSTRELVARVKANLRRA
                        *::*  *  :*:     :*:*::****.*:*****************.*:********* ref|ZP_01169692.1|      QQIAAKAGEEEETN-EIAIGSLVIHPDAYVVSKRGETIELTHREFELLHYLAKHIGQVMT
ref|ZP_01695449.1|      QQTPAAPGEEEESN-EIAIGSLVIHPDAYVVSKRGETIELTHREFELLHYLAKHIGQVMT
ref|YP_001127497.1|     AQTATQEEEESETN-EIVVGPLVIRPDAYVVQKRGETIELTHREFELLHYLAKHIGQVMT
ref|YP_149327.1|        AQTANQEEGENETN-EIVIGPLVIRPDAYVVQKRGETIELTHREFELLHYLAKHIGQVMT
ref|YP_534941.1|        SAVAAKSSAEDDKNSEITVGDLTIHPEAYTVSKNGQRIELTHREFELLHYLAQHLGQVMT
RAAC00020               SDVLR----EHKENERYVVQDLVIDLAEYTVTKAGQPIPLTHREFQVLAVLAAHPGRVFT
                          *   .   * . .  .: :  *.* *  *.*  * *: * *****:.* ** * *:*:* ref|ZP_01169692.1|      REHLLQTVWGYDYYGDVRTVDVTVRRLREKIEDNPSHPTWIVTRRGVGYYLRN-
ref|ZP_01695449.1|      REHLLETVWGYDYYGDVRTVDVTVRRLREKVEDNPSHPEWIVTRRGVGYYLRN-
ref|YP_001127497.1|     REHLLQTVWGYDYYGDVRTVDVTVRRLREKIEDNPSHPSWIVTRRGVGYYLRN-
ref|YP_149327.1|        REHLLQTVWGYDYYGDVRTVDVTVRRLREKIEDNPSHPNWIVTRRGVGYYLRN-
ref|YP_534941.1|        REHLLQTVWGYDYFGDVRTVDVTVRRLREKIEDNPSRPTWLVTRRGVGYYLRN-
RAAC00020               RDQLVDQVWGSDYVGDTRAVDVTIRRLREKLEPDPSQPRYVLTRRGVGYYVRNE
                        *::*::  *** ** **.*:****:******:*   :**:*   :::*********:**
```

FIG. 160A

```
gb|EDQ48509.1|      ------------------------------------------------------------
gb|EDQ48476.1|      ------------------------------------------------------------
ref|ZP_01575425.1|  ------------------------------------------------------------
RAAC01715           MSFGAETGGFGAFLSRTSAKKDKNDGIYDSPARRDSFIMFREKPFSFLVGREGRANVSVR
ref|ZP_02025790.1|  ------------------------------------------------------------
ref|YP_001662047.1| ------------------------------------------------------------ gb|EDQ48509.1|      ------------------------------------------------------------
gb|EDQ48476.1|      ------------------------------------------------------------
ref|ZP_01575425.1|  ------------------------------------------------------------
RAAC01715           MPKKTNVSSSLHAIREVRTSWPSVTWDVLQQHPVELDFREVERALDGVRDRQAWLVVVVR
ref|ZP_02025790.1|  ------------------------------------------------------------
ref|YP_001662047.1| ------------------------------------------------------------ gb|EDQ48509.1|      ------------------------------------------------------------
gb|EDQ48476.1|      ------------------------------------------------------------
ref|ZP_01575425.1|  ------------------------------------------------------------
RAAC01715           SSRVVPIYPFLAQIQSAGFDCVHLLSCDAAAYVMTLAAHHPERAMEGFESALARLAADRT
ref|ZP_02025790.1|  ------------------------------------------------------------
ref|YP_001662047.1| ------------------------------------------------------------ gb|EDQ48509.1|      ------------------------------------------------------------
gb|EDQ48476.1|      ------------------------------------------------------------
ref|ZP_01575425.1|  ------------------------------------------------------------
RAAC01715           LVGVSSACDEREVVRWWQALMEATAASHWNVFESSAYSQGRRELVPLHEEDRTRLITRAV
ref|ZP_02025790.1|  -----------KAASEAITALSLNFYSASHIIAFSRDYIANRNIFPVDISVRLHEYETAI
ref|YP_001662047.1| ------------------------------------------------------------ gb|EDQ48509.1|      ----------VLECVRQCFERLKEQRAGTGTIVRVCSQLEDMACREVQEYREIRGKEAR-
gb|EDQ48476.1|      ------------------------------------------------------------
ref|ZP_01575425.1|  ------------------------------------------------------------
RAAC01715           TQLGDRGYEGIASVVEDLFAQLAERPTKLEDVAELCAQFIMAAVGQRQADGRDRMLQVP-
ref|ZP_02025790.1|  LQLN---FKAAKDVVSTLFSNLQSNFTDEASVKNICTQIYLISYRLVMSTYNLPMDEKYV
ref|YP_001662047.1| ------------------------------------------------------------ gb|EDQ48509.1|      --ARLETQLR----ACMSFSDMEDCFVEAFRSAL---EKVYGLRSEMGGKAVEIVKRWIA
gb|EDQ48476.1|      ---ALR-------------------LIEARDDEK----------KEHTNQVVSRLNRYVE
ref|ZP_01575425.1|  ---------------------------------------------------INQVRKTIE
RAAC01715           --ISTRQWLRFVAEECPKWWDWRDKLKQALMVVL----GREEAVRTAHSAQIGQVIEIIE
ref|ZP_02025790.1|  KMLTESSDIFQLKSIVSDMIN---DLQIQLTQSVK----------KYSSFIEESLNYIK
ref|YP_001662047.1| ----------------------------------------------------IDEAIKLIQ
                                                                      :   . :

gb|EDQ48509.1|      EHY--SEHAELNTLAAMVYLTPSYLSKLFKQETGLTLTEYITDVRLKNAKRLLRTEPNMK
gb|EDQ48476.1|      EHL--DSDLSLTTLSDLVHLNPYYMSRLYKQMTGVNLPDYITDERIKKAKELVV-ESHLK
ref|ZP_01575425.1|  ERF--KEQISISTLARDVYLTPTYLCVLFKQVTGTTINDYLTLTRLEKAKK-LLSDPYIK
RAAC01715           RHY--DSDLDVATLASQVFLSPSYLSKRFKSETGMTIREFIVQTRLNKAKDLLLRDFHLK
ref|ZP_02025790.1|  EHL--EDDLSLEQIAQHIHINESYFSRTFKKECGNSVISYINNLRINKAKELLATS-NLK
ref|YP_001662047.1| ENY-SDLNISLNSIAEKLYITPNYLSTLFKSEMGVTFSDYLTACRIEKAKELL-KDVKVK
                    ..   . .: :: :.:.  *:. :*. *  .. .:   *:::**    :  . :*
```

FIG. 160B

```
gb|EDQ48509.1|           VHQIGAEVGYADPAYFNKLFKKVVGVTPNEYK-----------------
gb|EDQ48476.1|           MHEICKKVGFESPAYFTRIFKKTGSTPQEFREK----------------
ref|ZP_01575425.1|       LYDVCYEVGYLSPSYFSRLFKKYTGISPSEYRNVAI-------------
RAAC01715                AYEVGAHVGYPDPTYFNKLFKRQVGLTPKAFRDRAMRQARGFKQEDSRSS
ref|ZP_02025790.1|       TFEISEAVGIHDPAYFSVLFKKNTGMSPKAYRDQ---------------
ref|YP_001662047.1|      IYEVAEAVGYTDQHYFSKVFKNITGFTPKEYREKIL-------------
                          .::    **  .  **. :**. .* :*. ::
```

FIG. 161A

```
ref|NP_844784.1|      ------------------------------------------------------------
ref|ZP_02259481.1|    ------------------------------------------------------------
ref|YP_894957.1|      ------------------------------------------------------------
ref|NP_978751.1|      ------------------------------------------------------------
ref|ZP_00741477.1|    ------------------------------------------------------------
RAAC01137             -----------------------------------------------------MHRFEPKVR ref|NP_844784.1|      ---------------------------------------------------------LPETA
ref|ZP_02259481.1|    ---------------------------------------------------------LPETA
ref|YP_894957.1|      ---------------------------------------------------------LPETA
ref|NP_978751.1|      ---------------------------------------------------------LPETA
ref|ZP_00741477.1|    ---------------------------------------------------------LPETA
RAAC01137             TWSRTWRAAAILGWLLAAALLAAVFPAASKEEINRS-----------------TLLPASA
                                                                               ** :* ref|NP_844784.1|      MSQQAEALMKKEFPNNAGNPLLVVWYRDGGLQSQDYKLIQDVYKELKASPLKEQSTLPPF
ref|ZP_02259481.1|    MSQQAEALMKKEFPNNAGNPLLVVWYRDGGLQSQDYKLIQDVYKELKASPLKEQSTLPPF
ref|YP_894957.1|      MSQQAEALMKKEFPNNAGNPLLVVWYRDGGLQSQDYKLIQDVYKELKASPLKEQSTLPPF
ref|NP_978751.1|      MSQQAEALMKKEFPNNAGNPLLVVWYRDGGLQSQDYKLIQDVYKELKASPLKEQSTLPPF
ref|ZP_00741477.1|    MSQQAEALMKKEFPNNTGNPLLVVWYRDGGLQSQDYKLIQDVYKELKANPLKEQSTLPPF
RAAC01137             PSQMATARVRDAFPASSGTPAILVFYDPTGISSADWAAIRRTVRELRTHPVTAQTQVPPL
                       ** *  * ::. ** .:*.* ::*:*    *:.* *:  *: . :**:: *:. *: :**:

ref|NP_844784.1|      DTIPEQVLSKSASKDGTSFVTPVFFNKSAGTDILKENLDDLRNIVNSKVDEDPFKRKIND
ref|ZP_02259481.1|    DTIPEQVLSKSASKDGTSFVTPVFFNKSAGTDILKGNLDDLRKIVNSKVDVDPFKQKISD
ref|YP_894957.1|      DTIPEQVLSKSASKDGTSFVTPVFFNKSAGTDILKGNLDDLRKIVNSKVDVDPFKQKISD
ref|NP_978751.1|      DTIPEQALSKSASKDGTSFVTPVFFNKSAGTDILKGNLDDLRKIVNSKVDVDPFKQKISD
ref|ZP_00741477.1|    DTIPEQVLSKSASKDGTSFVTPVFFNKSAGTDILKGNLEKLEKKVNSKVDEDPFKQKISE
RAAC01137             DALPSGAAARFASDDGKVVSFPVLLRADASQDQLNQAVDEIDQDLRRAVGAGALNLALDR
                      *::*. . :: **.**. . **::. .*. * *:   ::.: : :.  *. ..::  :.

ref|NP_844784.1|      AGLHVRLSGPVGIQTDAVSLFSQADVKLLVATVLLVLVLLILLYRSPILAILPLLVVGFA
ref|ZP_02259481.1|    SGLHVRLSGPVGIQTDAVSLFSQADVKLLIATVLLVLVLLILLYRSPILAILPLLVVGFA
ref|YP_894957.1|      SGLHVRLSGPVGIQTDAVSLFSQADVKLLIATVLLVLVLLILLYRSPILAILPLLVVGFA
ref|NP_978751.1|      SGLHVRLSGPVGIQTDAVSLFSQADVKLLVATVLLVLVLLILLYRSPILAILPLLVVGFA
ref|ZP_00741477.1|    SGLHVRLSGPVGIQTDAVSLFSQADVKLLVATVLLVLILLILLYRSPILAILPILVVGFA
RAAC01137             PGLHAYVTGPAGIAVDATHLFQHADLALLIATTLLVLAMIVLYRSPILALVPLVSVGIA
                      .***. ::**.** .**. **:**.:**: **:**.**** *:*:*********::*:: **:*
```

FIG. 161B

```
ref|NP_844784.1|       YGIISPTLGFLADHGWIKVDAQAISIMTVLLFGAGTDYCLFLISRYREYLLEEESKYKAL
ref|ZP_02259481.1|     YGIISPTLGFLADYGWIKVDAQAISIMTVLLFGAGTDYCLFLISRYREYLLEEESKYKAL
ref|YP_894957.1|       YGIISPTLGFLADHGWIKVDAQAISIMTVLLFGAGTDYCLFLISRYREYLLEEESKYKAL
ref|NP_978751.1|       YGIISPTLGFLADHGWIKVDAQAISIMTVLLFGAGTDYCLFLISRYREYLLEEESKYKAL
ref|ZP_00741477.1|     YGIISPTLGFLADHGWIKVDAQAISIMTVLLFGAGTDYCLFLISRYREYLLEEESKYKAL
RAAC01137              YAVVSSLLGAWARYGGLTFDAQTLSILTVLLFGAGTDYCLFLIARYRQELRRHERPIDAL
                       *.::*. **   * :* :..***::**:**************:***: *  ..*   .**

ref|NP_844784.1|       QLAIKASGGAIIMSALTVVLGLGTLLLAHYGAFHRFAVPFSVAVFIMGIAALTILPAFLL
ref|ZP_02259481.1|     QLAIKASGGAIIMSALTVVLGLGTLLLAHYGAFHRFAVPFSAAVFIMGIAALTILPAFLL
ref|YP_894957.1|       QLAIKASGGAIIMSALTVVLGLGTLLLAHYGAFHRFAVPFSVAVFIMGIAALTILPALLL
ref|NP_978751.1|       QLAIKASGGAIIMSALTVVLGLGTLLLAHYGAFHRFAVPFSVAVFIMGIAALTILPALLL
ref|ZP_00741477.1|     QLAIKASGGAIIMSALTVVLGLGTLLLAHYGAFHRFAVPFSVAVFIMGIAALTILPALLL
RAAC01137              RAGYKSAAGAILMSGLTVSASLLSLLAARSPSFHEFAIPFSVAVFVMALVAITFVPALIG
                       :  . *::.***:**.***  .* :** *:  :**.**:***.***:*.:.*:*::**::

ref|NP_844784.1|       IFGRTAFFPFIPRTTSMNEELARRKKKVVKVKKSKGAFSKKLGDVVVRRPWTIIMLTVFV
ref|ZP_02259481.1|     IFGRTAFFPFIPRTTSMNEELARRKKKVVKVKKSKGAFSKKLGDVVVRRPWTIIMLTVFV
ref|YP_894957.1|       IFGRAAFFPFVPRTTSMNEELARRKKKVVKVKKSKGAFSKKLGDVVVRRPWTIIMLTVFV
ref|NP_978751.1|       IFGRAAFFPFVPRTTSMNEELARRKKKVVKVKKSKGAFSKKLGDVVVRRPWTIIMLTVFV
ref|ZP_00741477.1|     IFGRIAFFPFIPRTTSMNEEFARKKKRAVKVEKSKGSFSKKLGDVVVRRPWTIIMLTVFV
RAAC01137              SLGRAAFWPRIPRYEPDAPDAGR-----------PGRVSRWLGRTAVRRRKPVAVLGSLA
                       :**  ** :* :**      .  :  .*         *.*: ** ..*** .: :*  :.

ref|NP_844784.1|       LGGLASFVPRIQYTYDLLESFPKDMPSREGFTLISDHFSAGELAPVKVIVDTKGKELPIK
ref|ZP_02259481.1|     LGGLASFVPRIQYTYDLLESFPKDMPSREGFTLISDHFSAGELAPVKVIVDTKGKELPIK
ref|YP_894957.1|       LGGLASFVPRIQYTYDLLESFPKDMPSREGFTLISDHFSAGELAPVKVVVDTKGKELPIK
ref|NP_978751.1|       LGGLASFVPRIQYTYDLLESFPKDMPSREGFTLISDHFSAGELAPVKVVVDTKGKELPMK
ref|ZP_00741477.1|     LGGLASFVPRIQYTYDLLESFPKDMPSREGFTLISDHFSAGELAPVKVVVDTKGKELPIK
RAAC01137              LAACCLALPHVRTSYDLLSSFPADMPSREGYAVLSAHESPGALAPIDVLVEGGSPEGAVR
                       *... . :*::: :****.*** ******::::* * *.* ***:.*:*:    .* .::

ref|NP_844784.1|       --EELEKFSFVNTVKDPKEGKENKQIQMYEVSLAENPYSIEALDQIPKLKNSVEKVFKDA
ref|ZP_02259481.1|     --EELEKFSFVNTVKDPKEGKENKQIQMYEVSLAENPYSIEALDQIPKLKNSVEKVFKDA
ref|YP_894957.1|       --EELEKFSFVNTVKDPKEGKENKQIQMYEVSLAENPYSIEALDQIPKLKNSVEKVFKDA
ref|NP_978751.1|       --QELEKFSFVKTVKEPKDGKENKQIKMYEVSLAENPYSIEALDQIPKLKIHVEKVLKDA
ref|ZP_00741477.1|     --QELEKFSFVNTVKEPKEGKENKQIQMYEVSLAENPYSIEALDQIPKLKSNVEKVLKDA
RAAC01137              ---AVQSLAAVEQVH-LVAVRDHAHVALMQVELRTNPYSETAMAALS----SIERAAAKG
                         ::.:: *: *:   :::  ::  : :*.*  **** *:   :.       :*:.. ..

ref|NP_844784.1|       GISNAED-QLWIGGETASLYDTKQITERDEAVIIPVMISIIALLLLVYLRSIVAMIYLIV
ref|ZP_02259481.1|     GISNAED-QLWIGGETASLYDTKQITERDEAIIIPVMISIIALLLLVYLRSIVAMIYLIV
ref|YP_894957.1|       GISNAED-QLWIGGETASLYDTKQITERDEAVIIPVMISIIALLLLVYLRSIVAMIYLIV
ref|NP_978751.1|       GVTKAED-QLWIGGETASLYDTKQITERDEAVIIPVMISIIALLLLVYLRSIVAMIYLIV
ref|ZP_00741477.1|     GIRNTED-QLWIGGETASLYDTKQITERDESVIIPVMISIIALLLLVYLRSIVAMIYLIV
RAAC01137              ASAGGQAAHVFLAGETAAQEDTRAITARDTRVVIPIVLVAIGLLLLVYLRSVVAPLYLLA
                       .   :   : :::: .****:  **: ** **  ::**:::  *.********:** :**:.

ref|NP_844784.1|       TVVLSFFSALGAGWLLLHYGMGAPAIQGAIPLYAFVFLVALGEDYNIFMVSEIWKNRKTQ
ref|ZP_02259481.1|     TVVLSFFSALGAGWLLLHYGMGAPAIQGAIPLYAFVFLVALGEDYNIFMVSEIWKNRKTQ
ref|YP_894957.1|       TVVLSFFSALGAGWLLLHYGMGVPAIQGAIPLYAFVFLVALGEDYNIFMVSEIWKNRKTQ
ref|NP_978751.1|       TVVLSFFSALGAGWILLHFGMGAPAIQGAIPLYAFVFLVALGEDYNIFMVSEIWKNRKTQ
ref|ZP_00741477.1|     TVVLSFFSALGAGWILLHYGMGAPAIQGAIPLYAFVFLVALGEDYNIFMVSEIWKNRKTQ
RAAC01137              TIVLSYGAAMGLGWLVIREVLHQPAMQGAIPLYAFVFLVALGEDYNIFVMSRIWEVWRRG
                       *:***: :*:* **::::  :   **:********************:*.**:  :
```

FIG. 161C

```
ref|NP_844784.1|      NHLDAVKNGVIQTGSVITSAGLILAGTFAVLGTLPIQVLVQFGIVTAIGVLLDTFIVRPL
ref|ZP_02259481.1|    NHLDAVKNGVIQTGSVITSAGLILAGTFAVLGTLPIQVLVQFGIVTAIGVLLDTFIVRPL
ref|YP_894957.1|      NHLDAVKNGVIQTGSVITSAGLILAGTFAVLGTLPIQVLVQFGIVTAIGVLLDTFIVRPL
ref|NP_978751.1|      NHLAAVKNGVIQTGSVITSAGLILAGTFAVLGTLPIQVLVQFGIVTAIGVLLDTFIVRPL
ref|ZP_00741477.1|    NHMDAVKNGVIQTGSVITSAGLILAGTFAVLGTLPIQVLVQFGIVTAIGVLLDTFIVRPL
RAAC01137             QADAAVERGVADTASVITSAGLILAGTFAMLASLPIQVLLQFGVVTAIGVLLDTFVVRPW
                      :  :.  :*.**************:*.:****:*.**********:* ref|NP_844784.1|      LVPAITVVLGRFAFWP---
ref|ZP_02259481.1|    LVPAITVVLGRFAFWP---
ref|YP_894957.1|      LVPAITVVLGRFAFWP---
ref|NP_978751.1|      LVPAITVVLGRFAFWP---
ref|ZP_00741477.1|    LVPAITVVLGRFAFWP---
RAAC01137             MVPAITALLGDAARWPRRT
                      :*****.:**   * **
```

FIG. 162A

```
ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|NP_470526.1|         ---------- ---------- ---------- ---------- ---------- ----------
RAAC03013                MAERYAHFVA RFKYGIIAVW ILAVALAHVL LPQLNAIVAH KNTEFLPNSS SVVIASNWLK ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|NP_470526.1|         ---------- ---------- ---------- ---------- ---------- ----------
RAAC03013                RVDPARQAGS SAVVAMYNPH GLTAADKAWF TQKLKQVADH KPAYGVKTVT AAYNQSKSVQ ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|NP_470526.1|         ---------- ---------- ---------- ---------- ---------- ----------
RAAC03013                NQFFSADRTV EIATIGFPGN DVSKATDASL NQLHQVFQQP PKDAQILFTG DTPIENDNIN ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|NP_470526.1|         ---------- ---------- ---------- ---------- ---------- ----------
RAAC03013                ISMDGASKTA GVTIALVLVI LLVVFRSVVA PFLTLLSIGL SYLLTTNLVA VLANVGLPVS ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|NP_470526.1|         ---------- ---------- ---------- ---------- ---------- ----------
RAAC03013                TFTDTFLIAI IFGAGTDYSI IVLNRFREEA SRGLAPVDAL ARAMSGVAKT VVYSALTVFL ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|NP_470526.1|         ---------- ---------- ---------- ---------- ---------- ----------
RAAC03013                SFATLYFARF GLFRSGVGVA VGLAVTLFAC LTFLPALMMV LGRYVFWPRR NLDGASHKPS ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|NP_470526.1|         ---------- ---------- ---------- ---------- ---------- ----------
RAAC03013                RIWDLTGRTA LRHPWWTLAG VLVVLTPIAL SFTDKRTFDP TSDIPTAPSV EGFHVVSKAF ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|ZP_02168855.1|       ---------- ---------- ---------- ---------- ---------- ----------
ref|NP_470526.1|         ---------- ---------- ---------- ---------- ---------- ----------
RAAC03013                GPGKVLPMDV VIDTPDNLRT PEGLATIEQV SEAIAKLPFV QQVQSATRPT GSVIAEFELA ref|ZP_02168855.1|       ---------- ---------- ---------- ---------- ---------- ----------
ref|ZP_02168855.1|       ---------- ---------- ---------- ---------- ---------- ----------
```

FIG. 162B

```
ref|ZP_02168855.1|    ---------- ---------- ---------- ---------- ---------- ----------
ref|ZP_02168855.1|    ---------- ---------- ---------- ---------- ---------- ----------
ref|NP_470526.1|      ---------- ---------- ---------- ---------- ---------- ----------
RAAC03013             KQNQLAANGL GKVQTGLNQV ASHVGTKSAQ QAANAANTLS SGASALAQAG GKLSQGAAQA ref|ZP_02168855.1|    ---------- ---------- ---------- ---------- ---------- ----------
ref|ZP_02168855.1|    ---------- ---------- ---------- ---------- ---------- ----------
ref|ZP_02168855.1|    ---------- ---------- ---------- ---------- ---------- ----------
ref|ZP_02168855.1|    ---------- ---------- ---------- ---------- ---------- ----------
ref|NP_470526.1|      ---------- ---------- ---------- ---------- ---------- ----------
RAAC03013             QEGASKLAAG AQALSSGASR LTQANTQLAS GAAQVAAGSQ QVAQGADKLA TSARSIASGQ ref|ZP_02168855.1|    ---------- ---------- ---------- ---------- ---------- ----------
ref|ZP_02168855.1|    ---------- ---PDIDQFV REEGQAEAPE GFPSQIAEEL IEEDD-GFGG EEILLVYEQE
ref|ZP_02168855.1|    ---------- ---------- ---------- ---------- ---------- ----------
ref|ZP_02168855.1|    ---------- ---------- ---------- ---------- ---------- ----------
ref|NP_470526.1|      ---------- ---PPMADLV REKGELKLPD GYPSSLATEM QKKHNPDDKG SAYIAVYTAD
RAAC03013             TALANGAARE AQAAQQLANA IAAWTKAHPA EASDPNWQQI VALAQGNAAG AQQTAKAASQ ref|ZP_02168855.1|    ---------- ---------- ---------- ---------- ----DGMAEA RQGASDLSGG
ref|ZP_02168855.1|    DGFSSEQKEE IKEVLAGLSE EDHNLPIHAV TGPFDGDMEE ERLISEDGDV LIALVEMDIE
ref|ZP_02168855.1|    ---------- ---------- ---------- ---------- ---------- ----------
ref|ZP_02168855.1|    ---------- ---------- ---------- ---------- ---------- ----------
ref|NP_470526.1|      HKLTGTELNN IKKSLDSIDK NKDELHVTNV VSSFNQPELK DKFLSKDGKT MVASLTVDDT
RAAC03013             LANGTSQWAN GATSLAEGAG KVAAGASQLA AGSRGAASGA KGLSDGAAQV GQGASSLAQG ref|ZP_02168855.1|    LDELQSGHYA LLDGVGEGRN GLENFRKGLR DMLEGTEELN -------EGI GEAEDALRQV
ref|ZP_02168855.1|    AHEYADIRNE LQEASQAEGV DHDQTGEAVI NEDVVVSTEE GLVTSTYITV SLVFLVLALV
ref|ZP_02168855.1|    ---------- ---------- ---------- ---------- ---------- ----------
ref|ZP_02168855.1|    ---------- ---------- ---------- ---------- -------TEE GLVTSTYITV SLVFLVLALV
ref|NP_470526.1|      DASVKSIRNA LDKKMDVKGV DTYLTGNKLI QEDVVQGSED GLHKTEGITV VFILVVLFLV
RAAC03013             LNQLSGGARQ LQAGLGKWAA GAAQFSSGLS NAGAGENQLH SALVKLSNGV GTVKTALDET ref|ZP_02168855.1|    SKQEENPLEG LFIPNEAF-E EEAFEEAFDQ YV--TPGGQV AGMELLFEED PYSQEAMMIL
ref|ZP_02168855.1|    FKSLVSPLVP LLLLGTVYLF SISIVSRLID WVGFPVSNFT QMFVLAVVFG VGTDYCILIM
ref|ZP_02168855.1|    ---------- ---------- ---------- ---------- ---------- ----------
ref|ZP_02168855.1|    FKSLVSPLVP LLLLGTVYLF SISIVSRLID WVGFPVSNFT QMFVLAVVFG VGTDYCILIM
ref|NP_470526.1|      FRSAVAPFIP LLTVGISYLV AQSTVAFLID IFNFPVSTYT QIFMVCIMFG IGTDYCILLM
RAAC03013             AKAQTSGDPG FYVPASAISS NKSLRQALDS YI--SPDGHV ADIRVTLKSD PYSMTAIQEM ref|ZP_02168855.1|    DEVEEVAAFT LRDTPFEDKE MAFSGITSSN RDLRDVSDQD FFVTAAVMLA GIFIALTFLF
ref|ZP_02168855.1|    KRFQEEVLKD QTAFQAMLTT MRASKSTVLY SALTGFIGFA TIYLADFDLY QSAVGVAVAV
ref|ZP_02168855.1|    ---------- ---------- ---------- ---------- ---------- ----------
ref|ZP_02168855.1|    KRFQEEVLKD QTAFQAMLTT MRASKSTVLY SALTGFIGFA TIYLADFDLY QSAVGVAVAV
ref|NP_470526.1|      SRFKEEMGAG LDPRESVHAT YRTAGKTVIY SGVAVLVAFT SLYFVQFDLY RSAVAVGVGI
RAAC03013             PRLETVAQAA FTAAPIHTGQ VGFAGTTPTQ YALNQLSNQD FVRMMALILG SIFLLLVVML ref|ZP_02168855.1|    KSLIMPLYVL VSLVLTYIGS MAVAELIFVT ILGYDGIM-- ---WAVPFFS FVLLMALGVD
ref|ZP_02168855.1|    LVMMAGIWMV MPAVLALGGV RLFWPGKPGS SNPSNPLWGF IGGLTLRSPK LALVAVALLV
ref|ZP_02168855.1|    ---------- ---------- ---------- ---------- --------FS FVLLMALGVD
ref|ZP_02168855.1|    LVMMAGIWMV MPAVLALGGV RLFWP----- ---------- ---------- ----------
ref|NP_470526.1|      VVLLAALYTL VPFFMSTLGT HLFWPLNKNI SHKENKVWGA AGKFTFARPW IALLIVAAIT
RAAC03013             RSLIAPLYVI ASLTGTYFVT MACLQFVAVD VMHKAGIS-- ---WTVPFFA LLLLVALGVD
```

FIG. 162C

```
ref|ZP_02168855.1|    YSIFLMGRFR EILEEGEEIT IHDAIHIAMK RIGGTVISAA LILGGTFAAM MASGVLTLMQ
ref|ZP_02168855.1|    IPFYLFYDDL RSFDNVQEIR GDYDSVKAYE LTEEAFGQGD LFFSTLYLKT DEASWDDHGK
ref|ZP_02168855.1|    YSIFLMGRFR EILEEGEEIT IHDAIHIAMK RIGGTVISAA LILGGTFAAM MASGVLTLMQ
ref|ZP_02168855.1|    ---------- ---------- ---------- ---------- ---------- ----------
ref|NP_470526.1|      LPPILLHTGT ESFNSLDEIS DKYPSKKGFE IVSDSFGAGQ VAPTQVFIEN DDN-MRTTEY
RAAC03013             YSIFLMSRFD EELRRHPELN LRSAMLYAMR QMGNVIFSAA AIMAGTFGSM SVSGVTTLVE ref|ZP_02168855.1|    VSTVIMTGLL LYTLVMLPVF VPACMLLLGS WNWWPLGR-- ---------- ----------
ref|ZP_02168855.1|    IAHLEQLAMN IEKVEGIRGV RGLNRPDEDV PDEFRIPEQA GILSEGMVEA LDGLDELSDG
ref|ZP_02168855.1|    VSTVIMTGLL LYTLVMLPVF VPACMLLLGS WNWWP----- ---------- ----------
ref|ZP_02168855.1|    ---------- ---------- ---------- ---------- ---------- ----------
ref|NP_470526.1|      IAQIEKISDD LSHLKGIDMV MSASRPAGKR VDDIYIKNQA GQVNDGVGQA TDGVGEVKKG
RAAC03013             IGLSVIIGLA LYALIVLALF VPACTAIVGE AHFWPFRRVP REEQELRLPE ELAAE----- ref|ZP_02168855.1|    -------
ref|ZP_02168855.1|    I------
ref|ZP_02168855.1|    -------
ref|ZP_02168855.1|    -------
ref|NP_470526.1|      LDSASSE
RAAC03013             -------
```

TRANSCRIPTIONAL CONTROL IN *ALICYCLOBACILLUS ACIDOCALDARIUS* AND ASSOCIATED GENES, PROTEINS, AND METHODS

GOVERNMENT RIGHTS

This invention was made with government support under Contract Number DE-AC07-99ID13727 and Contract Number DE-AC07-05ID14517 awarded by the United States Department of Energy. The government has certain rights in the invention.

CROSS-REFERENCE TO RELATED APPLICATIONS

This application claims the benefit of the filing of U.S. Provisional Patent Application Ser. No. 61/030,820, filed Feb. 22, 2008, for "TRANSCRIPTIONAL CONTROL IN *ALICYCLOBACILLUS ACIDOCALDARIUS* AND ASSOCIATED GENES, PROTEINS, AND METHODS."

STATEMENT ACCORDING TO 37 C.F.R. §1.52(e)(5)—SEQUENCE LISTING SUBMITTED ON COMPACT DISC

Pursuant to 37 C.F.R. §1.52(e)(1)(ii), a compact disc containing an electronic version of the Sequence Listing has been submitted concomitant with this application, the contents of which are hereby incorporated by reference. A second compact disc is submitted and is an identical copy of the first compact disc. The discs are labeled "copy 1" and "copy 2," respectively, and each disc contains one file entitled "Utility SEQ LIST II.txt," which is 5,528 KB and was created on Feb. 20, 2009.

TECHNICAL FIELD

The present invention relates generally to biotechnology. More specifically, the present invention relates to isolated and/or purified polypeptides and nucleic acid sequences encoding polypeptides from *Alicyclobacillus acidocaldarius* and methods for their use.

BACKGROUND

Bacterial DNA codes for information that regulates transcription of genes into mRNA which codes for proteins or enzymes used for control of growth and processing of energy, carbon and other compounds by the cell. Most of these transcriptional regulators/repressors function to turn on and off genes to minimize expenditure of cellular energy in response to their growth environment (i.e., presence of growth substrate, metals, temperature, etc.).

BRIEF SUMMARY OF THE INVENTION

Embodiments of the invention relate to purified and/or isolated nucleotide sequences of the genome of *Alicyclobacillus acidocaldarius*, or a homologue or fragment thereof. In one embodiment of the invention, the nucleotide sequence is selected from at least one of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 or a homologue or fragment thereof. In another embodiment of the invention, the homologue is selected from the group consisting of a nucleotide sequence having at least 80% sequence identity to at least one of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928.

Embodiments of the invention may further relate to an isolated and/or purified nucleic acid sequence comprising a nucleic acid sequence encoding a polypeptide selected from the group consisting of a polypeptide having at least 90% sequence identity to at least one of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927.

Embodiments of the invention also relate to isolated and/or purified polypeptides coded for by a nucleotide sequence comprising a nucleotide sequence of the genome of *Alicyclobacillus acidocaldarius*, or a homologue or fragment thereof. In one embodiment, the nucleotide sequence comprises a nucleotide sequence selected from the group consisting of a nucleotide sequence having at least 80% sequence identity to at least one of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2860, 2877, 2894, 2911, and 2928.

In another embodiment of the invention, the nucleotide sequence comprises a nucleotide sequence selected from at least one of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2860, 2877, 2894, 2911, and 2928 or a homologue or fragment thereof. In still another embodiment, the polypeptide comprises an amino acid sequence of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927.

In yet another embodiment, the polypeptide comprises an amino acid sequence selected from the group consisting of a polypeptide having at least 90% sequence identity to at least one of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927.

In embodiments of the invention, the polypeptides may be acidophilic and/or thermophilic. In further embodiments, the polypeptides may be glycosylated, pegylated, and/or otherwise post-translationally modified.

Embodiments of methods include placing a recombinant, purified, and/or isolated polypeptide selected from the group consisting of a polypeptide having at least 90% sequence identity to SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 in, or replacing a component, of an in-vitro transcription system such as, by way of non-limiting example, a polymerase chain reaction or a reticulocyte lysate transcription/translation system.

Further embodiments of methods include placing a cell producing or encoding a recombinant, purified, and/or isolated nucleotide sequence comprising a nucleotide sequence selected from the group consisting of a nucleotide sequences having at least 90% sequence identity to at least one of the sequences of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2860, 2877, 2894, 2911, and 2928 and/or a recombinant, purified, and/or isolated polypeptide selected from the group consisting of a polypeptide having at least 90% sequence identity to at least one of the sequences of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 in an environment comprising temperatures at or above about 25, 30, 35, 40, 45, 50, 55, 60, 65, 70, 75, 80, 85, 90, and/or 95 degrees Celsius and/or a pH at, below, and/or above 8, 7, 6, 5,4, 3, 2, 1, and/or 0.

These and other aspects of the invention will become apparent to the skilled artisan in view of the teachings contained herein.

BRIEF DESCRIPTION OF THE SEVERAL VIEWS OF THE DRAWINGS

FIG. 1 depicts a sequence alignment (ClustalW) between SEQ ID NO: 1446 (RAAC01465) and reflZP_01666866.1|, reflYP_001039288.1|, reflYP_001210812.1|, reflYP_001111548.1|, and reflZP_01576004.1| (SEQ ID NOS: 1448-1452), respectively, which all have the function assigned to SEQ ID NO: 1446 in Table 1. Amino acids conserved among all sequences are indicted by a "*" and generally conserved amino acids are indicated by a ":".

FIG. 2 depicts a sequence alignment (ClustalW) between SEQ ID NO: 443 (RAAC00371) and reflYP_145986.1|, reflYP_001124263.1|, reflNP_241028.1|, reflYP_001210899.1|, and reflYP_001111617.1| (SEQ ID NOS: 445-449), respectively, which all have the function assigned to SEQ ID NO: 443 in Table 1. Amino acids conserved among all sequences are indicted by a "*" and generally conserved amino acids are indicated by a ":".

FIGS. 3A-3C depict a sequence alignment (ClustalW) (ClustalW) between SEQ ID NO: 477 (RAAC00408) and reflZP_02326346.1|, reflNP_240992.1|, reflYP_001124230.1|, reflYP_145951.1|, and reflYP_173646.1| (SEQ ID NOS: 479-483), respectively, which all have the function assigned to SEQ ID NO: 477 in Table 1. Amino acids conserved among all sequences are indicted by a "*" and generally conserved amino acids are indicated by a ":".

FIGS. 4A-4C depict a sequence alignment (ClustalW) (ClustalW) between SEQ ID NO: 460 (RAAC00407) and reflZP_02326345.1|, reflYP_001124231.1|, reflNP_240993.1|, reflYP_145952.1|, and reflNP_976431.1| (SEQ ID NOS: 462-466), respectively, which all have the function assigned to SEQ ID NO: 460 in Table 1. Amino acids conserved among all sequences are indicted by a "*" and generally conserved amino acids are indicated by a ":".

FIG. 5 depicts a sequence alignment (ClustalW) between SEQ ID NO: 596 (RAAC00480) and reflNP_244660|, reflZP_01168478.1|, reflYP_001127419.1|, reflZP_01860921.1|, and reflNP_693930.1| (SEQ ID NOS: 598-602), respectively, which all have the function assigned to SEQ ID NO: 596 in Table 1. Amino acids conserved among all sequences are indicted by a "*" and generally conserved amino acids are indicated by a ":".

FIG. 6 depicts a sequence alignment (ClustalW) between SEQ ID NO: 307 (RAAC00147) and reflYP_850042.1|, reflNP_465351.1|, reflYP_014447.1|, reflNP 268055.1|, and reflNP_471274.1| (SEQ ID NOS: 309-313), respectively, which all have the function assigned to SEQ ID NO: 307 in Table 1. Amino acids conserved among all sequences are indicted by a "*" and generally conserved amino acids are indicated by a ":".

FIG. 7 depicts a sequence alignment (ClustalW) between SEQ ID NO: 1752 (RAAC01826) and reflYP_074736.1|, reflYP_074981.1|, reflYP_001394390.1|, reflNP_244228.1|, and reflYP_001275817.1| (SEQ ID NOS: 1754-1758), respectively, which all have the function assigned to SEQ ID NO: 1752 in Table 1. Amino acids conserved among all sequences are indicted by a "*" and generally conserved amino acids are indicated by a ":".

FIG. 8 depicts a sequence alignment (ClustalW) between SEQ ID NO: 868 (RAAC00896) and reflYP_001126509.1|, reflYP_148335.1|, reflZP_02328521.1|, reflZP_01173341.1|, and reflYP_001376241.1| (SEQ ID NOS: 870-874), respectively, which all have the function assigned to SEQ ID NO: 868 in Table 1. Amino acids conserved among all sequences are indicted by a "*" and generally conserved amino acids are indicated by a ":".

FIG. 9 depicts a sequence alignment (ClustalW) between SEQ ID NO: 256 (RAAC00120) and reflNP_243422.1|, reflYP_146980.1|, reflYP_001125115.1|, reflZP_01862300.1|, and reflZP_01172495.1| (SEQ ID NOS: 258-262), respectively, which all have the function assigned to SEQ ID NO: 256 in Table 1. Amino acids conserved among all sequences are indicted by a "*" and generally conserved amino acids are indicated by a ":".

FIG. 10 depicts a sequence alignment (ClustalW) between SEQ ID NO: 1956 (RAAC02146) and reflYP_001126333.1|, gblAAB81194.1|, reflYP_148161.1|, pdbl1L0O|C, and reflYP_001487306.1| (SEQ ID NOS: 1958-1962), respectively, which all have the function assigned to SEQ ID NO: 1956 in Table 1. Amino acids conserved among all sequences are indicted by a "*" and generally conserved amino acids are indicated by a ":".

FIG. 11 depicts a sequence alignment (ClustalW) between SEQ ID NO: 273 (RAAC00121) and reflZP_02330758.1|, reflYP_001212395.1|, reflYP_001125116.1|, reflNP_243420.1|, and reflZP_01667054.1| (SEQ ID NOS: 275-279), respectively, which all have the function assigned to SEQ ID NO: 273 in Table 1. Amino acids conserved among all sequences are indicted by a "*" and generally conserved amino acids are indicated by a ":".

FIG. 12 depicts a sequence alignment (ClustalW) between SEQ ID NO: 2262 (RAAC02546) and reflYP_001512033.1|, reflNP_976421.1|, reflNP_842661.1|, reflNP_829995.1|, and reflYP_001373458.1| (SEQ ID NOS: 2264-2268), respectively, which all have the function assigned to SEQ ID NO: 2262 in Table 1. Amino acids conserved among all sequences are indicted by a "*" and generally conserved amino acids are indicated by a ":".

FIG. 13 depicts a sequence alignment (ClustalW) between SEQ ID NO: 511 (RAAC00418) and reflYP_077384.1|, reflYP_001419777.1|, emblCAA41793.1|, reflZP_01173595.1|, and reflNP_240981.1| (SEQ ID NOS: 513-517), respectively, which all have the function assigned to SEQ ID NO: 511 in Table 1. Amino acids conserved among all sequences are indicted by a "*" and generally conserved amino acids are indicated by a ":".

FIG. 14 depicts a sequence alignment (ClustalW) between SEQ ID NO: 2602 (RAAC02968) and reflYP_001409756.1|, reflYP_001485343.1|, reflYP_181606.1|, reflNP_976421.1|, and reflNP_842661.1| (SEQ ID NOS: 2604-2608), respectively, which all have the function assigned to SEQ ID NO: 2602 in Table 1. Amino acids conserved among all sequences are indicted by a "*" and generally conserved amino acids are indicated by a ":".

FIG. 15 depicts a sequence alignment between SEQ ID NO: 2927 (RAAC03263) and RTHT02135, RTHT02135, RBLH00099, RBSB05130, and RCTH01302 (SEQ ID NOS: 2929-2933), respectively, which all have the function assigned to SEQ ID NO: 2927 in Table 1. Amino acids conserved among all sequences are indicted by a "*" and generally conserved amino acids are indicated by a ":".

FIG. 16 depicts a sequence alignment (ClustalW) between SEQ ID NO: 817 (RAAC00856) and reflYP_001126560.1|, reflNP_242151.1|, reflYP_175113.1|, reflYP_148388.1|, and reflZP_01861605.11 (SEQ ID NOS: 819-823), respectively, which all have the function assigned to SEQ ID NO: 817 in Table 1. Amino acids conserved among all sequences are indicted by a "*" and generally conserved amino acids are indicated by a ":".

FIG. 17 depicts a sequence alignment (ClustalW) between SEQ ID NO: 1735 (RAAC01814) and reflYP_148388.11|, reflYP_001126560.1|, gblABY76244.11|, reflYP_896655.1|, and reflNP_980714.1| (SEQ ID NOS: 1737-

1741), respectively, which all have the function assigned to SEQ ID NO: 1735 in Table 1. Amino acids conserved among all sequences are indicted by a "*" and generally conserved amino acids are indicated by a ":".

FIG. 18 depicts a sequence alignment (ClustalW) between SEQ ID NO: 2381 (RAAC02673) and ref|YP_001486125.1|, ref|ZP_01696681.1|, ref|NP_388808.1|, ref|NP_830819.1|, and ref|YP_001643827.1| (SEQ ID NOS: 2383-2387), respectively, which all have the function assigned to SEQ ID NO: 2381 in Table 1. Amino acids conserved among all sequences are indicted by a "*" and generally conserved amino acids are indicated by a ":".

FIG. 19 depicts a sequence alignment (ClustalW) between SEQ ID NO: 1905 (RAAC02112) and ref|YP_148250.1|, ref|ZP_01725195.1|, ref|NP_390312.11|, ref|ZP_00538565.1|, and ref|YP_001126420.1| (SEQ ID NOS: 1907-1911), respectively, which all have the function assigned to SEQ ID NO: 1905 in Table 1. Amino acids conserved among all sequences are indicted by a "*" and generally conserved amino acids are indicated by a ":".

FIG. 20 depicts a sequence alignment (ClustalW) between SEQ ID NO: 2568 (RAAC02902) and ref|YP_147113.1|, ref|NP_243282.1|, ref|YP_001125233.1|, ref|YP_175727.1|, and ref|ZP_02330483.1| (SEQ ID NOS: 2570-2574), respectively, which all have the function assigned to SEQ ID NO: 2568 in Table 1. Amino acids conserved among all sequences are indicted by a "*" and generally conserved amino acids are indicated by a ":".

FIG. 21 depicts a sequence alignment (ClustalW) between SEQ ID NO: 494 (RAAC00415) and ref|ZP_01173598.1|, ref|YP_173640.1|, ref|YP_089786.11|, ref|YP_848410.1|, and ref|NP_691027.1| (SEQ ID NOS: 496-500), respectively, which all have the function assigned to SEQ ID NO: 494 in Table 1. Amino acids conserved among all sequences are indicted by a "*" and generally conserved amino acids are indicated by a ":".

FIGS. 22A and 22B depict a sequence alignment (ClustalW) between SEQ ID NO: 562 (RAAC00475) and ref|YP_149235.1|, ref|YP_001127411.1|, ref|YP_001377035.1|, gb|AAU09403.1|, and ref|YP_039325.1| (SEQ ID NOS: 564-568), respectively, which all have the function assigned to SEQ ID NO: 562 in Table 1. Amino acids conserved among all sequences are indicted by a "*" and generally conserved amino acids are indicated by a ":".

FIGS. 23A and 23B depict a sequence alignment (ClustalW) between SEQ ID NO: 2619 (RAAC02984) and ref|ZP_01173129.1|, ref|ZP_01696484.1|, ref|YP_001488275.1|, ref|ZP_02171541.1|, and ref|YP_173520.1| (SEQ ID NOS: 2621-2625), respectively, which all have the function assigned to SEQ ID NO: 2619 in Table 1. Amino acids conserved among all sequences are indicted by a "*" and generally conserved amino acids are indicated by a ":".

FIGS. 24A and 24B depict a sequence alignment (ClustalW) between SEQ ID NO: 2636 (RAAC02994) and ref|NP_244812.1|, ref|ZP_02171541.1|, ref|ZP_01173129.1|, ref|YP_090070.1|, and ref|YP_077660.1| (SEQ ID NOS: 2638-2642), respectively, which all have the function assigned to SEQ ID NO: 2636 in Table 1. Amino acids conserved among all sequences are indicted by a "*" and generally conserved amino acids are indicated by a ":".

FIG. 25 depicts a sequence alignment (ClustalW) between SEQ ID NO: 86 (RAAC00039) and ref|YP_177603.1|, ref|NP_244925.1|, ref|YP_001423363.1|, ref|ZP_02327875.1|, and ref|ZP_02172038.1| (SEQ ID NOS: 88-92), respectively, which all have the function assigned to SEQ ID NO: 86 in Table 1. Amino acids conserved among all sequences are indicted by a "*" and generally conserved amino acids are indicated by a ":".

FIG. 26 depicts a sequence alignment (ClustalW) between SEQ ID NO: 1871 (RAAC02034) and ref|YP_001422137.1|, ref|YP_080133.1|, ref|NP_243941.1|, ref|YP_176156.1|, and ref|YP_001376422.1| (SEQ ID NOS: 1873-1877), respectively, which all have the function assigned to SEQ ID NO: 1871 in Table 1. Amino acids conserved among all sequences are indicted by a "*" and generally conserved amino acids are indicated by a ":".

FIG. 27 depicts a sequence alignment (ClustalW) between SEQ ID NO: 188 (RAAC00092) and ref|ZP_01697682.1|, ref|YP_146960.1|, ref|NP_242122.1|, ref|YP_001125095.1|, and ref|ZP_01860230.1| (SEQ ID NOS: 190-194), respectively, which all have the function assigned to SEQ ID NO: 188 in Table 1. Amino acids conserved among all sequences are indicted by a "*" and generally conserved amino acids are indicated by a ":".

FIG. 28 depicts a sequence alignment (ClustalW) between SEQ ID NO: 2143 (RAAC02454) and ref|YP_001125095.1|, ref|YP_896293.1|, ref|YP_146960.1|, ref|NP_389392.1|, and ref|ZP_02261942.1| (SEQ ID NOS: 2145-2149), respectively, which all have the function assigned to SEQ ID NO: 2143 in Table 1. Amino acids conserved among all sequences are indicted by a "*" and generally conserved amino acids are indicated by a ":".

FIG. 29 depicts a sequence alignment (ClustalW) between SEQ ID NO: 341 (RAAC00212) and ref|YP_752777.1|, ref|YP_001666100.1|, ref|NP_621806.1|, ref|ZP_01666183.1|, and ref|YP_077079.1| (SEQ ID NOS: 343-347), respectively, which all have the function assigned to SEQ ID NO: 341 in Table 1. Amino acids conserved among all sequences are indicted by a "*" and generally conserved amino acids are indicated by a ":".

FIG. 30 depicts a sequence alignment (ClustalW) between SEQ ID NO: 2772 (RAAC03236) and ref|YP_001666100.1|, ref|YP_001317994.1|, ref|NP_621806.1|, ref|YP_001181188.1|, and ref|NP_346951.1| (SEQ ID NOS: 2774-2778), respectively, which all have the function assigned to SEQ ID NO: 2772 in Table 1. Amino acids conserved among all sequences are indicted by a "*" and generally conserved amino acids are indicated by a ":".

FIG. 31 depicts a sequence alignment (ClustalW) between SEQ ID NO: 2296 (RAAC02603) and ref|NP_346951.1|, ref|YP_001181188.1|, ref|YP_001666100.1|, ref|NP_621806.1|, and ref|YP_001317994.1| (SEQ ID NOS: 2298-2302), respectively, which all have the function assigned to SEQ ID NO: 2296 in Table 1. Amino acids conserved among all sequences are indicted by a "*" and generally conserved amino acids are indicated by a ":".

FIG. 32 depicts a sequence alignment (ClustalW) between SEQ ID NO: 324 (RAAC00161) and gb|AAC62407.1|, ref|YP_001374031.1|, ref|NP_830661.1|, ref|YP_037204.1|, and ref|NP_979446.1| (SEQ ID NOS: 326-330), respectively, which all have the function assigned to SEQ ID NO: 324 in Table 1. Amino acids conserved among all sequences are indicted by a "*" and generally conserved amino acids are indicated by a ":".

FIG. 33 depicts a sequence alignment (ClustalW) between SEQ ID NO: 919 (RAAC00923) and ref|YP_001422239.1|, ref|YP_001420593.1|, ref|ZP_01697004.1|, ref|ZP_01170670.1|, and ref|YP_001486165.1| (SEQ ID NOS: 921-925), respectively, which all have the function assigned to SEQ ID NO: 919 in Table 1. Amino acids conserved among all sequences are indicted by a "*" and generally conserved amino acids are indicated by a ":".

FIG. 34 depicts a sequence alignment (ClustalW) between SEQ ID NO: 749 (RAAC00643) and ref|ZP_02330525.1|, ref|NP_623103.1|, ref|ZP_02330045.1|, ref|YP_001665292.1|, and ref|YP_001665293.1| (SEQ ID NOS: 751-755), respectively, which all have the function assigned to SEQ ID NO: 749 in Table 1. Amino acids conserved among all sequences are indicted by a "*" and generally conserved amino acids are indicated by a ":".

FIG. 35 depicts a sequence alignment (ClustalW) between SEQ ID NO: 1361 (RAAC01427) and ref|NP_240926.1|, ref|ZP_02330558.1|, ref|YP_001419725.1|, ref|NP_829946.1|, and ref|NP_842611.1| (SEQ ID NOS: 1363-1367), respectively, which all have the function assigned to SEQ ID NO: 1361 in Table 1. Amino acids conserved among all sequences are indicted by a "*" and generally conserved amino acids are indicated by a ":".

FIG. 36 depicts a sequence alignment (ClustalW) between SEQ ID NO: 426 (RAAC00365) and ref|YP_173696.1|, ref|ZP_02329530.1|, ref|ZP_01696660.1|, ref|NP_241105.1|, and ref|YP_001124272.1| (SEQ ID NOS: 428-432), respectively, which all have the function assigned to SEQ ID NO: 426 in Table 1. Amino acids conserved among all sequences are indicted by a "*" and generally conserved amino acids are indicated by a ":".

FIGS. 37A and 37B depict a sequence alignment (ClustalW) between SEQ ID NO: 1531 (RAAC01563) and ref|ZP_01665476.1|, ref|ZP_02259717.1|, ref|YP_036745.1|, ref|YP_028716.1|, and ref|YP_083969.1| (SEQ ID NOS: 1533-1537), respectively, which all have the function assigned to SEQ ID NO: 1531 in Table 1. Amino acids conserved among all sequences are indicted by a "*" and generally conserved amino acids are indicated by a ":".

FIG. 38 depicts a sequence alignment (ClustalW) between SEQ ID NO: 2806 (RAAC02315) and ref|YP_145847.1|, gb|ABG00342.1|, ref|YP_536482.1|, ref|YP_891181.1|, and ref|YP_799230.1| (SEQ ID NOS: 2808-2812), respectively, which all have the function assigned to SEQ ID NO: 2806 in Table 1. Amino acids conserved among all sequences are indicted by a "*" and generally conserved amino acids are indicated by a ":".

FIG. 39 depicts a sequence alignment (ClustalW) between SEQ ID NO: 103 (RAAC00040) and ref|YP_001423364.1|, ref|NP_391977.1|, ref|YP_001488932.1|, ref|YP_093870.1|, and ref|YP_081433.1| (SEQ ID NOS: 105-109), respectively, which all have the function assigned to SEQ ID NO: 103 in Table 1. Amino acids conserved among all sequences are indicted by a "*" and generally conserved amino acids are indicated by a ":".

FIG. 40 depicts a sequence alignment (ClustalW) between SEQ ID NO: 205 (RAAC00113) and ref|ZP_01697918.1|, ref|YP_001125108.1|, emb|CAJ75583.1|, ref|YP_146973.1|, and ref|ZP_01172488.1| (SEQ ID NOS: 207-211), respectively, which all have the function assigned to SEQ ID NO: 205 in Table 1. Amino acids conserved among all sequences are indicted by a "*" and generally conserved amino acids are indicated by a ":".

FIGS. 41A and 41B depict a sequence alignment (ClustalW) between SEQ ID NO: 222 (RAAC00117) and ref|ZP_02330014.1|, emb|CAJ75587.1|, ref|YP_146977.1|, ref|YP_001125112.1|, and ref|NP_243425.1| (SEQ ID NOS: 224-228), respectively, which all have the function assigned to SEQ ID NO: 222 in Table 1. Amino acids conserved among all sequences are indicted by a "*" and generally conserved amino acids are indicated by a ":".

FIG. 42 depicts a sequence alignment (ClustalW) between SEQ ID NO: 239 (RAAC00118) and ref|YP_078922.1|, ref|YP_001375784.1|, ref|ZP_02171874.1|, ref|YP_001646530.1|, and gb|AAN04557.1| (SEQ ID NOS: 241-245), respectively, which all have the function assigned to SEQ ID NO: 239 in Table 1. Amino acids conserved among all sequences are indicted by a "*" and generally conserved amino acids are indicated by a ":".

FIG. 43 depicts a sequence alignment (ClustalW) between SEQ ID NO: 1344 (RAAC01377) and ref|YP_147952.1|, ref|YP_520670.1|, ref|YP_001395809.1|, ref|YP_001309701.1|, and ref|YP_001643660.1| (SEQ ID NOS: 1346-1350), respectively, which all have the function assigned to SEQ ID NO: 1344 in Table 1. Amino acids conserved among all sequences are indicted by a "*" and generally conserved amino acids are indicated by a ":".

FIGS. 44A and 44B depict a sequence alignment (ClustalW) between SEQ ID NO: 2840 (RAAC02381) and ref|NP_622177.1|, ref|YP_848858.1|, ref|YP_001374688.1|, ref|NP_470039.1|, and ref|ZP_01929325.1| (SEQ ID NOS: 2842-2846), respectively, which all have the function assigned to SEQ ID NO: 2840 in Table 1. Amino acids conserved among all sequences are indicted by a "*" and generally conserved amino acids are indicated by a ":".

FIG. 45 depicts a sequence alignment (ClustalW) between SEQ ID NO: 1038 (RAAC00991) and ref|ZP_02327412.1|, ref|YP_001487207.1|, ref|ZP_01172765.1|, ref|NP_831314.1|, and ref|NP_844008.1| (SEQ ID NOS: 1040-1044), respectively, which all have the function assigned to SEQ ID NO: 1038 in Table 1. Amino acids conserved among all sequences are indicted by a "*" and generally conserved amino acids are indicated by a ":".

FIG. 46 depicts a sequence alignment (ClustalW) between SEQ ID NO: 766 (RAAC00650) and ref|YP_001127183.1|, ref|ZP_02038504.1|, ref|YP_001647987.1|, ref|YP_001377114.1|, and ref|NP_835081.1| (SEQ ID NOS: 768-772), respectively, which all have the function assigned to SEQ ID NO: 766 in Table 1. Amino acids conserved among all sequences are indicted by a "*" and generally conserved amino acids are indicated by a ":".

FIG. 47 depicts a sequence alignment (ClustalW) between SEQ ID NO: 2041 (RAAC02421) and ref|ZP_01721811.1|, ref|NP_241897.1|, ref|YP_001486101.1|, ref|ZP_01170532.1|, and ref|ZP_02327994.1| (SEQ ID NOS: 2043-2047), respectively, which all have the function assigned to SEQ ID NO: 2041 in Table 1. Amino acids conserved among all sequences are indicted by a "*" and generally conserved amino acids are indicated by a ":".

FIGS. 48A and 48B depict a sequence alignment (ClustalW) between SEQ ID NO: 1922 (RAAC02142) and ref|ZP_01860158.1|, ref|YP_148164.1|, ref|NP_242401.1|, ref|YP_001126336.1|, and ref|YP_001421751.1| (SEQ ID NOS: 1924-1928), respectively, which all have the function assigned to SEQ ID NO: 1922 in Table 1. Amino acids conserved among all sequences are indicted by a "*" and generally conserved amino acids are indicated by a ":".

FIGS. 49A and 49B depict a sequence alignment (ClustalW) between SEQ ID NO: 2687 (RAAC03015) and ref|NP_628606.1|, ref|ZP_02061285.1|, ref|NP_824958.1|, emb|CAA04971.1|, and gb|AAC32488.1| (SEQ ID NOS: 2689-2693), respectively, which all have the function assigned to SEQ ID NO: 2687 in Table 1. Amino acids conserved among all sequences are indicted by a "*" and generally conserved amino acids are indicated by a ":".

FIGS. 50A and 50B depict a sequence alignment (ClustalW) between SEQ ID NO: 2517 (RAAC2227) and ref|YP_430213.1|, ref|YP_001212426.1|, ref|YP_001663198.1|, ref|YP_360920.1|, and ref|YP_001665129.1| (SEQ ID NOS: 2519-2523), respectively, which all have the function assigned to SEQ ID NO: 2517 in Table 1. Amino acids con- FIG. 51 depicts a sequence alignment (ClustalW) between SEQ ID NO: 834 (RAAC00872) and ref|NP_622598.1|, ref|YP_001320854.1|, ref|YP_001665389.1|, ref|YP_001037463.1|, and ref|YP_001512768.1| (SEQ ID NOS: 836-840), respectively, which all have the function assigned to SEQ ID NO: 834 in Table 1. Amino acids conserved among all sequences are indicted by a "*" and generally conserved amino acids are indicated by a ":".

FIG. 52 depicts a sequence alignment (ClustalW) between SEQ ID NO: 120 (RAAC00045) and ref|ZP_02172045.1|, ref|ZP_01189194.1|, ref|NP_244931.1|, ref|YP_001213468.1|, and ref|YP_358877.1| (SEQ ID NOS: 122-126), respectively, which all have the function assigned to SEQ ID NO: 120 in Table 1. Amino acids conserved among all sequences are indicted by a "*" and generally conserved amino acids are indicated by a ":".

FIGS. 53A and 53B depict a sequence alignment (ClustalW) between SEQ ID NO: 2092 (RAAC02428) and dbj|BAB83769.1|, ref|YP_146913.1|, sp|P11961|ODP2_BACST, ref|ZP_01696305.1|, and ref|YP_001125047.1| (SEQ ID NOS: 2094-2098), respectively, which all have the function assigned to SEQ ID NO: 2092 in Table 1. Amino acids conserved among all sequences are indicted by a "*" and generally conserved amino acids are indicated by a ":".

FIGS. 54A and 54B depict a sequence alignment (ClustalW) between SEQ ID NO: 1650 (RAAC01659) and ref|ZP_02326222.1|, ref|NP_241081.1|, ref|YP_074242.1|, ref|YP_001153408.1|, and ref|NP_560158.1| (SEQ ID NOS: 1652-1656), respectively, which all have the function assigned to SEQ ID NO: 1650 in Table 1. Amino acids conserved among all sequences are indicted by a "*" and generally conserved amino acids are indicated by a ":".

FIG. 55 depicts a sequence alignment (ClustalW) between SEQ ID NO: 1701 (RAAC01745) and ref|YP_001127228.1|, ref|YP_149070.1|, ref|ZP_00539127.1|, ref|ZP_02326224.1|, and ref|NP_241079.1| (SEQ ID NOS: 1703-1707), respectively, which all have the function assigned to SEQ ID NO: 1701 in Table 1. Amino acids conserved among all sequences are indicted by a "*" and generally conserved amino acids are indicated by a ":".

FIG. 56 depicts a sequence alignment (ClustalW) between SEQ ID NO: 1718 (RAAC01746) and ref|YP_149069.1|, ref|YP_001127227.1|, ref|ZP_00539126.1|, ref|YP_001125046.1|, and ref|NP_833691.1| (SEQ ID NOS: 1720-1724), respectively, which all have the function assigned to SEQ ID NO: 1718 in Table 1. Amino acids conserved among all sequences are indicted by a "*" and generally conserved amino acids are indicated by a ":".

FIG. 57 depicts a sequence alignment (ClustalW) between SEQ ID NO: 2058 (RAAC02426) and ref|NP_243521.1|, pdb|1W85|A, sp|P21873|ODPA_BACST, ref|YP_001421036.1|, and ref|YP_146911.1| (SEQ ID NOS: 2060-2064), respectively, which all have the function assigned to SEQ ID NO: 2058 in Table 1. Amino acids conserved among all sequences are indicted by a "*" and generally conserved amino acids are indicated by a ":".

FIG. 58 depicts a sequence alignment (ClustalW) between SEQ ID NO: 2075 (RAAC02427) and ref|ZP_01696304.1|, sp|P21874|ODPB_BACST, ref|YP_001125046.1|, pdb|1W85|B, and ref|YP_146912.1| (SEQ ID NOS: 2077-2081), respectively, which all have the function assigned to SEQ ID NO: 2075 in Table 1. Amino acids conserved among all sequences are indicted by a "*" and generally conserved amino acids are indicated by a ":".

FIG. 59 depicts a sequence alignment (ClustalW) between SEQ ID NO: 1616 (RAAC01657) and ref|ZP_02326224.1|, dbj|BAB40585.1|, ref|NP_241079.1|, ref|YP_001126012.1|, and ref|ZP_01171269.1| (SEQ ID NOS: 1618-1622), respectively, which all have the function assigned to SEQ ID NO: 1616 in Table 1. Amino acids conserved among all sequences are indicted by a "*" and generally conserved amino acids are indicated by a ":".

FIG. 60 depicts a sequence alignment (ClustalW) between SEQ ID NO: 1633 (RAAC01658) and ref|ZP_02326223.1|, ref|NP_241080.1|, dbj|BAB40586.1|, ref|YP_001126011.1|, and ref|NP_693798.1| (SEQ ID NOS: 1635-1639), respectively, which all have the function assigned to SEQ ID NO: 1633 in Table 1. Amino acids conserved among all sequences are indicted by a "*" and generally conserved amino acids are indicated by a ":".

FIGS. 61A and 61B depict a sequence alignment (ClustalW) between SEQ ID NO: 630 (RAAC00484) and ref|YP_001125466.1|, ref|ZP_01697095.1|, ref|YP_147353.1|, ref|ZP_01886631.1|, and ref|YP_077737.1| (SEQ ID NOS: 632-636), respectively, which all have the function assigned to SEQ ID NO: 630 Table 1. Amino acids conserved among all sequences are indicted by a "*" and generally conserved amino acids are indicated by a ":".

FIG. 62 depicts a sequence alignment (ClustalW) between SEQ ID NO: 613 (RAAC00483) and ref|NP_886151.1|, ref|YP_147354.1|, ref|YP_001125467.1|, ref|YP_001420062.1|, and ref|NP_242684.1| (SEQ ID NOS: 615-619), respectively, which all have the function assigned to SEQ ID NO: 613 in Table 1. Amino acids conserved among all sequences are indicted by a "*" and generally conserved amino acids are indicated by a ":".

FIG. 63 depicts a sequence alignment (ClustalW) between SEQ ID NO: 290 (RAAC00134) and ref|ZP_01860800.1|, ref|YP_147000.1|, ref|ZP_01695960.1|, ref|YP_001125127.1|, and ref|YP_806677.1| (SEQ ID NOS: 292-296), respectively, which all have the function assigned to SEQ ID NO: 290 in Table 1. Amino acids conserved among all sequences are indicted by a "*" and generally conserved amino acids are indicated by a ":".

FIG. 64 depicts a sequence alignment (ClustalW) between SEQ ID NO: 358 (RAAC00215) and ref|YP_145879.1|, ref|ZP_01697513.1|, ref|YP_001124157.1|, ref|ZP_01174007.1|, and ref|YP_001642924.1| (SEQ ID NOS: 360-364), respectively, which all have the function assigned to SEQ ID NO: 358 in Table 1. Amino acids conserved among all sequences are indicted by a "*" and generally conserved amino acids are indicated by a ":".

FIG. 65 depicts a sequence alignment (ClustalW) between SEQ ID NO: 2177 (RAAC02164) and ref|YP_359129.1|, ref|ZP_02127016.1|, ref|YP_001540277.1|, pdb|1M2N|A, and pdb|1M2K|A (SEQ ID NOS: 2179-2183), respectively, which all have the function assigned to SEQ ID NO: 2177 in Table 1. Amino acids conserved among all sequences are indicted by a "*" and generally conserved amino acids are indicated by a ":".

FIGS. 66A-66C depict a sequence alignment (ClustalW) between SEQ ID NO: 1395 (RAAC01438) and ref|YP_173587.1|, ref|NP_240935.1|, ref|YP_001373418.1|, ref|YP_892975.1|, and ref|NP_976379.1| (SEQ ID NOS: 1397-1401), respectively, which all have the function assigned to SEQ ID NO: 1395 in Table 1. Amino acids conserved among all sequences are indicted by a "*" and generally conserved amino acids are indicated by a ":".

FIG. 67 depicts a sequence alignment (ClustalW) between SEQ ID NO: 2755 (RAAC03184) and ref|YP_001105447.1|, ref|YP_117520.1|, ref|YP_046943.1|, ref|YP_707186.1|, and ref|YP_001337847.1| (SEQ ID NOS: 2757-2761), respectively, which all have the function assigned to SEQ ID NO: 2755 in Table 1. Amino acids conserved among all sequences are indicted by a "*" and generally conserved amino acids are indicated by a ":".

FIG. 68 depicts a sequence alignment between SEQ ID NO: 2859 (RAAC02740) and ref|NP_391246.1|, ref|YP_001488252.1|, ref|NP_244416.1|, ref|YP_001112264.1|, and ref|YP_430670.1| (SEQ ID NOS: 2861-2865), respectively, which all have the function assigned to SEQ ID NO: 2856 in Table 1. Amino acids conserved among all sequences are indicted by a "*" and generally conserved amino acids are indicated by a ":".

FIG. 69 depicts a sequence alignment between SEQ ID NO: 2893 (RAAC02937) and ref|YP_075413.1|, ref|YP_001662816.1|, ref|YP_001664674.1|, ref|YP_827514.1|, and ref|YP_827514.1| (SEQ ID NOS: 2895-2899), respectively, which all have the function assigned to SEQ ID NO: 2893 in Table 1. Amino acids conserved among all sequences are indicted by a "*" and generally conserved amino acids are indicated by a ":".

FIG. 70 depicts a sequence alignment (ClustalW) between SEQ ID NO: 783 (RAAC00675) and ref|YP_001373772.1|, ref|YP_034761.1|, ref|YP_893335.1|, ref|ZP_00237972.1|, and ref|ZP_02329595.1| (SEQ ID NOS: 785-789), respectively, which all have the function assigned to SEQ ID NO: 783 in Table 1. Amino acids conserved among all sequences are indicted by a "*" and generally conserved amino acids are indicated by a ":".

FIG. 71 depicts a sequence alignment (ClustalW) between SEQ ID NO: 2789 (RAAC02292) and gb|AAB91591.1|, ref|YP_001422657.1|, ref|NP_391247.1|, ref|YP_093160.1|, and ref|NP_391246.1| (SEQ ID NOS: 2791-2795), respectively, which all have the function assigned to SEQ ID NO: 2789 in Table 1. Amino acids conserved among all sequences are indicted by a and generally conserved amino acids are indicated by a ":".

FIG. 72 depicts a sequence alignment (ClustalW) between SEQ ID NO: 1599 (RAAC01655) and ref|ZP_00235680.1|, ref|NP_241278.1|, ref|NP_845841.1|, ref|ZP_02260616.1|, and ref|ZP_02256143.1| (SEQ ID NOS: 1601-1605), respectively, which all have the function assigned to SEQ ID NO: 1599 Table 1. Amino acids conserved among all sequences are indicted by a "*" and generally conserved amino acids are indicated by a ":".

FIG. 73 depicts a sequence alignment (ClustalW) between SEQ ID NO: 545 (RAAC00436) and ref|ZP_02171828.1|, ref|YP_077369.1|, ref|YP_001485328.1|, ref|ZP_02329455.1|, and ref|YP_001419762.1| (SEQ ID NOS: 547-551), respectively, which all have the function assigned to SEQ ID NO: 545 in Table 1. Amino acids conserved among all sequences are indicted by a "*" and generally conserved amino acids are indicated by a ":".

FIG. 74 depicts a sequence alignment (ClustalW) between SEQ ID NO: 1429 (RAAC01464) and ref|YP_001485324.1|, ref|YP_001124204.1|, ref|YP_145925.1|, ref|YP_077366.1|, and ref|NP_829977.1| (SEQ ID NOS: 1431-1435), respectively, which all have the function assigned to SEQ ID NO: 1429 in Table 1. Amino acids conserved among all sequences are indicted by a "*" and generally conserved amino acids are indicated by a ":".

FIG. 75 depicts a sequence alignment (ClustalW) between SEQ ID NO: 698 (RAAC00579) and ref|ZP_01440002.1|, ref|NP_896891.1|, ref|YP_001623237.1|, ref|ZP_01419169.11|, and ref|ZP_01084741.1| (SEQ ID NOS: 700-704), respectively, which all have the function assigned to SEQ ID NO: 698 in Table 1. Amino acids conserved among all sequences are indicted by a "*" and generally conserved amino acids are indicated by a ":".

FIG. 76 depicts a sequence alignment (ClustalW) between SEQ ID NO: 2721 (RAAC03156) and ref|YP_954024.1|, ref|YP_001360254.1|, ref|YP_001156989.1|, ref|ZP_00050136.2|, and ref|YP_591607.1| (SEQ ID NOS: 2723-2727), respectively, which all have the function assigned to SEQ ID NO: 2721 in Table 1. Amino acids conserved among all sequences are indicted by a "*" and generally conserved amino acids are indicated by a ":".

FIG. 77 depicts a sequence alignment (ClustalW) between SEQ ID NO: 715 (RAAC00603) and ref|YP_001309477.1|, ref|YP_001180339.1|, ref|NP_242735.1|, ref|YP_173905.1|, and ref|ZP_00603386.1| (SEQ ID NOS: 717-721), respectively, which all have the function assigned to SEQ ID NO: 715 in Table 1. Amino acids conserved among all sequences are indicted by a "*" and generally conserved amino acids are indicated by a ":".

FIG. 78 depicts a sequence alignment (ClustalW) between SEQ ID NO: 2738 (RAAC03180) and ref|YP_001664041.1|, ref|YP_001210714.1|, ref|NP_242309.1|, ref|ZP_02038515.1|, and ref|YP_085042.1| (SEQ ID NOS: 2740-2744), respectively, which all have the function assigned to SEQ ID NO: 2738 in Table 1. Amino acids conserved among all sequences are indicted by a "*" and generally conserved amino acids are indicated by a ":".

FIG. 79 depicts a sequence alignment (ClustalW) between SEQ ID NO: 2024 (RAAC02417) and ref|NP_469419.1|, ref|ZP_02309926.1|, ref|ZP_01926077.1|, ref|ZP_01941236.1|, and ref|YP_001111866.1| (SEQ ID NOS: 2026-2030), respectively, which all have the function assigned to SEQ ID NO: 2024 in Table 1. Amino acids conserved among all sequences are indicted by a "*" and generally conserved amino acids are indicated by a ":".

FIG. 80 depicts a sequence alignment (ClustalW) between SEQ ID NO: 1786 (RAAC01912) and ref|YP_001103030.1|, ref|YP_001363698.1|, ref|NP_625321.1|, ref|NP_822608.1|, and ref|ZP_00996757.1| (SEQ ID NOS: 1788-1792), respectively, which all have the function assigned to SEQ ID NO: 1786 in Table 1. Amino acids conserved among all sequences are indicted by a "*" and generally conserved amino acids are indicated by a ":".

FIG. 81 depicts a sequence alignment (ClustalW) between SEQ ID NO: 2330 (RAAC02663) and ref|YP_527240.1|, ref|NP_435364.1|, ref|YP_001313948.1|, ref|YP_001169444.1|, and ref|ZP_01509063.1| (SEQ ID NOS: 2332-2336), respectively, which all have the function assigned to SEQ ID NO: 2330 in Table 1. Amino acids conserved among all sequences are indicted by a "*" and generally conserved amino acids are indicated by a ":".

FIG. 82 depicts a sequence alignment (ClustalW) between SEQ ID NO: 1191 (RAAC01158) and ref|YP_077724.1|, ref|YP_643029.1|, ref|YP_174340.1|, ref|YP_001308645.1|, and ref|YP_516602.1| (SEQ ID NOS: 1193-1197), respectively, which all have the function assigned to SEQ ID NO: 1191 in Table 1. Amino acids conserved among all sequences are indicted by a "*" and generally conserved amino acids are indicated by a ":".

FIG. 83 depicts a sequence alignment (ClustalW) between SEQ ID NO: 137 (RAAC00068) and ref|ZP_02328287.1|, ref|YP_001420528.1|, ref|YP_430032.1|, ref|ZP_02082978.1|, and ref|ZP_01962813.1| (SEQ ID NOS: 139-143), respectively, which all have the function assigned to SEQ ID NO: 137 in Table 1. Amino acids conserved among all sequences are indicted by a "*" and generally conserved amino acids are indicated by a ":".

FIG. 84 depicts a sequence alignment (ClustalW) between SEQ ID NO: 1055 (RAAC01035) and ref|YP_642998.1|, ref|NP_822795.1|, emb|CAJ88752.1|, ref|YP_001191149.1|, and ref|YP_752794.1| (SEQ ID NOS: 1057-1061), respectively, which all have the function assigned to SEQ ID NO: 1055 in Table 1. Amino acids conserved among all sequences are indicted by a "*" and generally conserved amino acids are indicated by a ":".

FIG. 85 depicts a sequence alignment (ClustalW) between SEQ ID NO: 1854 (RAAC02031) and ref|YP_148128.1|, ref|YP_001126297.1|, ref|YP_900875.1|, ref|ZP_01662088.1|, and ref|ZP_01697892.1| (SEQ ID NOS: 1856-1860), respectively, which all have the function assigned to SEQ ID NO: 1854 in Table 1. Amino acids conserved among all sequences are indicted by a "*" and generally conserved amino acids are indicated by a ":".

FIG. 86 depicts a sequence alignment (ClustalW) between SEQ ID NO: 2653 (RAAC03005) and ref|YP_001127075.1|, ref|YP_148880.1|, ref|YP_832996.1|, ref|YP_949591.1|, and ref|YP_950253.1| (SEQ ID NOS: 2655-2659), respectively, which all have the function assigned to SEQ ID NO: 2653 in Table 1. Amino acids conserved among all sequences are indicted by a "*" and generally conserved amino acids are indicated by a ":".

FIG. 87 depicts a sequence alignment (ClustalW) between SEQ ID NO: 2160 (RAAC02459) and ref|YP_073926.1|, emb|CAB08003.1|, ref|YP_431134.1|, ref|YP_001422711.1|, and ref|YP_080763.1| (SEQ ID NOS: 2162-2166), respectively, which all have the function assigned to SEQ ID NO: 2160 in Table 1. Amino acids conserved among all sequences are indicted by a "*" and generally conserved amino acids are indicated by a ":".

FIG. 88 depicts a sequence alignment (ClustalW) between SEQ ID NO: 1293 (RAAC01353) and RAAC01353_nuc, ref|YP_147389.1|, ref|NP_243003.1|, ref|YP_001125502.1|, and ref|YP_001665938.1| (SEQ ID NOS: 1294-1298), respectively, which all have the function assigned to SEQ ID NO: 2160 in Table 1. Amino acids conserved among all sequences are indicted by a "*" and generally conserved amino acids are indicated by a ":".

FIG. 89 depicts a sequence alignment (ClustalW) between SEQ ID NO: 2109 (RAAC02432) and ref|ZP_02329176.1|, ref|YP_076367.1|, ref|NP_694155.1|, ref|YP_001126042.1|, and ref|YP_643152.1| (SEQ ID NOS: 2111-2115), respectively, which all have the function assigned to SEQ ID NO: 2109 in Table 1. Amino acids conserved among all sequences are indicted by a "*" and generally conserved amino acids are indicated by a ":".

FIG. 90 depicts a sequence alignment (ClustalW) between SEQ ID NO: 681 (RAAC00570) and emb|CAB65654.1|, ref|YP_001662226.1|, ref|YP_001664166.1|, ref|NP_624096.1|, and ref|ZP_02171282.1| (SEQ ID NOS: 683-687), respectively, which all have the function assigned to SEQ ID NO: 681 in Table 1. Amino acids conserved among all sequences are indicted by a "*" and generally conserved amino acids are indicated by a ":".

FIG. 91 depicts a sequence alignment (ClustalW) between SEQ ID NO: 375 (RAAC00269) and ref|ZP_01188890.1|, ref|ZP_01188246.1|, ref|ZP_01188241.1|, ref|NP_242794.1|, and ref|NP_244559.1| (SEQ ID NOS: 377-381), respectively, which all have the function assigned to SEQ ID NO: 375 in Table 1. Amino acids conserved among all sequences are indicted by a "*" and generally conserved amino acids are indicated by a ":".

FIG. 92 depicts a sequence alignment (ClustalW) between SEQ ID NO: 1837 (RAAC02012) and ref|YP_430255.1|, ref|YP_518526.1|, ref|ZP_01369294.1|, ref|YP_361384.1|, and ref|YP_001213325.1| (SEQ ID NOS: 1839-1843), respectively, which all have the function assigned to SEQ ID NO: 1837 in Table 1. Amino acids conserved among all sequences are indicted by a "*" and generally conserved amino acids are indicated by a ":".

FIG. 93 depicts a sequence alignment (ClustalW) between SEQ ID NO: 1667 (RAAC01701) and ref|NP_691275.1|, ref|NP_354021.1|, ref|YP_174284.1|, ref|ZP_01074644.1|, and ref|NP_772010.1| (SEQ ID NOS: 1669-1673), respectively, which all have the function assigned to SEQ ID NO: 1667 in Table 1. Amino acids conserved among all sequences are indicted by a "*" and generally conserved amino acids are indicated by a ":".

FIG. 94 depicts a sequence alignment (ClustalW) between SEQ ID NO: 936 (RAAC00927) and ref|ZP_02330514.1|, ref|NP_347485.1|, ref|YP_001253394.1|, ref|YP_001308605.1|, and ref|YP_001376921.1| (SEQ ID NOS: 938-942), respectively, which all have the function assigned to SEQ ID NO: 936 in Table 1. Amino acids conserved among all sequences are indicted by a "*" and generally conserved amino acids are indicated by a ":".

FIG. 95 depicts a sequence alignment (ClustalW) between SEQ ID NO: 953 (RAAC00935) and ref|YP_001422559.1|, ref|NP_391166.1|, gb|AAB87745.1|, pdb|1S3J|A, and ref|YP_001643469.1| (SEQ ID NOS: 955-959), respectively, which all have the function assigned to SEQ ID NO: 953 in Table 1. Amino acids conserved among all sequences are indicted by a "*" and generally conserved amino acids are indicated by a ":".

FIG. 96 depicts a sequence alignment (ClustalW) between SEQ ID NO: 1888 (RAAC02041) and ref|NP_693030.1|, ref|YP_001320949.1|, ref|YP_001512727.1|, ref|YP_001126687.1|, and ref|YP_148522.1| (SEQ ID NOS: 1890-1894), respectively, which all have the function assigned to SEQ ID NO: 1888 in Table 1. Amino acids conserved among all sequences are indicted by a "*" and generally conserved amino acids are indicated by a ":".

FIG. 97 depicts a sequence alignment (ClustalW) between SEQ ID NO: 2670 (RAAC02241) and ref|NP_629113.1|, ref|NP_824479.1|, ref|YP_001508494.1|, ref|ZP_01169478.1|, and ref|NP_631123.1| (SEQ ID NOS: 2672-2676), respectively, which all have the function assigned to SEQ ID NO: 2670 in Table 1. Amino acids conserved among all sequences are indicted by a "*" and generally conserved amino acids are indicated by a ":".

FIG. 98 depicts a sequence alignment (ClustalW) between SEQ ID NO: 2347 (RAAC02671) and ref|NP_388620.1|, ref|YP_001420380.1|, ref|YP_090401.1|, ref|YP_077997.1|, and ref|YP_714968.1| (SEQ ID NOS: 2349-2353), respectively, which all have the function assigned to SEQ ID NO: 2347 in Table 1. Amino acids conserved among all sequences are indicted by a "*" and generally conserved amino acids are indicated by a ":".

FIG. 99 depicts a sequence alignment (ClustalW) between SEQ ID NO: 664 (RAAC00549) and ref|YP_427081.1|, ref|YP_001141973.1|, ref|YP_927240.1|, ref|YP_001141729.1|, and ref|YP_856665.1| (SEQ ID NOS: 666-670), respectively, which all have the function assigned to SEQ ID NO: 664 in Table 1. Amino acids conserved among all sequences are indicted by a "*" and generally conserved amino acids are indicated by a ":".

FIG. 100 depicts a sequence alignment (ClustalW) between SEQ ID NO: 1123 (RAAC01080) and dbj|BAA00729.1|, ref|NP_389627.1|, ref|ZP_02328256.1|, ref|NP_833433.1|, and ref|YP_001375615.1| (SEQ ID NOS: 1125-1129), respectively, which all have the function assigned to SEQ ID NO: 1123 in Table 1. Amino acids conserved among all sequences are indicted by a "*" and generally conserved amino acids are indicated by a ":".

FIG. 101 depicts a sequence alignment (ClustalW) between SEQ ID NO: 1140 (RAAC01126) and ref|YP_146517.1|, ref|ZP_00739458.1|, ref|YP_001124699.1|, ref|YP_893832.1|, and ref|NP_830863.1| (SEQ ID NOS: 1142-1146), respectively, which all have the function assigned to SEQ ID NO: 664 in Table 1. Amino acids conserved among all sequences are indicted by a "*" and generally conserved amino acids are indicated by a ":".

FIG. 102 depicts a sequence alignment (ClustalW) between SEQ ID NO: 1174 (RAAC01138) and ref|NP_832103.1|, ref|YP_894956.1|, ref|P_02215257.1|, ref|NP_978750.1|, and ref|NP_844783.1| (SEQ ID NOS: 1176-1180), respectively, which all have the function assigned to SEQ ID NO: 1174 in Table 1. Amino acids conserved among all sequences are indicted by a "*" and generally conserved amino acids are indicated by a ":".

FIG. 103 depicts a sequence alignment (ClustalW) between SEQ ID NO: 409 (RAAC00354) and ref|YP_001309939.1|, ref|YP_001643723.1|, ref|YP_079403.1|, ref|YP_001647188.1|, and ref|NP_980994.1| (SEQ ID NOS: 411-415), respectively, which all have the function assigned to SEQ ID NO: 409 in Table 1. Amino acids conserved among all sequences are indicted by a "*" and generally conserved amino acids are indicated by a ":".

FIG. 104 depicts a sequence alignment (ClustalW) between SEQ ID NO: 2415 (RAAC02712) and ref|YP_036650.1|, ref|NP_978853.1|, ref|ZP_01173627.1|", ref|NP_844911.1|, and ref|ZP_02256518.1| (SEQ ID NOS: 2417-2421), respectively, which all have the function assigned to SEQ ID NO: 2415 in Table 1. Amino acids conserved among all sequences are indicted by a "*" and generally conserved amino acids are indicated by a ":".

FIG. 105 depicts a sequence alignment (ClustalW) between SEQ ID NO: 1072 (RAAC01059) and ref|ZP_02327699.1|, ref|YP_001126706.1|, ref|YP_148542.1|, ref|NP_243968.1|, and ref|YP_360433.1| (SEQ ID NOS: 1074-1078), respectively, which all have the function assigned to SEQ ID NO: 1072 in Table 1. Amino acids conserved among all sequences are indicted by a "*" and generally conserved amino acids are indicated by a ":".

FIG. 106 depicts a sequence alignment (ClustalW) between SEQ ID NO: 1565 (RAAC01638) and ref|YP_076316.1|, ref|YP_603589.1|, ref|NP_296097.1|, ref|YP_004584.1|, and ref|YP_144239.1| (SEQ ID NOS: 1567-1571), respectively, which all have the function assigned to SEQ ID NO: 1565 in Table 1. Amino acids conserved among all sequences are indicted by a "*" and generally conserved amino acids are indicated by a ":".

FIG. 107 depicts a sequence alignment (ClustalW) between SEQ ID NO: 1973 (RAAC02161) and ref|YP_148132.1|, ref|YP_001126301.1|, ref|ZP_02330236.1|, ref|NP_242446.1|, and ref|YP_175331.1| (SEQ ID NOS: 1975-1979), respectively, which all have the function assigned to SEQ ID NO: 1973 in Table 1. Amino acids conserved among all sequences are indicted by a "*" and generally conserved amino acids are indicated by a ":".

FIG. 108 depicts a sequence alignment (ClustalW) between SEQ ID NO: 392 (RAAC00349) and ref|YP_430046.1|, ref|YP_358986.1|, ref|YP_001213400.1|, ref|ZP_02330078.1|, and ref|YP_001114520.1| (SEQ ID NOS: 394-398), respectively, which all have the function assigned to SEQ ID NO: 392 in Table 1. Amino acids conserved among all sequences are indicted by a "*" and generally conserved amino acids are indicated by a ":".

FIG. 109 depicts a sequence alignment (ClustalW) between SEQ ID NO: 1327 (RAAC01375) and ref|YP_079987.1|, ref|YP_001634921.1|, ref|YP_290510.1|, ref|YP_001423330.1|, and ref|YP_001422015.1| (SEQ ID NOS: 1329-1333), respectively, which all have the function assigned to SEQ ID NO: 1327 in Table 1. Amino acids conserved among all sequences are indicted by a "*" and generally conserved amino acids are indicated by a ":".

FIG. 110 depicts a sequence alignment (ClustalW) between SEQ ID NO: 18 (RAAC00013) and ref|YP_146744.1|, ref|YP_001647744.1|, ref|NP_981573.1|, ref|ZP_02255842.1|, and ref|YP_897365.1| (SEQ ID NOS: 20-24), respectively, which all have the function assigned to SEQ ID NO: 18 in Table 1. Amino acids conserved among all sequences are indicted by a "*" and generally conserved amino acids are indicated by a ":".

FIG. 111 depicts a sequence alignment (ClustalW) between SEQ ID NO: 1480 (RAAC01493) and ref|YP_075596.1|, ref|YP_430668.1|, ref|YP_590553.1|, ref|YP_478499.1|, and ref|YP_001668480.1| (SEQ ID NOS: 1482-1486), respectively, which all have the function assigned to SEQ ID NO: 1480 in Table 1. Amino acids conserved among all sequences are indicted by a "*" and generally conserved amino acids are indicated by a ":".

FIG. 112 depicts a sequence alignment (ClustalW) between SEQ ID NO: 1582 (RAAC01653) and ref|ZP_00743391.1|, ref|YP_001375561.1|, ref|YP_896056.1|, ref|NP_845992.1|, and ref|ZP_02254866.1| (SEQ ID NOS: 1584-1588), respectively, which all have the function assigned to SEQ ID NO: 1582 in Table 1. Amino acids conserved among all sequences are indicted by a "*" and generally conserved amino acids are indicated by a ":".

FIG. 113 depicts a sequence alignment (ClustalW) between SEQ ID NO: 528 (RAAC00430) and ref|YP_001210836.1|, ref|YP_001111557.1|, ref|YP_001485333.1|, ref|NP_240971.1|, and ref|NP_387969.1| (SEQ ID NOS: 530-534), respectively, which all have the function assigned to SEQ ID NO: 528 in Table 1. Amino acids conserved among all sequences are indicted by a "*" and generally conserved amino acids are indicated by a ":".

FIG. 114 depicts a sequence alignment (ClustalW) between SEQ ID NO: 2823 (RAAC02359) and ref|NP_832076.1|, ref|YP_001645033.1|, ref|NP_844759.1|, ref|YP_001375058.1|, and ref|YP_535778.1| (SEQ ID NOS: 2825-2829), respectively, which all have the function assigned to SEQ ID NO: 2823 in Table 1. Amino acids conserved among all sequences are indicted by a "*" and generally conserved amino acids are indicated by a ":".

FIG. 115 depicts a sequence alignment (ClustalW) between SEQ ID NO: 2279 (RAAC02589) and ref|ZP_00591928.1|, ref|YP_001003150.1|, ref|NP_046614.1|, ref|YP_375842.1|, and ref|YP_001131112.1| (SEQ ID NOS: 2281-2285), respectively, which all have the function assigned to SEQ ID NO: 2279 in Table 1. Amino acids conserved among all sequences are indicted by a "*" and generally conserved amino acids are indicated by a ":".

FIG. 116 depicts a sequence alignment (ClustalW) between SEQ ID NO: 1412 (RAAC01442) and ref|ZP_02170919.1|, ref|YP_535778.1|, ref|ZP_01862118.1|, ref|NP_692713.1|, and ref|YP_359077.1| (SEQ ID NOS: 1414-1418), respectively, which all have the function assigned to SEQ ID NO: 1412 in Table 1. Amino acids conserved among all sequences are indicted by a "*" and generally conserved amino acids are indicated by a ":".

FIG. 117 depicts a sequence alignment (ClustalW) between SEQ ID NO: 69 (RAAC00027) and ref|YP_001213441.1|, ref|NP_244917.1|, ref|YP_001377189.1|, ref|YP_149334.1|, and ref|YP_077145.1| (SEQ ID NOS: 71-75), respectively, which all have the function assigned to SEQ ID NO: 69 in Table 1. Amino acids conserved among all sequences are indicted by a "*" and generally conserved amino acids are indicated by a ":".

FIG. 118 depicts a sequence alignment (ClustalW) between SEQ ID NO: 2245 (RAAC02508) and ref|NP_624000.1|, ref|YP_001662406.1|, ref|YP_001664279.1|, ref|YP_001038261.1|, and ref|YP_001394883.1| (SEQ ID NOS: 2247-2251), respectively, which all have the function assigned to SEQ ID NO: 2245 in Table 1. Amino acids conserved among all sequences are indicted by a "*" and generally conserved amino acids are indicated by a ":".

FIG. 119 depicts a sequence alignment (ClustalW) between SEQ ID NO: 885 (RAAC00905) and ref|ZP_00739566.1|, ref|NP_830389.1|, ref|YP_001643379.1|, ref|ZP_00237866.1|, and ref|YP_034830.1| (SEQ ID NOS: 887-891), respectively, which all have the function assigned to SEQ ID NO: 885 in Table 1. Amino acids conserved among all sequences are indicted by a "*" and generally conserved amino acids are indicated by a ":".

FIG. 120 depicts a sequence alignment (ClustalW) between SEQ ID NO: 1769 (RAAC01903) and ref|YP_001244333.1|, emb|CAI44346.1|, ref|ZP_02128221.1|, ref|NP_228001.1|, and ref|ZP_02171167.1| (SEQ ID NOS: 1771-1775), respectively, which all have the function assigned to SEQ ID NO: 1769 in Table 1. Amino acids conserved among all sequences are indicted by a "*" and generally conserved amino acids are indicated by a ":".

FIG. 121 depicts a sequence alignment (ClustalW) between SEQ ID NO: 987 (RAAC00981) and ref|YP_290547.1|, ref|YP_074752.1|, ref|YP_480150.1|, ref|YP_001509772.1|, and ref|NP_627230.1| (SEQ ID NOS: 989-993), respectively, which all have the function assigned to SEQ ID NO: 1769 in Table 1. Amino acids conserved among all sequences are indicted by a "*" and generally conserved amino acids are indicated by a ":".

FIGS. 122A and 122B depict a sequence alignment (ClustalW) between SEQ ID NO: 1004 (RAAC00986) and ref|YP_001489923.1|, ref|ZP_01964315.1|, ref|NP_937072.1|, ref|NP_762428.1|, and ref|ZP_01847462.1| (SEQ ID NOS: 1006-1010), respectively, which all have the function assigned to SEQ ID NO: 1004 Table 1. Amino acids conserved among all sequences are indicted by a "*" and generally conserved amino acids are indicated by a ":".

FIGS. 123A and 123B depict a sequence alignment (ClustalW) between SEQ ID NO: 2704 (RAAC03031) and ref|ZP_01170738.1|, ref|ZP_00539543.1|, ref|ZP_02168828.1|, ref|ZP_01856429.1|, and ref|YP_001114416.1| (SEQ ID NOS: 2706-2710), respectively, which all have the function assigned to SEQ ID NO: 2704 Table 1. Amino acids conserved among all sequences are indicted by a "*" and generally conserved amino acids are indicated by a ":".

FIG. 124 depicts a sequence alignment (ClustalW) between SEQ ID NO: 1803 (RAAC01956) and pdb|1B4A|A, sp|O31408|ARGR_BACST, ref|ZP_00538558.1|, ref|NP_243643.1|, and ref|YP_001126414.1| (SEQ ID NOS: 1805-1809), respectively, which all have the function assigned to SEQ ID NO: 1803 in Table 1. Amino acids conserved among all sequences are indicted by a "*" and generally conserved amino acids are indicated by a ":".

FIG. 125 depicts a sequence alignment (ClustalW) between SEQ ID NO: 1497 (RAAC01498) and ref|YP_001127098.1|, ref|YP_148912.1|, ref|ZP_01696601.1|, ref|YP_176517.1|, and ref|ZP_01171675.1| (SEQ ID NOS: 1499-1503), respectively, which all have the function assigned to SEQ ID NO: 1497 in Table 1. Amino acids conserved among all sequences are indicted by a "*" and generally conserved amino acids are indicated by a ":".

FIG. 126 depicts a sequence alignment (ClustalW) between SEQ ID NO: 1548 (RAAC01624) and ref|YP_090740.1|, ref|YP_078338.1|, ref|NP_243093.1|, ref|YP_001126180.1|, and ref|YP_001422307.1| (SEQ ID NOS: 1550-1554), respectively, which all have the function assigned to SEQ ID NO: 1548 in Table 1. Amino acids conserved among all sequences are indicted by a "*" and generally conserved amino acids are indicated by a ":".

FIG. 127 depicts a sequence alignment (ClustalW) between SEQ ID NO: 171 (RAAC00077) and ref|ZP_01696173.1|, ref|ZP_02327860.1|, ref|ZP_00539488.1|, ref|NP_694112.1|, and ref|YP_034511.1| (SEQ ID NOS: 173-177), respectively, which all have the function assigned to SEQ ID NO: 171 in Table 1. Amino acids conserved among all sequences are indicted by a "*" and generally conserved amino acids are indicated by a ":".

FIG. 128 depicts a sequence alignment (ClustalW) between SEQ ID NO: 851 (RAAC00876) and ref|ZP_02170056.1|, ref|YP_079889.1|, ref|NP_980690.1|, ref|ZP_02257686.1|, and ref|YP_038371.1| (SEQ ID NOS: 853-857), respectively, which all have the function assigned to SEQ ID NO: 851 in Table 1. Amino acids conserved among all sequences are indicted by a "*" and generally conserved amino acids are indicated by a ":".

FIG. 129 depicts a sequence alignment (ClustalW) between SEQ ID NO: 647 (RAAC00525) and ref|YP_001488458.1|, ref|ZP_01665756.1|, ref|NP_347033.1|, ref|YP_080909.1|, and ref|YP_841318.1| (SEQ ID NOS: 649-653), respectively, which all have the function assigned to SEQ ID NO: 647 in Table 1. Amino acids conserved among all sequences are indicted by a "*" and generally conserved amino acids are indicated by a ":".

FIG. 130 depicts a sequence alignment (ClustalW) between SEQ ID NO: 1089 (RAAC01072) and ref|YP_849514.1|, ref|ZP_02320157.11|, ref|YP_013918.1|, ref|ZP_02330749.1|, and ref|NP_470676.1| (SEQ ID NOS: 1091-1095), respectively, which all have the function assigned to SEQ ID NO: 1089 in Table 1. Amino acids conserved among all sequences are indicted by a "*" and generally conserved amino acids are indicated by a ":".

FIG. 131 depicts a sequence alignment (ClustalW) between SEQ ID NO: 1310 (RAAC01366) and ref|YP_849898.1|, ref|NP_471127.1|, ref|NP_465208.1|, ref|YP_001124617.1|, and ref|YP_146331.1| (SEQ ID NOS: 1312-1316), respectively, which all have the function assigned to SEQ ID NO: 1310 Table 1. Amino acids conserved among all sequences are indicted by a "*" and generally conserved amino acids are indicated by a ":".

FIG. 132 depicts a sequence alignment (ClustalW) between SEQ ID NO: 1378 (RAAC01431) and ref|ZP_01666690.1|, ref|YP_077070.1|, ref|ZP_01173986.1|, ref|YP_814057.1|, and ref|NP_964223.1| (SEQ ID NOS: 1380-1384), respectively, which all have the function assigned to SEQ ID NO: 1378 in Table 1. Amino acids conserved among all sequences are indicted by a "*" and generally conserved amino acids are indicated by a ":".

FIG. 133 depicts a sequence alignment (ClustalW) between SEQ ID NO: 1514 (RAAC01505) and ref|YP_149084.1|, ref|YP_001127265.1|, ref|YP_074599.1|, ref|YP_001661816.1|, and ref|NP_621898.1| (SEQ ID NOS: 1516-1520), respectively, which all have the function assigned to SEQ ID NO: 1514 in Table 1. Amino acids conserved among all sequences are indicted by a "*" and generally conserved amino acids are indicated by a ":".

FIG. 134 depicts a sequence alignment (ClustalW) between SEQ ID NO: 1514 (RAAC01505) and ref|YP_149084.1|, ref|YP_001127265.1|, ref|YP_074599.1|, ref|YP_001661816.1|, and ref|NP_621898.1| (SEQ ID NOS: 1516-1520), respectively, which all have the function assigned to SEQ ID NO: 1514 in Table 1. Amino acids conserved among all sequences are indicted by a "*" and generally conserved amino acids are indicated by a ":".

FIG. 135 depicts a sequence alignment between SEQ ID NO: 1820 (RAAC01972) and ref|ZP_01171531.1|, ref|YP_001391734.1|, ref|YP_001308325.1|, ref|YP_518781.1|, and ref|YP_001254935.1| (SEQ ID NOS: 1822-1826), respectively, which all have the function assigned to SEQ ID NO: 1820 Table 1. Amino acids conserved among all sequences are indicted by a "*" and generally conserved amino acids are indicated by a ":".

FIG. 136 depicts a sequence alignment between SEQ ID NO: 154 (RAAC00076) and ref|YP_001488917.1|, ref|YP_079193.1|, ref|NP_241876.1|, ref|YP_174035.1|, and ref|ZP_01169176.11| (SEQ ID NOS: 156-160), respectively, which all have the function assigned to SEQ ID NO: 154 in Table 1. Amino acids conserved among all sequences are indicted by a "*" and generally conserved amino acids are indicated by a ":".

FIG. 137 depicts a sequence alignment between SEQ ID NO: 1939 (RAAC02144) and ref|ZP_02327651.1|, sp|O32720|SP2AA_PAEPO, ref|NP_833792.1|, ref|NP_846529.1|, and ref|YP_001646701.1| (SEQ ID NOS: 1941-1945), respectively, which all have the function assigned to SEQ ID NO: 1939 in Table 1. Amino acids conserved among all sequences are indicted by a "*" and generally conserved amino acids are indicated by a ":".

FIGS. 138A and 138B depict a sequence alignment between SEQ ID NO: 2126 (RAAC02439) and ref|YP_001125957.1|, ref|YP_147806.1|, ref|ZP_01695872.1|, ref|NP_693661.1|, and ref|ZP_01666100.1| (SEQ ID NOS: 2128-2132), respectively, which all have the function assigned to SEQ ID NO: 2126 Table 1. Amino acids conserved among all sequences are indicted by a "*" and generally conserved amino acids are indicated by a ":".

FIG. 139 depicts a sequence alignment between SEQ ID NO: 970 (RAAC00944) and ref|YP_001488778.1|, ref|YP_174256.1|, ref|YP_081277.1|, ref|YP_711801.1|, and ref|YP_804091.1| (SEQ ID NOS: 972-976), respectively, which all have the function assigned to SEQ ID NO: 970 in Table 1. Amino acids conserved among all sequences are indicted by a "*" and generally conserved amino acids are indicated by a ":".

FIGS. 140A and 140B depict a sequence alignment between SEQ ID NO: 2313 (RAAC02632) and ref|ZP_01695369.1|, ref|NP_764957.1|, ref|NP_646484.1|, ref|YP_001332652.1|, and ref|NP_372249.1| (SEQ ID NOS: 2315-2319), respectively, which all have the function assigned to SEQ ID NO: 2313 in Table 1. Amino acids conserved among all sequences are indicted by a "*" and generally conserved amino acids are indicated by a ":".

FIG. 141 depicts a sequence alignment between SEQ ID NO: 2211 (RAAC02474) and ref|ZP_02329050.1|, ref|YP_148935.1|, gb|AAX09759.1|, ref|YP_001127122.1|, and ref|YP_001376898.1| (SEQ ID NOS: 2213-2217), respectively, which all have the function assigned to SEQ ID NO: 2211 in Table 1. Amino acids conserved among all sequences are indicted by a "*" and generally conserved amino acids are indicated by a ":".

FIG. 142 depicts a sequence alignment between SEQ ID NO: 732 (RAAC00625) and ref|NP_244107.1|, ref|ZP_01188060.1|, ref|YP_176259.1|, ref|YP_148663.1|, and ref|YP_001126805.1| (SEQ ID NOS: 734-738), respectively, which all have the function assigned to SEQ ID NO: 732 in Table 1. Amino acids conserved among all sequences are indicted by a "*" and generally conserved amino acids are indicated by a ":".

FIG. 143 depicts a sequence alignment between SEQ ID NO: 800 (RAAC00733) and ref|ZP_01697803.1|, ref|YP_001488326.1|, ref|ZP_01860336.11|, ref|NP_834817.1|, and ref|NP_693386.1| (SEQ ID NOS: 802-806), respectively, which all have the function assigned to SEQ ID NO: 800 in Table 1. Amino acids conserved among all sequences are indicted by a "*" and generally conserved amino acids are indicated by a ":".

FIG. 144 depicts a sequence alignment between SEQ ID NO: 2194 (RAAC02466) and ref|ZP_01860336.1|, ref|ZP_02327791.1|, ref|NP_244433.11|, ref|ZP_01171669.1|, and ref|YP_001488326.1| (SEQ ID NOS: 2196-2200), respectively, which all have the function assigned to SEQ ID NO: 2194 in Table 1. Amino acids conserved among all sequences are indicated by a "*" and generally conserved amino acids are indicated by a ":".

FIG. 145 depicts a sequence alignment between SEQ ID NO: 2398 (RAAC02678) and ref|YP_001124914.1|, ref|YP_146760.1|, ref|YP_001319371.1|, ref|ZP_01723416.1|, and ref|ZP_00742387.1| (SEQ ID NOS: 2400-2404), respectively, which all have the function assigned to SEQ ID NO: 2398 in Table 1. Amino acids conserved among all sequences are indicated by a "*" and generally conserved amino acids are indicated by a ":".

FIG. 146 depicts a sequence alignment between SEQ ID NO: 2228 (RAAC02507) and ref|YP_517080.1|, ref|ZP_02185068.1|, ref|YP_001394884.1|, ref|ZP_01574787.1|, and ref|YP_001559227.1| (SEQ ID NOS: 2230-2234), respectively, which all have the function assigned to SEQ ID NO: 2228 in Table 1. Amino acids conserved among all sequences are indicated by a "*" and generally conserved amino acids are indicated by a ":".

FIGS. 147A and 147B depict a sequence alignment between SEQ ID NO: 902 (RAAC00906) and ref|ZP_01667455.1|, ref|ZP_01515931.1|, ref|YP_001430381.1|, ref|YP_001637100.1|, and ref|YP_146183.1| (SEQ ID NOS: 904-908), respectively, which all have the function assigned to SEQ ID NO: 902 Table 1. Amino acids conserved among all sequences are indicted by a "*" and generally conserved amino acids are indicated by a ":".

FIG. 148 depicts a sequence alignment between SEQ ID NO: 2364 (RAAC02211) and ref|YP_005108.1|, ref|YP_144769.1|, ref|YP_001124914.1|, ref|YP_001157480.1|, and ref|ZP_01773683.1| (SEQ ID NOS: 2366-2370), respectively, which all have the function assigned to SEQ ID NO: 2364 in Table 1. Amino acids conserved among all sequences are indicated by a "*" and generally conserved amino acids are indicated by a ":".

FIGS. 149A and 149B depict a sequence alignment between SEQ ID NO: 1463 (RAAC01489) and ref|ZP_01696335.1|, ref|ZP_01667455.1|, ref|ZP_00739567.1|, ref|YP_001037228.1|, and ref|NP_830390.1| (SEQ ID NOS: 1465-1469), respectively, which all have the function assigned to SEQ ID NO: 1463 Table 1. Amino acids conserved among all sequences are indicted by a "*" and generally conserved amino acids are indicated by a ":".

FIGS. 150A and 150B depict a sequence alignment between SEQ ID NO: 2007 (RAAC02391) and ref|ZP_01697157.1|, ref|ZP_001212380.1|, ref|ZP_00539202.1|, ref|NP_693085.1|, and ref|ZP_02329946.1| (SEQ ID NOS: 2009-2013), respectively, which all have the function assigned to SEQ ID NO: 2007 Table 1. Amino acids con- FIGS. 151A and 151B depict a sequence alignment between SEQ ID NO: 2551 (RAAC02885) and ref|YP_147095.1|, ref|ZP_01171502.1|, ref|YP_001125215.1|, ref|YP_001486785.1|, and ref|ZP_01861001.1| (SEQ ID NOS: 2553-2557), respectively, which all have the function assigned to SEQ ID NO: 2551 Table 1. Amino acids conserved among all sequences are indicted by a "*" and generally conserved amino acids are indicated by a ":".

FIG. 152 depicts a sequence alignment between SEQ ID NO: 2534 (RAAC02876) and ref|YP_001125206.1|, ref|ZP_01696550.1|, ref|YP_001410204.1|, ref|ZP_01860990.1|, and ref|NP_243310.1| (SEQ ID NOS: 2536-2540), respectively, which all have the function assigned to SEQ ID NO: 2534 in Table 1. Amino acids conserved among all sequences are indicted by a "*" and generally conserved amino acids are indicated by a ":".

FIG. 153 depicts a sequence alignment between SEQ ID NO: 1021 (RAAC00987) and ref|YP_001559801.1|, ref|ZP_01696550.1|, ref|YP_753552.1|, ref|NP_243310.1|, and ref|ZP_01725653.1| (SEQ ID NOS: 1023-1027), respectively, which all have the function assigned to SEQ ID NO: 1021 in Table 1. Amino acids conserved among all sequences are indicted by a "*" and generally conserved amino acids are indicated by a ":".

FIGS. 154A and 154B depict a sequence alignment between SEQ ID NO: 1990 (RAAC02162) and ref|YP_148131.1|, ref|YP_001126300.1|, ref|YP_079616.1|, ref|NP_390192.1|, and ref|YP_001487274.1| (SEQ ID NOS: 1992-1996), respectively, which all have the function assigned to SEQ ID NO: 1990 Table 1. Amino acids conserved among all sequences are indicted by a "*" and generally conserved amino acids are indicated by a ":".

FIG. 155 depicts a sequence alignment between SEQ ID NO: 1 (RAAC00012) and ref|YP_907563.1|, ref|YP_955166.1|, ref|ZP_00997175.1|, ref|YP_001133548.1|, and ref|YP_829143.1| (SEQ ID NOS: 3-7), respectively, which all have the function assigned to SEQ ID NO: 1 in Table 1. Amino acids conserved among all sequences are indicted by a "*" and generally conserved amino acids are indicated by a ":".

FIGS. 156A and 156B depict a sequence alignment between SEQ ID NO: 2876 (RAAC02761) and emb|CAG29823.1|, ref|NP_923516.1|, ref|ZP_02329377.1|, gb|EAY57526.1|, and ref|YP_149098.1| (SEQ ID NOS: 2878-2882), respectively, which all have the function assigned to SEQ ID NO: 2876 in Table 1. Amino acids conserved among all sequences are indicted by a "*" and generally conserved amino acids are indicated by a ":".

FIG. 157 depicts a sequence alignment between SEQ ID NO: 579 (RAAC00477) and ref|YP_001377039.1|, ref|NP_244654.1|, ref|YP_001647908.1|, ref|YP_897521.1|, and ref|ZP_00744427.1| (SEQ ID NOS: 581-585), respectively, which all have the function assigned to SEQ ID NO: 579 in Table 1. Amino acids conserved among all sequences are indicted by a "*" and generally conserved amino acids are indicated by a ":".

FIGS. 158A and 158B depict a sequence alignment between SEQ ID NO: 35 (RAAC00019) and ref|ZP_02169265.1|, ref|YP_848463.1|, ref|NP_694373.1|, ref|ZP_01695448.1|, and ref|ZP_00539458.1| (SEQ ID NOS: 37-41), respectively, which all have the function assigned to SEQ ID NO: 35 in Table 1. Amino acids conserved among all sequences are indicted by a "*" and generally conserved amino acids are indicated by a ":".

FIG. 159 depicts a sequence alignment between SEQ ID NO: 52 (RAAC00020) and ref|ZP_01169692.1|, ref|ZP_01695449.1|, ref|YP_001127497.1|, ref|YP_149327.1|, and ref|YP_534941.1| (SEQ ID NOS: 54-58), respectively, which all have the function assigned to SEQ ID NO: 52 in Table 1. Amino acids conserved among all sequences are indicted by a "*" and generally conserved amino acids are indicated by a ":".

FIGS. 160A and 160B depict a sequence alignment between SEQ ID NO: 1684 (RAAC01715) and gb|EDQ48509.1|, gb|EDQ48476.1|, ref|ZP_01575425.1|, ref|ZP_02025790.1|, and ref|YP_001662047.1| (SEQ ID NOS: 1686-1690), respectively, which all have the function assigned to SEQ ID NO: 1684 in Table 1. Amino acids conserved among all sequences are indicted by a "*" and generally conserved amino acids are indicated by a ":".

FIGS. 161A-161C depict a sequence alignment between SEQ ID NO: 1157 (RAAC01137) and ref|NP_978751.1|, ref|ZP_00741477.1|, ref|YP_894957.1|, ref|NP_844784.1|, and ref|ZP_02259481.1| (SEQ ID NOS: 1159-1163), respectively, which all have the function assigned to SEQ ID NO: 1157 in Table 1. Amino acids conserved among all sequences are indicted by a "*" and generally conserved amino acids are indicated by a ":".

FIGS. 162A-162C depict a sequence alignment between SEQ ID NO: 2910 (RAAC03013) and ref|ZP_02168855.1|, ref|NP_470526.1|, ref|ZP_02320069.1|, ref|ZP_01927122.1|, and ref|YP_013834.1| (SEQ ID NOS: 2912-2916), respectively, which all have the function assigned to SEQ ID NO: 2910 in Table 1. Amino acids conserved among all sequences are indicted by a "*" and generally conserved amino acids are indicated by a ":".

DETAILED DESCRIPTION OF THE INVENTION

Bacterial DNA codes for information that regulates transcription of genes into mRNA, which codes for proteins or enzymes used for; control of growth, and processing of energy, carbon and other compounds by the cell. Most of these transcriptional regulators/repressors function to turn on and off genes to minimize expenditure of cellular energy in response to their growth environment (i.e., presence of growth substrate, metals, temperature, etc.). This can become a problem related to process development because regulation and control of enzymes for a specific reaction may lead to suboptimal growth or suboptimal production of a desired metabolite (enzyme or compound). The genome of *Alicyclobacillus acidocaldarius* strain ATCC 27009 contains numerous coding sequences for transcriptional regulators and repressors of proteins related to growth, and processing of carbon by the cell. These regulators and repressors may directly affect expression of glycosyl hydrolase and/or esterase enzymes for processing of biomass outside the cell, as well as controlling production of valuable secondary metabolites.

Metabolic engineering through modification (genetic engineering) of these regulatory responses for transcription is one approach for optimization of cellular processes, by way of non-limiting example, *Alicyclobacillus acidocaldarius*. Control of these genes will allow for over-expression of desired pathways (e.g., production of glycosyl hydrolases, organic acids or alcohols), or likewise elimination or causing reduced expression of genes leading to undesired pathways or products (e.g., proteins that control transcription of glycosyl hydrolase genes). Control of these genes, or using them as loci for controlling/optimizing carbon processing in organisms, such as, by way of non-limiting example, the thermoacidophile *Alicyclobacillus acidocaldarius* has not been previously attempted using genes and proteins from *Alicyclobacillus acidocaldarius*; thereby, making use of transcriptional regulators from this source novel.

Embodiments of the invention include genes and associated proteins related to regulation of growth and metabolism of the thermoacidophile *Alicyclobacillus acidocaldarius*. Coding sequences for genes related to these processes were determined from sequence information generated from sequencing the genome of *Alicyclobacillus acidocaldarius*. These genes and proteins may represent targets for metabolic engineering of *Alicyclobacillus acidocaldarius* or other organisms. Non-limiting examples of nucleotide sequences found within the genome of *Alicyclobacillus acidocaldarius*, and amino acids coded thereby, associated with regulation of growth and carbon metabolism are listed in Table 1. Regulators and repressors may be, without limitation, of the following classes: regulators that control growth, including cell division and growth under aerobic and anaerobic conditions; regulators that respond to environmental conditions such as temperature, metal concentration and metabolite concentration; regulators of secondary metabolite pathways such as amino acids, organic acids, alcohols, antibiotics, antibiotic resistance, enzymes related to DNA processing and others; repressors related to carbon processing operons that respond to the presence or absence of organic compounds in the growth environment; signal transduction regulators that control phases of growth and carbon processing; regulators that control the response of *Alicyclobacillus acidocaldarius* to its growth environment allowing movement toward carbon sources or biofilm formation on a carbon source; and others.

Embodiments of the invention relate in part to the gene sequences and/or protein sequences comprising genes and/or proteins of *Alicyclobacillus acidocaldarius*. Genes and proteins included are those which play a role in transcription and transcriptional control. Intracellular enzyme activities may be thermophilic and/or acidophilic in nature and general examples of similar genes are described in the literature. Classes of genes, sequences, enzymes and factors include, but are not limited to, those listed in Table 1.

TABLE 1

*Alicyclobacillus acidocaldarius* genes related to transcription and transcriptional regulation

| Reference | Gene Sequence | Protein Sequence | Function |
|---|---|---|---|
| RAAC00012 | SEQ ID NO: 2 | SEQ ID NO: 1 | C4-dicarboxylate transport protein |
| RAAC00013 | SEQ ID NO: 19 | SEQ ID NO: 18 | Transcriptional regulators, LysR family |
| RAAC00019 | SEQ ID NO: 36 | SEQ ID NO: 35 | Two-component sensor kinase yycG |
| RAAC00020 | SEQ ID NO: 53 | SEQ ID NO: 52 | Two-component response regulator yycF |
| RAAC00027 | SEQ ID NO: 70 | SEQ ID NO: 69 | Single-strand DNA binding protein |
| RAAC00039 | SEQ ID NO: 87 | SEQ ID NO: 86 | Stage 0 sporulation protein J |
| RAAC00040 | SEQ ID NO: 104 | SEQ ID NO: 103 | Chromosome partitioning protein parA |
| RAAC00045 | SEQ ID NO: 121 | SEQ ID NO: 120 | Jag protein |
| RAAC00068 | SEQ ID NO: 138 | SEQ ID NO: 137 | Transcriptional regulator, GntR family |
| RAAC00076 | SEQ ID NO: 155 | SEQ ID NO: 154 | Trp repressor binding protein |
| RAAC00077 | SEQ ID NO: 172 | SEQ ID NO: 171 | Gluconate operon transcriptional repressor |

TABLE 1-continued

*Alicyclobacillus acidocaldarius* genes related to transcription and transcriptional regulation

| Reference | Gene Sequence | Protein Sequence | Function |
|---|---|---|---|
| RAAC00092 | SEQ ID NO: 189 | SEQ ID NO: 188 | Prespore specific transcriptional activator rsfA |
| RAAC00113 | SEQ ID NO: 206 | SEQ ID NO: 205 | Cell-division initiation protein DivIB |
| RAAC00117 | SEQ ID NO: 223 | SEQ ID NO: 222 | Cell division protein ftsA |
| RAAC00118 | SEQ ID NO: 240 | SEQ ID NO: 239 | Cell division protein ftsZ |
| RAAC00120 | SEQ ID NO: 257 | SEQ ID NO: 256 | RNA polymerase sigma-E factor |
| RAAC00121 | SEQ ID NO: 274 | SEQ ID NO: 273 | RNA polymerase sigma-G factor |
| RAAC00134 | SEQ ID NO: 291 | SEQ ID NO: 290 | Pyrimidine operon regulatory protein pyrR |
| RAAC00147 | SEQ ID NO: 308 | SEQ ID NO: 307 | DNA-directed RNA polymerase omega chain |
| RAAC00161 | SEQ ID NO: 325 | SEQ ID NO: 324 | Small acid-soluble spore protein |
| RAAC00212 | SEQ ID NO: 342 | SEQ ID NO: 341 | Transcription state regulatory protein abrB |
| RAAC00215 | SEQ ID NO: 359 | SEQ ID NO: 358 | Phosphorelay inhibitor |
| RAAC00269 | SEQ ID NO: 376 | SEQ ID NO: 375 | Transcriptional regulator, LacI family |
| RAAC00349 | SEQ ID NO: 393 | SEQ ID NO: 392 | Transcriptional regulator, AsnC family |
| RAAC00354 | SEQ ID NO: 410 | SEQ ID NO: 409 | Transcriptional regulator, TetR family |
| RAAC00365 | SEQ ID NO: 427 | SEQ ID NO: 426 | N-acetylmuramoyl-L-alanine amidase |
| RAAC00371 | SEQ ID NO: 444 | SEQ ID NO: 443 | DNA-directed RNA polymerase alpha chain |
| RAAC00407 | SEQ ID NO: 461 | SEQ ID NO: 460 | DNA-directed RNA polymerase beta' chain |
| RAAC00408 | SEQ ID NO: 478 | SEQ ID NO: 477 | DNA-directed RNA polymerase beta chain |
| RAAC00415 | SEQ ID NO: 495 | SEQ ID NO: 494 | Transcription antitermination protein nusG |
| RAAC00418 | SEQ ID NO: 512 | SEQ ID NO: 511 | RNA polymerase sigma-H factor |
| RAAC00430 | SEQ ID NO: 529 | SEQ ID NO: 528 | DNA-binding protein |
| RAAC00436 | SEQ ID NO: 546 | SEQ ID NO: 545 | Transcriptional regulator ctsR |
| RAAC00475 | SEQ ID NO: 563 | SEQ ID NO: 562 | Transcription termination factor rho |
| RAAC00477 | SEQ ID NO: 580 | SEQ ID NO: 579 | Sporulation initiation phosphotransferase F |
| RAAC00480 | SEQ ID NO: 597 | SEQ ID NO: 596 | DNA-directed RNA polymerase delta chain |
| RAAC00483 | SEQ ID NO: 614 | SEQ ID NO: 613 | Regulator of kinase autophosphorylation inhibitor |
| RAAC00484 | SEQ ID NO: 631 | SEQ ID NO: 630 | Kinase autophosphorylation inhibitor kipI |
| RAAC00525 | SEQ ID NO: 648 | SEQ ID NO: 647 | Kdg operon repressor |
| RAAC00549 | SEQ ID NO: 665 | SEQ ID NO: 664 | Transcriptional regulator, MerR family |
| RAAC00570 | SEQ ID NO: 682 | SEQ ID NO: 681 | Transcriptional regulator, LacI family |
| RAAC00579 | SEQ ID NO: 699 | SEQ ID NO: 698 | Transcriptional regulator, ArsR family |
| RAAC00603 | SEQ ID NO: 716 | SEQ ID NO: 715 | Transcriptional regulator, ArsR family |
| RAAC00625 | SEQ ID NO: 733 | SEQ ID NO: 732 | Catabolite control protein A |
| RAAC00643 | SEQ ID NO: 750 | SEQ ID NO: 749 | Small acid-soluble spore protein |
| RAAC00650 | SEQ ID NO: 767 | SEQ ID NO: 766 | Glycosyltransferase |
| RAAC00675 | SEQ ID NO: 784 | SEQ ID NO: 783 | Transcriptional regulator |
| RAAC00733 | SEQ ID NO: 801 | SEQ ID NO: 800 | Catabolite repression protein crh |

TABLE 1-continued

*Alicyclobacillus acidocaldarius* genes related to transcription and transcriptional regulation

| Reference | Gene Sequence | Protein Sequence | Function |
|---|---|---|---|
| RAAC00856 | SEQ ID NO: 818 | SEQ ID NO: 817 | RNA polymerase sigma-K factor |
| RAAC00872 | SEQ ID NO: 835 | SEQ ID NO: 834 | Spore protease |
| RAAC00876 | SEQ ID NO: 852 | SEQ ID NO: 851 | Heat-inducible transcription repressor hrcA |
| RAAC00896 | SEQ ID NO: 869 | SEQ ID NO: 868 | RNA polymerase sigma factor rpoD |
| RAAC00905 | SEQ ID NO: 886 | SEQ ID NO: 885 | Two-component response regulator |
| RAAC00906 | SEQ ID NO: 903 | SEQ ID NO: 902 | Two component system histidine kinase |
| RAAC00923 | SEQ ID NO: 920 | SEQ ID NO: 919 | Small acid-soluble spore protein |
| RAAC00927 | SEQ ID NO: 937 | SEQ ID NO: 936 | Transcriptional regulator, MarR family |
| RAAC00935 | SEQ ID NO: 954 | SEQ ID NO: 953 | Transcriptional regulator, MarR family |
| RAAC00944 | SEQ ID NO: 971 | SEQ ID NO: 970 | Transcriptional activator tenA |
| RAAC00981 | SEQ ID NO: 988 | SEQ ID NO: 987 | Two-component response regulator |
| RAAC00986 | SEQ ID NO: 1005 | SEQ ID NO: 1004 | Two-component response regulator |
| RAAC00987 | SEQ ID NO: 1022 | SEQ ID NO: 1021 | Chemotaxis protein cheY |
| RAAC00991 | SEQ ID NO: 1039 | SEQ ID NO: 1038 | Glycosyltransferase |
| RAAC01035 | SEQ ID NO: 1056 | SEQ ID NO: 1055 | Transcriptional regulator, GntR family |
| RAAC01059 | SEQ ID NO: 1073 | SEQ ID NO: 1072 | Transcriptional regulator, TetR family |
| RAAC01072 | SEQ ID NO: 1090 | SEQ ID NO: 1089 | Repressor LexA |
| RAAC01078 | SEQ ID NO: 1107 | SEQ ID NO: 1106 | Ribose operon repressor |
| RAAC01080 | SEQ ID NO: 1124 | SEQ ID NO: 1123 | Transcriptional regulator, MerR family |
| RAAC01126 | SEQ ID NO: 1141 | SEQ ID NO: 1140 | Transcriptional regulator, TetR family |
| RAAC01137 | SEQ ID NO: 1158 | SEQ ID NO: 1157 | Transporter, MMPL family |
| RAAC01138 | SEQ ID NO: 1175 | SEQ ID NO: 1174 | Transcriptional regulator, TetR family |
| RAAC01158 | SEQ ID NO: 1192 | SEQ ID NO: 1191 | Transcriptional regulator, GntR family |
| RAAC01353 | SEQ ID NO: 1294 | SEQ ID NO: 1293 | Transcriptional regulator, IclR family |
| RAAC01366 | SEQ ID NO: 1311 | SEQ ID NO: 1310 | Peroxide operon regulator |
| RAAC01375 | SEQ ID NO: 1328 | SEQ ID NO: 1327 | Transcriptional regulators, LysR family |
| RAAC01377 | SEQ ID NO: 1345 | SEQ ID NO: 1344 | Glycosyltransferase |
| RAAC01427 | SEQ ID NO: 1362 | SEQ ID NO: 1361 | SspF protein |
| RAAC01431 | SEQ ID NO: 1379 | SEQ ID NO: 1378 | Pur operon repressor |
| RAAC01438 | SEQ ID NO: 1396 | SEQ ID NO: 1395 | Transcription-repair coupling factor |
| RAAC01442 | SEQ ID NO: 1413 | SEQ ID NO: 1412 | DNA-binding protein HU |
| RAAC01464 | SEQ ID NO: 1430 | SEQ ID NO: 1429 | Transcriptional regulator, Xre family |
| RAAC01465 | SEQ ID NO: 1447 | SEQ ID NO: 1446 | Transcription elongation factor greA |
| RAAC01489 | SEQ ID NO: 1464 | SEQ ID NO: 1463 | Two component system histidine kinase |
| RAAC01493 | SEQ ID NO: 1481 | SEQ ID NO: 1480 | Transcriptional regulators, LysR family |
| RAAC01498 | SEQ ID NO: 1498 | SEQ ID NO: 1497 | Central glycolytic genes regulator |
| RAAC01505 | SEQ ID NO: 1515 | SEQ ID NO: 1514 | Ribose operon repressor |
| RAAC01563 | SEQ ID NO: 1532 | SEQ ID NO: 1531 | Sporulation kinase D |
| RAAC01624 | SEQ ID NO: 1549 | SEQ ID NO: 1548 | Ebg operon repressor |
| RAAC01638 | SEQ ID NO: 1566 | SEQ ID NO: 1565 | Transcriptional regulator, TetR family |
| RAAC01653 | SEQ ID NO: 1583 | SEQ ID NO: 1582 | Transcriptional regulators, LysR family |
| RAAC01655 | SEQ ID NO: 1600 | SEQ ID NO: 1599 | Transcriptional regulator |
| RAAC01657 | SEQ ID NO: 1617 | SEQ ID NO: 1616 | Pyruvate dehydrogenase (acetyl-transferring) |
| RAAC01658 | SEQ ID NO: 1634 | SEQ ID NO: 1633 | Pyruvate dehydrogenase (acetyl-transferring) |
| RAAC01659 | SEQ ID NO: 1651 | SEQ ID NO: 1650 | Dihydrolipoyllysine-residue acetyltransferase |
| RAAC01701 | SEQ ID NO: 1668 | SEQ ID NO: 1667 | Transcriptional regulator, MarR family |
| RAAC01715 | SEQ ID NO: 1685 | SEQ ID NO: 1684 | Two-component response regulator yesN |
| RAAC01745 | SEQ ID NO: 1702 | SEQ ID NO: 1701 | Pyruvate dehydrogenase (acetyl-transferring) |
| RAAC01746 | SEQ ID NO: 1719 | SEQ ID NO: 1718 | Pyruvate dehydrogenase (acetyl-transferring) |
| RAAC01814 | SEQ ID NO: 1736 | SEQ ID NO: 1735 | RNA polymerase sigma-K factor |
| RAAC01826 | SEQ ID NO: 1753 | SEQ ID NO: 1752 | RNA polymerase ECF-type sigma factor |
| RAAC01903 | SEQ ID NO: 1770 | SEQ ID NO: 1769 | Two-component response regulator |
| RAAC01912 | SEQ ID NO: 1787 | SEQ ID NO: 1786 | Transcriptional regulator, DeoR family |
| RAAC01956 | SEQ ID NO: 1804 | SEQ ID NO: 1803 | Arginine repressor, argR |
| RAAC01972 | SEQ ID NO: 1821 | SEQ ID NO: 1820 | Transcription pleiotropic repressor codY |
| RAAC02012 | SEQ ID NO: 1838 | SEQ ID NO: 1837 | Transcriptional regulator, LytR family |
| RAAC02031 | SEQ ID NO: 1855 | SEQ ID NO: 1854 | Transcriptional regulator, GntR family |
| RAAC02034 | SEQ ID NO: 1872 | SEQ ID NO: 1871 | Germination protein gerE |
| RAAC02041 | SEQ ID NO: 1889 | SEQ ID NO: 1888 | Transcriptional regulator, MarR family |
| RAAC02112 | SEQ ID NO: 1906 | SEQ ID NO: 1905 | N utilization substance protein B |
| RAAC02142 | SEQ ID NO: 1923 | SEQ ID NO: 1922 | Serine-type D-Ala-D-Ala carboxypeptidase |
| RAAC02144 | SEQ ID NO: 1940 | SEQ ID NO: 1939 | Anti-sigma F factor antagonist |
| RAAC02146 | SEQ ID NO: 1957 | SEQ ID NO: 1956 | RNA polymerase sigma-F factor |
| RAAC02161 | SEQ ID NO: 1974 | SEQ ID NO: 1973 | Transcriptional regulatory protein resD |
| RAAC02162 | SEQ ID NO: 1991 | SEQ ID NO: 1990 | Sensor protein resE |
| RAAC02391 | SEQ ID NO: 2008 | SEQ ID NO: 2007 | Phosphate regulon sensor protein phoR |
| RAAC02417 | SEQ ID NO: 2025 | SEQ ID NO: 2024 | Transcriptional regulator, Cro/CI family |
| RAAC02421 | SEQ ID NO: 2042 | SEQ ID NO: 2041 | Glycosyltransferase |
| RAAC02426 | SEQ ID NO: 2059 | SEQ ID NO: 2058 | Pyruvate dehydrogenase (acetyl-transferring) |
| RAAC02427 | SEQ ID NO: 2076 | SEQ ID NO: 2075 | Pyruvate dehydrogenase (acetyl-transferring) |
| RAAC02428 | SEQ ID NO: 2093 | SEQ ID NO: 2092 | Dihydrolipoyllysine-residue acetyltransferase |
| RAAC02432 | SEQ ID NO: 2110 | SEQ ID NO: 2109 | Transcriptional regulator, IclR family |
| RAAC02439 | SEQ ID NO: 2127 | SEQ ID NO: 2126 | Sigma-54-dependent transcriptional activator |
| RAAC02454 | SEQ ID NO: 2144 | SEQ ID NO: 2143 | Prespore specific transcriptional activator rsfA |

TABLE 1-continued

Alicyclobacillus acidocaldarius genes related to transcription and transcriptional regulation

| Reference | Gene Sequence | Protein Sequence | Function |
|---|---|---|---|
| RAAC02459 | SEQ ID NO: 2161 | SEQ ID NO: 2160 | Transcriptional regulator, GntR family |
| RAAC02164 | SEQ ID NO: 2178 | SEQ ID NO: 2177 | SIR2 family protein |
| RAAC02466 | SEQ ID NO: 2195 | SEQ ID NO: 2194 | Catabolite repression protein crh |
| RAAC02474 | SEQ ID NO: 2212 | SEQ ID NO: 2211 | Hpr(ser) Kinase/Phosphatase |
| RAAC02507 | SEQ ID NO: 2229 | SEQ ID NO: 2228 | Two component system histidine kinase |
| RAAC02508 | SEQ ID NO: 2246 | SEQ ID NO: 2245 | Two-component response regulator |
| RAAC02546 | SEQ ID NO: 2263 | SEQ ID NO: 2262 | RNA polymerase sigma-H factor |
| RAAC02589 | SEQ ID NO: 2280 | SEQ ID NO: 2279 | DNA-binding protein HU |
| RAAC02603 | SEQ ID NO: 2297 | SEQ ID NO: 2296 | Transcription state regulatory protein abrB |
| RAAC02632 | SEQ ID NO: 2314 | SEQ ID NO: 2313 | Hpr(ser) Kinase/Phosphatase |
| RAAC02663 | SEQ ID NO: 2331 | SEQ ID NO: 2330 | Transcriptional regulator, GntR family |
| RAAC02671 | SEQ ID NO: 2348 | SEQ ID NO: 2347 | Transcriptional regulator, MerR family |
| RAAC02211 | SEQ ID NO: 2365 | SEQ ID NO: 2364 | Two component system histidine kinase |
| RAAC02673 | SEQ ID NO: 2382 | SEQ ID NO: 2381 | Glycerol uptake operon antiterminator regulatory protein |
| RAAC02678 | SEQ ID NO: 2399 | SEQ ID NO: 2398 | Two component system histidine kinase |
| RAAC02712 | SEQ ID NO: 2416 | SEQ ID NO: 2415 | Transcriptional regulator, TetR family |
| RAAC02227 | SEQ ID NO: 2518 | SEQ ID NO: 2517 | Serine-type D-Ala-D-Ala carboxypeptidase |
| RAAC02876 | SEQ ID NO: 2535 | SEQ ID NO: 2534 | Chemotaxis protein cheY |
| RAAC02885 | SEQ ID NO: 2552 | SEQ ID NO: 2551 | Chemotaxis protein cheA |
| RAAC02902 | SEQ ID NO: 2569 | SEQ ID NO: 2568 | N utilization substance protein A |
| RAAC02968 | SEQ ID NO: 2603 | SEQ ID NO: 2602 | RNA polymerase sigma-H factor |
| RAAC02984 | SEQ ID NO: 2620 | SEQ ID NO: 2619 | Arginine utilization regulatory protein rocR |
| RAAC02994 | SEQ ID NO: 2637 | SEQ ID NO: 2636 | Arginine utilization regulatory protein rocR |
| RAAC03005 | SEQ ID NO: 2654 | SEQ ID NO: 2653 | Transcriptional regulator, GntR family |
| RAAC02241 | SEQ ID NO: 2671 | SEQ ID NO: 2670 | Transcriptional regulator, MarR family |
| RAAC03015 | SEQ ID NO: 2688 | SEQ ID NO: 2687 | Serine-type D-Ala-D-Ala carboxypeptidase |
| RAAC03031 | SEQ ID NO: 2705 | SEQ ID NO: 2704 | Two-component response regulator |
| RAAC03156 | SEQ ID NO: 2722 | SEQ ID NO: 2721 | Transcriptional regulator, ArsR family |
| RAAC03180 | SEQ ID NO: 2739 | SEQ ID NO: 2738 | Transcriptional regulator, Cro/CI family |
| RAAC03184 | SEQ ID NO: 2756 | SEQ ID NO: 2755 | Transcriptional regulator |
| RAAC03236 | SEQ ID NO: 2773 | SEQ ID NO: 2772 | Transcription state regulatory protein abrB |
| RAAC02292 | SEQ ID NO: 2790 | SEQ ID NO: 2789 | Transcriptional regulator |
| RAAC02315 | SEQ ID NO: 2807 | SEQ ID NO: 2806 | Chromosome partitioning protein parA |
| RAAC02359 | SEQ ID NO: 2824 | SEQ ID NO: 2823 | DNA-binding protein HU |
| RAAC02381 | SEQ ID NO: 2841 | SEQ ID NO: 2840 | Glycosyltransferase |
|  | SEQ ID NO: 2857 |  | Catabolite-responsive element |
|  | SEQ ID NO: 2858 |  | Catabolite responsive element |
| RAAC02740 | SEQ ID NO: 2860 | SEQ ID NO: 2859 | Transcriptional regulator |
| RAAC02761 | SEQ ID NO: 2877 | SEQ ID NO: 2876 | Sensor protein kdpD |
| RAAC02937 | SEQ ID NO: 2894 | SEQ ID NO: 2893 | Transcriptional regulator |
| RAAC03013 | SEQ ID NO: 2911 | SEQ ID NO: 2910 | Transporter, MMPL family |
| RAAC03263 | SEQ ID NO: 2928 | SEQ ID NO: 2927 | RNA polymerase sigma-H factor |

The present invention relates to nucleotides sequences comprising isolated and/or purified nucleotide sequences of the genome of Alicyclobacillus acidocaldarius selected from the sequences of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 or one of their fragments.

The present invention likewise relates to isolated and/or purified nucleotide sequences, characterized in that they comprise at least one of: a) a nucleotide sequence of at least one of the sequences of SEQ ID NOS: 22, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 or one of their fragments; b) a nucleotide sequence homologous to a nucleotide sequence such as defined in a); c) a nucleotide sequence complementary to a nucleotide sequence such as defined in a) or b), and a nucleotide sequence of their corresponding RNA; d) a nucleotide sequence capable of hybridizing under stringent conditions with a sequence such as defined in a), b) or c); e) a nucleotide sequence comprising a sequence such as defined in a), b), c) or d); and f) a nucleotide sequence modified by a nucleotide sequence such as defined in a), b), c), d) or e).

Nucleotide, polynucleotide, or nucleic acid sequence will be understood according to the present invention as meaning both a double-stranded or single-stranded DNA in the monomeric and dimeric (so-called in tandem) forms and the transcription products of the DNAs.

Aspects of the invention relate to nucleotide sequences in which it has been possible to isolate, purify or partially purify, starting from separation methods such as, for example, ion-exchange chromatography, by exclusion based on molecular size, or by affinity, or, alternatively, fractionation techniques based on solubility in different solvents, or starting from methods of genetic engineering such as amplification, cloning, and subcloning, it being possible for the sequences of the invention to be carried by vectors.

Isolated and/or purified nucleotide sequence fragment according to the invention will be understood as designating any nucleotide fragment of the genome of *Alicyclobacillus acidocaldarius*, and may include, by way of non-limiting example, a length of at least 8, 12, 20 25, 50, 75, 100, 200, 300, 400, 500, 1000, or more, consecutive nucleotides of the sequence from which it originates.

Specific fragment of an isolated and/or purified nucleotide sequence according to the invention will be understood as designating any nucleotide fragment of the genome of *Alicyclobacillus acidocaldarius*, having, after alignment and comparison with the corresponding fragments of genomic sequences of *Alicyclobacillus acidocaldarius*, at least one nucleotide or base of different nature.

Homologous isolated and/or purified nucleotide sequence in the sense of the present invention is understood as meaning an isolated and/or purified nucleotide sequence having at least a percentage identity with the bases of a nucleotide sequence according to the invention of at least about 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, this percentage being purely statistical and it being possible to distribute the differences between the two nucleotide sequences at random and over the whole of their length.

Specific homologous nucleotide sequence in the sense of the present invention is understood as meaning a homologous nucleotide sequence having at least one nucleotide sequence of a specific fragment, such as defined above. The "specific" homologous sequences can comprise, for example, the sequences corresponding to the genomic sequence or to the sequences of its fragments representative of variants of the genome of *Alicyclobacillus acidocaldarius*. These specific homologous sequences can thus correspond to variations linked to mutations within strains of *Alicyclobacillus acidocaldarius*, and especially correspond to truncations, substitutions, deletions and/or additions of at least one nucleotide. The homologous sequences can likewise correspond to variations linked to the degeneracy of the genetic code.

The term "degree or percentage of sequence homology" refers to "degree or percentage of sequence identity between two sequences after optimal alignment" as defined in the present application.

Two amino-acids or nucleotidic sequences are said to be "identical" if the sequence of amino-acids or nucleotidic residues, in the two sequences is the same when aligned for maximum correspondence as described below. Sequence comparisons between two (or more) peptides or polynucleotides are typically performed by comparing sequences of two optimally aligned sequences over a segment or "comparison window" to identify and compare local regions of sequence similarity. Optimal alignment of sequences for comparison may be conducted by the local homology algorithm of Smith and Waterman, *Ad. App. Math* 2:482 (1981), by the homology alignment algorithm of Neddleman and Wunsch, *J. Mol Biol.* 48:443 (1970), by the search for similarity method of Pearson and Lipman, *Proc. Natl. Acad. Sci.* (U.S.A.) 85:2444 (1988), by computerized implementation of these algorithms (GAP, BESTFIT, FASTA, and TFASTA in the Wisconsin Genetics Software Package, Genetics Computer Group (GCG), 575 Science Dr., Madison, Wis.), or by visual inspection.

"Percentage of sequence identity" (or degree of identity) is determined by comparing two optimally aligned sequences over a comparison window, where the portion of the peptide or polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical amino-acid residue or nucleic acid base occurs in both sequences to yield the number of matched positions, dividing the number of matched positions by the total number of positions in the window of comparison and multiplying the result by 100 to yield the percentage of sequence identity.

The definition of sequence identity given above is the definition that would be used by one of skill in the art. The definition by itself does not need the help of any algorithm, the algorithms being helpful only to achieve the optimal alignments of sequences, rather than the calculation of sequence identity.

From the definition given above, it follows that there is a well-defined and only one value for the sequence identity between two compared sequences, which value corresponds to the value obtained for the best or optimal alignment.

In the BLAST N or BLAST P "BLAST 2 sequence" software, which is available at the web site ncbi.nlm.nih.gov/gorf/bl2.html, and habitually used by the inventors and in general by the skilled person for comparing and determining the identity between two sequences, gap cost which depends on the sequence length to be compared is directly selected by the software (i.e., 11.2 for substitution matrix BLOSUM-62 for length>85).

Complementary nucleotide sequence of a sequence of the invention is understood as meaning any DNA whose nucleotides are complementary to those of the sequence of the invention, and whose orientation is reversed (antisense sequence).

Hybridization under conditions of stringency with a nucleotide sequence according to the invention is understood as meaning hybridization under conditions of temperature and ionic strength chosen in such a way that they allow the maintenance of the hybridization between two fragments of complementary DNA.

By way of illustration, conditions of great stringency of the hybridization step with the aim of defining the nucleotide fragments described above are advantageously the following.

The hybridization is carried out at a preferential temperature of 65° C. in the presence of SSC buffer, 1×SSC corresponding to 0.15 M NaCl and 0.05 M Na citrate. The washing steps, for example, can be the following: 2×SSC, at ambient temperature followed by two washes with 2×SSC, 0.5% SDS at 65° C.; 2×0.5×SSC, 0.5% SDS; at 65° C. for 10 minutes each.

The conditions of intermediate stringency, using, for example, a temperature of 42° C. in the presence of a 2×SSC buffer, or of less stringency, for example, a temperature of 37° C. in the presence of a 2×SSC buffer, respectively require a globally less significant complementarity for the hybridization between the two sequences.

The stringent hybridization conditions described above for a polynucleotide with a size of approximately 350 bases will be adapted by a person skilled in the art for oligonucleotides of greater or smaller size, according to the teachings of Sambrook et al., 1989.

Among the isolated and/or purified nucleotide sequences according to the invention, are those that can be used as a primer or probe in methods allowing the homologous sequences according to the invention to be obtained, these methods, such as the polymerase chain reaction (PCR), nucleic acid cloning, and sequencing, being well known to a person skilled in the art.

Among the isolated and/or purified nucleotide sequences according to the invention, those are again preferred that can be used as a primer or probe in methods allowing the presence of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928, one of their fragments, or one of their variants such as defined below to be diagnosed.

The nucleotide sequence fragments according to the invention can be obtained, for example, by specific amplification, such as PCR, or after digestion with appropriate restriction enzymes of nucleotide sequences according to the invention, these methods in particular being described in the work of Sambrook et al., 1989. Such representative fragments can likewise be obtained by chemical synthesis according to methods well known to persons of ordinary skill in the art.

Modified nucleotide sequence will be understood as meaning any nucleotide sequence obtained by mutagenesis according to techniques well known to a person skilled in the art, and containing modifications with respect to the normal sequences according to the invention, for example, mutations in the regulatory and/or promoter sequences of polypeptide expression, especially leading to a modification of the rate of expression of the polypeptide or to a modulation of the replicative cycle.

Modified nucleotide sequence will likewise be understood as meaning any nucleotide sequence coding for a modified polypeptide, such as defined below.

The present invention relates to nucleotide sequence comprising isolated and/or purified nucleotide sequences of *Alicyclobacillus acidocaldarius*, characterized in that they are selected from the sequences SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 or one of their fragments.

Embodiments of the invention likewise relate to isolated and/or purified nucleotide sequences characterized in that they comprise a nucleotide sequence selected from: a) at least one of a nucleotide sequence of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 or one of their fragments; b) a nucleotide sequence of a specific fragment of a sequence such as defined in a); c) a homologous nucleotide sequence having at least 80% identity with a sequence such as defined in a) or b); d) a complementary nucleotide sequence or sequence of RNA corresponding to a sequence such as defined in a), b) or c); and e) a nucleotide sequence modified by a sequence such as defined in a), b), c) or d).

Among the isolated and/or purified nucleotide sequences according to the invention are the nucleotide sequences of SEQ ID NOS: 13-17, 30-34, 47-51, 64-68, 81-85, 98-102, 115-119, 132-136, 149-153, 166-170, 183-187, 200-204, 217-221, 234-238, 251-255, 268-272, 285-289, 302-306, 319-323, 336-340, 353-357, 370-374, 387-391, 404-408, 421-425, 438-442, 445-459, 472-476, 489-493, 506-510, 523-527, 540-544, 557-561, 574-578, 591-595, 608-612, 625-629, 642-646, 659-663, 676-680, 693-697, 710-714, 727-731, 744-748, 761-765, 778-782, 795-799, 812-816, 829-833, 846-850, 863-867, 880-884, 897-901, 914-918, 931-935, 948-952, 965-969, 982-986, 999-1003, 1016-1020, 1033-1037, 1050-1054, 1067-1071, 1084-1088, 1101-1105, 1118-1122, 1135-1139, 1152-1156, 1169-1173, 1186-1190, 1203-1207, 1305-1309, 1322-1326, 1339-1343, 1356-1360, 1373-1377, 1390-1394, 1407-1411, 1424-1428, 1441-1445, 1458-1462, 1475-1479, 1492-1496, 1509-1513, 1526-1530, 1543-1547, 1560-1564, 1577-1581, 1594-1598, 1611-1615, 1628-1632, 1645-1649, 1662-1666, 1679-1683, 1696-1700, 1713-1717, 1730-1734, 1747-1751, 1764-1768, 1781-1785, 1798-1802, 1815-1819, 1832-1836, 1849-1853, 1866-1870, 1883-1887, 1900-1904, 1917-1921, 1934-1938, 1951-1955, 1968-1972, 1985-1989, 2002-2006, 2019-2023, 2036-2040, 2053-2057, 2070-2074, 2087-2091, 2104-2108, 2121-2125, 2138-2142, 2155-2159, 2172-2176, 2189-2193, 2206-2210, 2223-2227, 2240-2244, 2257-2261, 2274-2278, 2291-2295, 2308-2312, 2325-2329, 2342-2346, 2359-2363, 2376-2380, 2393-2397, 2410-2414, 2427-2431, 2529-2533, 2546-2550, 2563-2567, 2580-2584, 2614-2618, 2631-2635, 2648-2652, 2665-2669, 2682-2686, 2699-2703, 2716-2720, 2733-2737, 2750-2754, 2767-2771, 2784-2788, 2801-2805, 2818-2822, 2835-2839, 2852-2856, 2878-2882, 2888-2892, 2905-2909, 2922-2926, and 2939-2943, or fragments thereof and any isolated and/or purified nucleotide sequences which have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with the at least one of the sequences of SEQ ID NOS: 2, 19, 36, 53, 70, 87, 104, 121, 138, 155, 172, 189, 206, 223, 240, 257, 274, 291, 308,325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 or fragments thereof. The homologous sequences can comprise, for example, the sequences corresponding to the genomic sequences *Alicyclobacillus acidocaldarius*. In the same manner, these specific homologous sequences can correspond to variations linked to mutations within strains of *Alicyclobacillus acidocaldarius* and especially correspond to truncations, substitutions, deletions and/or additions of at least one nucleotide. As will be apparent to one of ordinary skill in the art, such homologues are easily created and identified using standard techniques and publicly available computer programs such as BLAST. As such, each homologue referenced above should be considered as set forth herein and fully described.

Embodiments of the invention comprise the isolated and/or purified polypeptides coded for by a nucleotide sequence according to the invention, or fragments thereof, whose sequence is represented by a fragment. Amino acid sequences corresponding to the isolated and/or purified polypeptides which can be coded for according to one of the three possible reading frames of at least one of the sequences of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928.

Embodiments of the invention likewise relate to the isolated and/or purified polypeptides, characterized in that they comprise a polypeptide selected from at least one of the amino acid sequences of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 or one of their fragments.

Among the isolated and/or purified polypeptides, according to embodiments of the invention, are the isolated and/or purified polypeptides of amino acid sequence SEQ ID NOS: 8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, 773-777, 790-794, 807-811, 824-828, 841-845, 858-862, 875-879, 892-896, 909-913, 926-930, 943-947, 960-964, 977-981, 994-998, 1011-1015, 1028-1032, 1045-1049, 1062-1066, 1079-1083, 1096-1100, 1113-1117, 1130-1134, 1147-1151, 1164-1168, 1181-1185, 1198-1202, 1300-1304, 1317-1321, 1334-1338, 1351-1355, 1368-1372, 1385-1389, 1402-1406, 1419-1423, 1436-1440, 1453-1457, 1470-1474, 1487-1491, 1504-1508, 1521-1525, 1538-1542, 1555-1559, 1572-1576, 1589-1593, 1606-1610, 1623-1627, 1640-1644, 1657-1661, 1674-1678, 1691-1695, 1708-1712, 1725-1729, 1742-1746, 1759-1763, 1776-1780, 1793-1797, 1810-1814, 1827-1831, 1844-1848, 1861-1865, 1878-1882, 1895-1899, 1912-1916, 1929-1933, 1946-1950, 1963-1967, 1980-1984, 1997-2001, 2014-2018, 2031-2035, 2048-2052, 2065-2069, 2082-2086, 2099-2103, 2116-2120, 2133-2137, 2150-2154, 2167-2171, 2184-2188, 2201-2205, 2218-2222, 2235-2239, 2252-2256, 2269-2273, 2286-2290, 2303-2307, 2320-2324, 2337-2341, 2354-2358, 2371-2375, 2388-2392, 2405-2409, 2422-2426, 2524-2528, 2541-2545, 2558-2562, 2575-2579, 2609-2613, 2626-2630, 2643-2647, 2660-2664, 2677-2681, 2694-2698, 2711-2715, 2728-2732, 2745-2749, 2762-2766, 2779-2783, 2796-2800, 2813-2817, 2830-2834, 2847-2851, 2866-2870, 2883-2887, 2900-2914, 2917-2921, and 2934-2938, or fragments thereof or any other isolated and/or purified polypeptides which have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with at least one of the sequences of SEQ ID NOS. 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 or fragments thereof. As will be apparent to one of ordinary skill in the art, such homologues are easily created and identified using standard techniques and publicly available computer programs such as BLAST. As such, each homologue referenced above should be considered as set forth herein and fully described.

Embodiments of the invention also relate to the polypeptides, characterized in that they comprise a polypeptide selected from: a) a specific fragment of at least 5 amino acids of a polypeptide of an amino acid sequence according to the invention; b) a polypeptide homologous to a polypeptide such as defined in a); c) a specific biologically active fragment of a polypeptide such as defined in a) or b); and d) a polypeptide modified by a polypeptide such as defined in a), b) or c).

In the present description, the terms polypeptide, peptide and protein are interchangeable.

In embodiments of the invention, the isolated and/or purified polypeptides according to the invention may be glycosylated, pegylated, and/or otherwise post-translationally modified. In further embodiments, glycosylation, pegylation, and/or other post-translational modifications may occur in vivo or in vitro and/or may be performed using chemical techniques. In additional embodiments, any glycosylation, pegylation and/or other post-translational modifications may be N-linked or O-linked.

In embodiments of the invention any one of the isolated and/or purified polypeptides according to the invention may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other post-translational modification may be required for the isolated and/or purified polypeptides according to the invention to be enzymatically or functionally active at a pH at or below 8, 7, 6, 5, 4, 3, 2, 1, and/or 0 or at temperatures at or above about 25, 30, 35, 40, 45, 50, 55, 60, 65, 70, 75, 80, 85, 90, and/or 95 degrees Celsius.

Aspects of the invention relate to polypeptides that are isolated or obtained by purification from natural sources, or else obtained by genetic recombination, or alternatively by chemical synthesis and that they may thus contain unnatural amino acids, as will be described below.

A "polypeptide fragment" according to the embodiments of the invention is understood as designating a polypeptide containing at least 5 consecutive amino acids, preferably 10 consecutive amino acids or 15 consecutive amino acids.

In the present invention, a specific polypeptide fragment is understood as designating the consecutive polypeptide fragment coded for by a specific fragment nucleotide sequence according to the invention.

"Homologous polypeptide" will be understood as designating the polypeptides having, with respect to the natural polypeptide, certain modifications such as, in particular, a deletion, addition, or substitution of at least one amino acid, a truncation, a prolongation, a chimeric fusion, and/or a mutation. Among the homologous polypeptides, those are preferred whose amino acid sequence has at least 80% or 90%, homology with the sequences of amino acids of polypeptides according to the invention.

"Specific homologous polypeptide" will be understood as designating the homologous polypeptides such as defined above and having a specific fragment of polypeptide according to the invention.

In the case of a substitution, one or more consecutive or nonconsecutive amino acids are replaced by "equivalent" amino acids. The expression "equivalent" amino acid is directed here at designating any amino acid capable of being substituted by one of the amino acids of the base structure without, however, essentially modifying the biological activities of the corresponding peptides and such that they will be defined by the following. As will be apparent to one of ordinary skill in the art, such substitutions are easily created and identified using standard molecular biology techniques and publicly available computer programs such as BLAST. As such, each substitution referenced above should be considered as set forth herein and fully described. Examples of such substitutions in the amino acid sequences SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 may include those isolated and/or purified polypeptides of amino acid sequence SEQ ID NOS: 8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, 773-777, 790-794, 807-811, 824-828, 841-845, 858-862, 875-879, 892-896, 909-913, 926-930, 943-947, 960-964, 977-981, 994-998, 1011-1015, 1028-1032, 1045-1049, 1062-1066, 1079-1083, 1096-1100, 1113-1117, 1130-1134, 1147-1151, 1164-1168, 1181-1185, 1198-1202, 1300-1304, 1317-1321, 1334-1338, 1351-1355, 1368-1372, 1385-1389, 1402-1406, 1419-1423, 1436-1440, 1453-1457, 1470-1474, 1487-1491, 1504-1508, 1521-1525, 1538-1542, 1555-1559, 1572-1576, 1589-1593, 1606-1610, 1623-1627, 1640-1644, 1657-1661, 1674-1678, 1691-1695, 1708-1712, 1725-1729, 1742-1746, 1759-1763, 1776-1780, 1793-1797, 1810-1814, 1827-1831, 1844-1848, 1861-1865, 1878-1882, 1895-1899, 1912-1916, 1929-1933, 1946-1950, 1963-1967, 1980-1984, 1997-2001, 2014-2018, 2031-2035, 2048-2052, 2065-2069, 2082-2086, 2099-2103, 2116-2120, 2133-2137, 2150-2154, 2167-2171, 2184-2188, 2201-2205, 2218-2222, 2235-2239, 2252-2256, 2269-2273, 2286-2290, 2303-2307, 2320-2324, 2337-2341, 2354-2358, 2371-2375, 2388-2392, 2405-2409, 2422-2426, 2524-2528, 2541-2545, 2558-2562, 2575-2579, 2609-2613, 2626-2630, 2643-2647, 2660-2664, 2677-2681, 2694-2698, 2711-2715, 2728-2732, 2745-2749, 2762-2766, 2779-2783, 2796-2800, 2813-2817, 2830-2834, 2847-2851, 2866-2870, 2883-2887, 2900-2914, 2917-2921, and 2934-2938.

These equivalent amino acids can be determined either by depending on their structural homology with the amino acids, which they substitute, or on results of comparative tests of biological activity between the different polypeptides, which are capable of being carried out.

By way of non-limiting example, the possibilities of substitutions capable of being carried out without resulting in an extensive modification of the biological activity of the corresponding modified polypeptides will be mentioned, the replacement, for example, of leucine by valine or isoleucine, of aspartic acid by glutamic acid, of glutamine by asparagine, of arginine by lysine, etc., the reverse substitutions naturally being envisageable under the same conditions.

In a further embodiment, substitutions are limited to substitutions in amino acids not conserved among other proteins which have similar identified activity. For example, one of ordinary skill in the art may align proteins of the same function in similar organisms and determine which amino acids are generally conserved among proteins of that function. One example of a program that may be used to generate such alignments is available at the website charite.de/bioinf/strap/ in conjunction with the databases provided by the NCBI. Examples of such polypeptides may include, but are not limited to, those found in amino acid sequence SEQ ID NOS: 8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, 773-777, 790-794, 807-811, 824-828, 841-845, 858-862, 875-879, 892-896, 909-913, 926-930, 943-947, 960-964, 977-981, 994-998, 1011-1015, 1028-1032, 1045-1049, 1062-1066, 1079-1083, 1096-1100, 1113-1117, 1130-1134, 1147-1151, 1164-1168, 1181-1185, 1198-1202, 1300-1304, 1317-1321, 1334-1338, 1351-1355, 1368-1372, 1385-1389, 1402-1406, 1419-1423, 1436-1440, 1453-1457, 1470-1474, 1487-1491, 1504-1508, 1521-1525, 1538-1542, 1555-1559, 1572-1576, 1589-1593, 1606-1610, 1623-1627, 1640-1644, 1657-1661, 1674-1678, 1691-1695, 1708-1712, 1725-1729, 1742-1746, 1759-1763, 1776-1780, 1793-1797, 1810-1814, 1827-1831, 1844-1848, 1861-1865, 1878-1882, 1895-1899, 1912-1916, 1929-1933, 1946-1950, 1963-1967, 1980-1984, 1997-2001, 2014-2018, 2031-2035, 2048-2052, 2065-2069, 2082-2086, 2099-2103, 2116-2120, 2133-2137, 2150-2154, 2167-2171, 2184-2188, 2201-2205, 2218-2222, 2235-2239, 2252-2256, 2269-2273, 2286-2290, 2303-2307, 2320-2324, 2337-2341, 2354-2358, 2371-2375, 2388-2392, 2405-2409, 2422-2426, 2524-2528, 2541-2545, 2558-2562, 2575-2579, 2609-2613, 2626-2630, 2643-2647, 2660-2664, 2677-2681, 2694-2698, 2711-2715, 2728-2732, 2745-2749, 2762-2766, 2779-2783, 2796-2800, 2813-2817, 2830-2834, 2847-2851, 2866-2870, 2883-2887, 2900-2914, 2917-2921, and 2934-2938.

Thus, according to one embodiment of the invention, substitutions or mutations may be made at positions that are generally conserved among proteins of that function. In a further embodiment, nucleic acid sequences may be mutated or substituted such that the amino acid they code for is unchanged (degenerate substitutions and/or mutations) and/or mutated or substituted such that any resulting amino acid substitutions or mutations are made at positions that are generally conserved among proteins of that function. Examples of such nucleic acid sequences may include, but are not limited to, those found in are the nucleotide sequences of SEQ ID NOS: 13-17, 30-34, 47-51, 64-68, 81-85, 98-102, 115-119, 132-136, 149-153, 166-170, 183-187, 200-204, 217-221, 234-238, 251-255, 268-272, 285-289, 302-306, 319-323, 336-340, 353-357, 370-374, 387-391, 404-408, 421-425, 438-442, 455-459, 472-476, 489-493, 506-510, 523-527, 540-544, 557-561, 574-578, 591-595, 608-612, 625-629, 642-646, 659-663, 676-680, 693-697, 710-714, 727-731, 744-748, 761-765, 778-782, 795-799, 812-816, 829-833, 846-850, 863-867, 880-884, 897-901, 914-918, 931-935, 948-952, 965-969, 982-986, 999-1003, 1016-1020, 1033-1037, 1050-1054, 1067-1071, 1084-1088, 1101-1105, 1118-1122, 1135-1139, 1152-1156, 1169-1173, 1186-1190, 1203-1207, 1305-1309, 1322-1326, 1339-1343, 1356-1360, 1373-1377, 1390-1394, 1407-1411, 1424-1428, 1441-1445, 1458-1462, 1475-1479, 1492-1496, 1509-1513, 1526-1530, 1543-1547, 1560-1564, 1577-1581, 1594-1598, 1611-1615, 1628-1632, 1645-1649, 1662-1666, 1679-1683, 1696-1700, 1713-1717, 1730-1734, 1747-1751, 1764-1768, 1781-1785, 1798-1802, 1815-1819, 1832-1836, 1849-1853, 1866-1870, 1883-1887, 1900-1904, 1917-1921, 1934-1938, 1951-1955, 1968-1972, 1985-1989, 2002-2006, 2019-2023, 2036-2040, 2053-2057, 2070-2074, 2087-2091, 2104-2108, 2121-2125, 2138-2142, 2155-2159, 2172-2176, 2189-2193, 2206-2210, 2223-2227, 2240-2244, 2257-2261, 2274-2278, 2291-2295, 2308-2312, 2325-2329, 2342-2346, 2359-2363, 2376-2380, 2393-2397, 2410-2414, 2427-2431, 2529-2533, 2546-2550, 2563-2567, 2580-2584, 2614-2618, 2631-2635, 2648-2652, 2665-2669, 2682-2686, 2699-2703, 2716-2720, 2733-2737, 2750-2754, 2767-2771, 2784-2788, 2801-2805, 2818-2822, 2835-2839, 2852-2856, 2878-2882, 2888-2892, 2905-2909, 2922-2926, and 2939-2943 or fragments thereof.

The specific homologous polypeptides likewise correspond to polypeptides coded for by the specific homologous nucleotide sequences such as defined above and thus comprise in the present definition the polypeptides, which are mutated or correspond to variants that can exist in *Alicyclobacillus acidocaldarius*, and which especially correspond to truncations, substitutions, deletions, and/or additions of at least one amino acid residue.

"Specific biologically active fragment of a polypeptide" according to an embodiment of the invention will be understood in particular as designating a specific polypeptide fragment, such as defined above, having at least one of the characteristics of polypeptides according to the invention. In certain embodiments the peptide is capable of behaving as at least one of the types of proteins outlined in Table 1.

The polypeptide fragments according to embodiments of the invention can correspond to isolated or purified fragments naturally present in *Alicyclobacillus acidocaldarius* or correspond to fragments that can be obtained by cleavage of the polypeptide by a proteolytic enzyme, such as trypsin or chymotrypsin or collagenase, or by a chemical reagent, such as cyanogen bromide (CNBr). Such polypeptide fragments can likewise just as easily be prepared by chemical synthesis, from hosts transformed by an expression vector according to the invention containing a nucleic acid allowing the expression of the fragments, placed under the control of appropriate regulation and/or expression elements.

"Modified polypeptide" of a polypeptide according to an embodiment of the invention is understood as designating a polypeptide obtained by genetic recombination or by chemical synthesis as will be described below, having at least one modification with respect to the normal sequence. These modifications may or may not be able to bear on amino acids at the origin of specificity, and/or of activity, or at the origin of the structural conformation, localization, and of the capacity of membrane insertion of the polypeptide according to the invention. It will thus be possible to create polypeptides of equivalent, increased, or decreased activity, and of equivalent, narrower, or wider specificity. Among the modified polypeptides, it is necessary to mention the polypeptides in which up to 5 or more amino acids can be modified, truncated at the N- or C-terminal end, or even deleted or added.

The methods allowing the modulations on eukaryotic or prokaryotic cells to be demonstrated are well known to a person of ordinary skill in the art. It is likewise well understood that it will be possible to use the nucleotide sequences coding for the modified polypeptides for the modulations, for example, through vectors according to the invention and described below.

The preceding modified polypeptides can be obtained by using combinatorial chemistry, in which it is possible to systematically vary parts of the polypeptide before testing them on models, cell cultures or microorganisms, for example, to select the compounds that are most active or have the properties sought.

Chemical synthesis likewise has the advantage of being able to use unnatural amino acids, or nonpeptide bonds.

Thus, in order to improve the duration of life of the polypeptides, according to the invention, it may be of interest to use unnatural amino acids, for example, in D form, or else amino acid analogs, especially sulfur-containing forms, for example.

Finally, it will be possible to integrate the structure of the polypeptides according to the invention, its specific or modified homologous forms, into chemical structures of polypeptide type or others. Thus, it may be of interest to provide at the N- and C-terminal ends compounds not recognized by proteases.

The nucleotide sequences coding for a polypeptide according to the invention are likewise part of the invention.

The invention likewise relates to nucleotide sequences utilizable as a primer or probe, characterized in that the sequences are selected from the nucleotide sequences according to the invention.

It is well understood that the present invention, in various embodiments, likewise relates to specific polypeptides of *Alicyclobacillus acidocaldarius*, coded for by nucleotide sequences, capable of being obtained by purification from natural polypeptides, by genetic recombination or by chemical synthesis by procedures well known to a person skilled in the art and such as described in particular below. In the same manner, the labeled or unlabeled mono- or polyclonal antibodies directed against the specific polypeptides coded for by the nucleotide sequences are also encompassed by the invention.

Embodiments of the invention additionally relate to the use of a nucleotide sequence according to the invention as a primer or probe for the detection and/or the amplification of nucleic acid sequences.

The nucleotide sequences according to embodiments of the invention can thus be used to amplify nucleotide sequences, especially by the PCR technique (polymerase chain reaction) (Erlich, 1989; Innis et al., 1990; Rolfs et al., 1991; and White et al., 1997).

These oligodeoxyribonucleotide or oligoribonucleotide primers advantageously have a length of at least 8 nucleotides, preferably of at least 12 nucleotides, and even more preferentially of at least 20 nucleotides.

Other amplification techniques of the target nucleic acid can be advantageously employed as alternatives to PCR.

The nucleotide sequences of the invention, in particular the primers according to the invention, can likewise be employed in other procedures of amplification of a target nucleic acid, such as: the TAS technique (Transcription-based Amplification System), described by Kwoh et al. in 1989; the 3SR technique (Self-Sustained Sequence Replication), described by Guatelli et al. in 1990; the NASBA technique (Nucleic Acid Sequence Based Amplification), described by Kievitis et al. in 1991; the SDA technique (Strand Displacement Amplification) (Walker et al., 1992); and the TMA technique (Transcription Mediated Amplification).

The polynucleotides of the invention can also be employed in techniques of amplification or of modification of the nucleic acid serving as a probe, such as: the LCR technique (Ligase Chain Reaction), described by Landegren et al. in 1988 and improved by Barany et al. in 1991, which employs a thermostable ligase; the RCR technique (Repair Chain Reaction), described by Segev in 1992; the CPR technique (Cycling Probe Reaction), described by Duck et al. in 1990; the amplification technique with Q-beta replicase, described by Miele et al. in 1983 and especially improved by Chu et al. in 1986, Lizardi et al. in 1988, then by Burg et al., as well as by Stone et al. in 1996.

In the case where the target polynucleotide to be detected is possibly an RNA, for example, an mRNA, it will be possible to use, prior to the employment of an amplification reaction with the aid of at least one primer according to the invention or to the employment of a detection procedure with the aid of at least one probe of the invention, an enzyme of reverse transcriptase type in order to obtain a cDNA from the RNA contained in the biological sample. The cDNA obtained will thus serve as a target for the primer(s) or the probe(s) employed in the amplification or detection procedure according to the invention.

The detection probe will be chosen in such a manner that it hybridizes with the target sequence or the amplicon generated from the target sequence. By way of sequence, such a probe will advantageously have a sequence of at least 12 nucleotides, in particular of at least 20 nucleotides, and preferably of at least 100 nucleotides.

Embodiments of the invention also comprise the nucleotide sequences utilizable as a probe or primer according to the invention, characterized in that they are labeled with a radioactive compound or with a nonradioactive compound.

The unlabeled nucleotide sequences can be used directly as probes or primers, although the sequences are generally labeled with a radioactive isotope ($^{32}P$, $^{35}S$, $^{3}H$, $^{125}I$) or with a nonradioactive molecule (biotin, acetylaminofluorene, digoxigenin, 5-bromodeoxyuridine, fluorescein) to obtain probes, which are utilizable for numerous applications.

Examples of nonradioactive labeling of nucleotide sequences are described, for example, in French Patent No. 7810975 or by Urdea et al. or by Sanchez-Pescador et al. in 1988.

In the latter case, it will also be possible to use one of the labeling methods described in patents FR-2 422 956 and FR-2 518 755.

The hybridization technique can be carried out in various manners (Matthews et al., 1988). The most general method consists in immobilizing the nucleic acid extract of cells on a support (such as nitrocellulose, nylon, polystyrene) and in incubating, under well-defined conditions, the immobilized target nucleic acid with the probe. After hybridization, the excess of probe is eliminated and the hybrid molecules formed are detected by the appropriate method (measurement of the radioactivity, of the fluorescence or of the enzymatic activity linked to the probe).

The invention, in various embodiments, likewise comprises the nucleotide sequences according to the invention, characterized in that they are immobilized on a support, covalently or noncovalently.

According to another advantageous mode of employing nucleotide sequences according to the invention, the latter can be used immobilized on a support and can thus serve to capture, by specific hybridization, the target nucleic acid obtained from the biological sample to be tested. If necessary, the solid support is separated from the sample and the hybridization complex formed between the capture probe and the target nucleic acid is then detected with the aid of a second probe, a so-called detection probe, labeled with an easily detectable element.

Another aspect of the present invention is a vector for the cloning and/or expression of a sequence, characterized in that it contains a nucleotide sequence according to the invention.

The vectors, according to the invention, characterized in that they contain the elements allowing the integration, expression and/or the secretion of the nucleotide sequences in a determined host cell, are likewise part of the invention.

The vector may then contain a promoter, signals of initiation and termination of translation, as well as appropriate regions of regulation of transcription. It may be able to be maintained stably in the host cell and can optionally have particular signals specifying the secretion of the translated protein. These different elements may be chosen as a function of the host cell used. To this end, the nucleotide sequences according to the invention may be inserted into autonomous replication vectors within the chosen host, or integrated vectors of the chosen host.

Such vectors will be prepared according to the methods currently used by a person skilled in the art, and it will be possible to introduce the clones resulting therefrom into an appropriate host by standard methods, such as, for example, lipofection, electroporation, and thermal shock.

The vectors according to the invention are, for example, vectors of plasmid or viral origin. One example of a vector for the expression of polypeptides of the invention is *Baculovirus*.

These vectors are useful for transforming host cells in order to clone or to express the nucleotide sequences of the invention.

The invention likewise comprises the host cells transformed by a vector according to the invention.

These cells can be obtained by the introduction into host cells of a nucleotide sequence inserted into a vector such as defined above, then the culturing of the cells under conditions allowing the replication and/or expression of the transfected nucleotide sequence.

The host cell can be selected from prokaryotic or eukaryotic systems, such as, for example, bacterial cells (Olins and Lee, 1993), but likewise yeast cells (Buckholz, 1993), as well as plants cells, such as *Arabidopsis* sp., and animal cells, in particular the cultures of mammalian cells (Edwards and Aruffo, 1993), for example, Chinese hamster ovary (CHO) cells, but likewise the cells of insects in which it is possible to use procedures employing baculoviruses, for example, Sf9 insect cells (Luckow, 1993).

Embodiments of the invention likewise relate to organisms comprising one of the transformed cells according to the invention.

The obtainment of transgenic organisms, according to the invention, of expressing one or more of the genes of *Alicyclobacillus acidocaldarius* or part of the genes may be carried out in, for example, rats, mice, or rabbits according to methods well known to a person skilled in the art, such as by viral or nonviral transfections. It will be possible to obtain the transgenic organisms expressing one or more of the genes by transfection of multiple copies of the genes under the control of a strong promoter of ubiquitous nature, or selective for one type of tissue. It will likewise be possible to obtain the transgenic organisms by homologous recombination in embryonic cell strains, transfer of these cell strains to embryos, selection of the affected chimeras at the level of the reproductive lines, and growth of the chimeras.

The transformed cells, as well as the transgenic organisms according to the invention, are utilizable in procedures for preparation of recombinant polypeptides.

It is today possible to produce recombinant polypeptides in relatively large quantity by genetic engineering using the cells transformed by expression vectors according to the invention or using transgenic organisms according to the invention.

The procedures for preparation of a polypeptide of the invention in recombinant form, characterized in that they employ a vector and/or a cell transformed by a vector according to the invention and/or a transgenic organism comprising one of the transformed cells according to the invention are themselves comprised in the present invention.

As used herein, "transformation" and "transformed" relate to the introduction of nucleic acids into a cell, whether prokaryotic or eukaryotic. Further, "transformation" and "transformed," as used herein, need not relate to growth control or growth deregulation.

Among the procedures for preparation of a polypeptide of the invention in recombinant form, the preparation procedures employing a vector, and/or a cell transformed by the vector and/or a transgenic organism comprising one of the transformed cells, containing a nucleotide sequence according to the invention coding for a polypeptide of *Alicyclobacillus acidocaldarius*.

A variant according to the invention may consist of producing a recombinant polypeptide fused to a "carrier" protein (chimeric protein). The advantage of this system is that it may allow stabilization of and/or a decrease in the proteolysis of the recombinant product, an increase in the solubility in the course of renaturation *in vitro* and/or a simplification of the purification when the fusion partner has an affinity for a specific ligand.

More particularly, the invention relates to a procedure for preparation of a polypeptide of the invention comprising the following steps: a) culture of transformed cells under conditions allowing the expression of a recombinant polypeptide of a nucleotide sequence according to the invention; b) if need be, recovery of the recombinant polypeptide.

When the procedure for preparation of a polypeptide of the invention employs a transgenic organism according to the invention, the recombinant polypeptide is then extracted from the organism.

The invention also relates to a polypeptide that is capable of being obtained by a procedure of the invention, such as described previously.

The invention also comprises a procedure for preparation of a synthetic polypeptide, characterized in that it uses a sequence of amino acids of polypeptides according to the invention.

The invention likewise relates to a synthetic polypeptide obtained by a procedure according to the invention.

The polypeptides according to the invention can likewise be prepared by techniques that are conventional in the field of the synthesis of peptides. This synthesis can be carried out in homogeneous solution or in solid phase.

For example, recourse can be made to the technique of synthesis in a homogeneous solution described by Houben-Weyl in 1974.

This method of synthesis consists in successively condensing, two by two, the successive amino acids in the order required, or in condensing amino acids and fragments formed previously and already containing several amino acids in the appropriate order, or alternatively several fragments previously prepared in this way, it being understood that it will be necessary to protect beforehand all the reactive functions carried by these amino acids or fragments, with the exception of amine functions of one and carboxyls of the other or vice-versa, which must normally be involved in the formation of peptide bonds, especially after activation of the carboxyl function, according to the methods well known in the synthesis of peptides.

Recourse may also be made to the technique described by Merrifield.

To make a peptide chain according to the Merrifield procedure, recourse is made to a very porous polymeric resin, on which is immobilized the first C-terminal amino acid of the chain. This amino acid is immobilized on a resin through its carboxyl group and its amine function is protected. The amino acids that are going to form the peptide chain are thus immobilized, one after the other, on the amino group, which is deprotected beforehand each time, of the portion of the peptide chain already formed, and which is attached to the resin. When the whole of the desired peptide chain has been formed, the protective groups of the different amino acids forming the peptide chain are eliminated and the peptide is detached from the resin with the aid of an acid.

The invention additionally relates to hybrid polypeptides having at least one polypeptide according to the invention, and a sequence of a polypeptide capable of inducing an immune response in man or animals.

Advantageously, the antigenic determinant is such that it is capable of inducing a humoral and/or cellular response.

It will be possible for such a determinant to comprise a polypeptide according to the invention in glycosylated, pegylated, and/or otherwise post-translationally modified form used with a view to obtaining immunogenic compositions capable of inducing the synthesis of antibodies directed against multiple epitopes.

These hybrid molecules can be formed, in part, of a polypeptide carrier molecule or of fragments thereof according to the invention, associated with a possibly immunogenic part, in particular, an epitope of the diphtheria toxin, the tetanus toxin, a surface antigen of the hepatitis B virus (Patent FR 79 21811), the VP 1 antigen of the poliomyelitis virus or any other viral or bacterial toxin or antigen.

The procedures for synthesis of hybrid molecules encompass the methods used in genetic engineering for constructing hybrid nucleotide sequences coding for the polypeptide sequences sought. It will be possible, for example, to refer advantageously to the technique for obtainment of genes coding for fusion proteins described by Minton in 1984.

The hybrid nucleotide sequences coding for a hybrid polypeptide as well as the hybrid polypeptides according to the invention characterized in that they are recombinant polypeptides obtained by the expression of the hybrid nucleotide sequences are likewise part of the invention.

The invention likewise comprises the vectors characterized in that they contain one of the hybrid nucleotide sequences. The host cells transformed by the vectors, the transgenic organisms comprising one of the transformed cells as well as the procedures for preparation of recombinant polypeptides using the vectors, the transformed cells and/or the transgenic organisms are, of course, likewise part of the invention.

The polypeptides according to the invention, the antibodies according to the invention described below and the nucleotide sequences according to the invention can advantageously be employed in procedures for the detection and/or identification of *Alicyclobacillus acidocaldarius*, in a sample capable of containing them. These procedures, according to the specificity of the polypeptides, the antibodies and the nucleotide sequences according to the invention that will be used, will in particular be able to detect and/or to identify *Alicyclobacillus acidocaldarius*.

The polypeptides according to the invention can advantageously be employed in a procedure for the detection and/or the identification of *Alicyclobacillus acidocaldarius* in a sample capable of containing them, characterized in that it comprises the following steps: a) contacting of this sample with a polypeptide or one of its fragments according to the invention (under conditions allowing an immunological reaction between the polypeptide and the antibodies possibly present in the biological sample); and b) demonstration of the antigen-antibody complexes possibly formed.

Any conventional procedure can be employed for carrying out such a detection of the antigen-antibody complexes possibly formed.

By way of example, a preferred method brings into play immunoenzymatic processes according to the ELISA technique, by immunofluorescence, or radioimmunological processes (RIA) or their equivalent.

Thus, the invention likewise relates to the polypeptides according to the invention, labeled with the aid of an adequate label, such as, of the enzymatic, fluorescent or radioactive type.

Such methods comprise, for example, the following steps: deposition of determined quantities of a polypeptide composition according to the invention in the wells of a microtiter plate, introduction into the wells of increasing dilutions of serum, or of a biological sample other than that defined previously, having to be analyzed, incubation of the wells of the microtiter plate, introduction into the wells of the microtiter plate of labeled antibodies directed against pig immunoglobulins, the labeling of these antibodies having been carried out with the aid of an enzyme selected from those which are capable of hydrolyzing a substrate by modifying the absorption of the radiation of the latter, at least at a determined wavelength, for example, at 550 nm, detection, by comparison with a control test, of the quantity of hydrolyzed substrate.

The polypeptides according to the invention allow monoclonal or polyclonal antibodies to be prepared which are characterized in that they specifically recognize the polypeptides according to the invention. It will advantageously be possible to prepare the monoclonal antibodies from hybridomas according to the technique described by Kohler and Milstein in 1975. It will be possible to prepare the polyclonal antibodies, for example, by immunization of an animal, in particular a mouse, with a polypeptide or a DNA, according to the invention, associated with an adjuvant of the immune response, and then purification of the specific antibodies contained in the serum of the immunized animals on an affinity column on which the polypeptide, which has served as an antigen, has previously been immobilized. The polyclonal antibodies according to the invention can also be prepared by purification, on an affinity column on which a polypeptide according to the invention has previously been immobilized, of the antibodies contained in the serum of an animal immunologically challenged by *Alicyclobacillus acidocaldarius*, or a polypeptide or fragment according to the invention.

The invention likewise relates to mono- or polyclonal antibodies or their fragments, or chimeric antibodies, characterized in that they are capable of specifically recognizing a polypeptide according to the invention.

It will likewise be possible for the antibodies of the invention to be labeled in the same manner as described previously for the nucleic probes of the invention, such as a labeling of enzymatic, fluorescent or radioactive type.

The invention is additionally directed at a procedure for the detection and/or identification of *Alicyclobacillus acidocaldarius* in a sample, characterized in that it comprises the following steps: a) contacting of the sample with a mono- or polyclonal antibody according to the invention (under conditions allowing an immunological reaction between the antibodies and the polypeptides of *Alicyclobacillus acidocaldarius* possibly present in the biological sample); and b) demonstration of the antigen-antibody complex possibly formed.

The present invention likewise relates to a procedure for the detection and/or the identification of *Alicyclobacillus acidocaldarius* in a sample, characterized in that it employs a nucleotide sequence according to the invention.

More particularly, the invention relates to a procedure for the detection and/or the identification of *Alicyclobacillus acidocaldarius* in a sample, characterized in that it contains the following steps: a) if need be, isolation of the DNA from the sample to be analyzed; b) specific amplification of the DNA of the sample with the aid of at least one primer, or a pair of primers, according to the invention; and c) demonstration of the amplification products.

These can be detected, for example, by the technique of molecular hybridization utilizing a nucleic probe according to the invention. This probe will advantageously be labeled with a nonradioactive (cold probe) or radioactive isotope.

For the purposes of the present invention, "DNA of the biological sample" or "DNA contained in the biological sample" will be understood as meaning either the DNA present in the biological sample considered, or possibly the cDNA obtained after the action of an enzyme of reverse transcriptase type on the RNA present in the biological sample.

A further embodiment of the invention comprises a method, characterized in that it comprises the following steps: a) contacting of a nucleotide probe according to the invention with a biological sample, the DNA contained in the biological sample having, if need be, previously been made accessible to hybridization under conditions allowing the hybridization of the nucleotide probe with the DNA of the sample; and b) demonstration of the hybrid formed between the nucleotide probe and the DNA of the biological sample.

The present invention also relates to a procedure according to the invention, characterized in that it comprises the following steps: a) contacting of a nucleotide probe immobilized on a support according to the invention with a biological sample, the DNA of the sample having, if need be, previously been made accessible to hybridization, under conditions allowing the hybridization of the nucleotide probe with the DNA of the sample; b) contacting of the hybrid formed between the nucleotide probe immobilized on a support and the DNA contained in the biological sample, if need be after elimination of the DNA of the biological sample which has not hybridized with the nucleotide probe, with a nucleotide probe labeled according to the invention; and c) demonstration of the novel hybrid formed in step b).

According to an advantageous embodiment of the procedure for detection and/or identification defined previously, this is characterized in that, prior to step a), the DNA of the biological sample is first amplified with the aid of at least one primer according to the invention.

Embodiments of methods include placing a recombinant, purified, and/or isolated polypeptide selected from the group consisting of a polypeptide having at least 90% sequence identity to SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 in, or replacing a component, of an in-vitro transcription system such as, by way of non-limiting example, a polymerase chain reaction or a reticulocyte lysate transcription/translation system.

Further embodiments of methods include placing a cell producing or encoding a recombinant, purified, and/or isolated nucleotide sequence comprising a nucleotide sequence selected from the group consisting of a nucleotide sequence having at least 90% sequence identity to at least one of the sequences of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 and/or a recombinant, purified, and/or isolated polypeptide selected from the group consisting of a polypeptide having at least 90% sequence identity to at least one of the sequences of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 in an environment comprising temperatures at or above about 25, 30, 35, 40, 45, 50, 55, 60, 65, 70, 75, 80, 85, 90, and/or 95 degrees Celsius and/or a pH at, below, and/or above 8, 7, 6, 5, 4, 3, 2, 1, and/or 0.

The present invention provides cells that have been genetically manipulated to have an altered capacity to produce expressed proteins. In particular, the present invention relates to Gram-positive microorganisms, such as *Bacillus* species having enhanced expression of a protein of interest, wherein one or more chromosomal genes have been inactivated, and/or wherein one or more chromosomal genes have been deleted from the *Bacillus* chromosome. In some further embodiments, one or more indigenous chromosomal regions have been deleted from a corresponding wild-type *Bacillus* host chromosome. In further embodiments, the *Bacillus* is an *Alicyclobacillus* sp. or *Alicyclobacillus acidocaldarius*.

In additional embodiments, methods of modulating transcription or transcription or transcriptional control at temperatures at or above about 25, 30, 35, 40, 45, 50, 55, 60, 65, 70, 75, 80, 85, 90, and/or 95 degrees Celsius and/or at a pH at, below, and/or above 8, 7, 6, 5, 4, 3, 2, 1, and/or 0 via a recombinant, purified, and/or isolated nucleotide sequence comprising a nucleotide sequence selected from the group consisting of a nucleotide sequence having at least 90% sequence identity to at least one of the sequences of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 and/or a recombinant, purified, and/or isolated polypeptide selected from the group consisting of a polypeptide having at least 90% sequence identity to at least one of the sequences of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927.

Further embodiments of the invention may comprise a kit for modulating transcription or transcriptional control, the kit comprising a recombinant, purified, and/or isolated nucleotide sequence comprising a nucleotide sequence selected from the group consisting of a nucleotide sequences having at least 90% sequence identity to at least one of the sequences of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 and/or a recombinant, purified, and/or isolated polypeptide selected from the group consisting of a polypeptide having at least 90% sequence identity to at least one of the sequences of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927.

In embodiments of the invention any one of the isolated and/or purified polypeptides according to the invention may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other post-translational modification may be required for the isolated and/or purified polypeptides according to the invention to be enzymatically or functionally active at a pH at or below 8, 7, 6, 5, 4, 3, 2, 1, and/or 0 or at temperatures at or above about 25, 30, 35, 40, 45, 50, 55, 60, 65, 70, 75, 80, 85, 90, and/or 95 degrees Celsius.

The invention is described in additional detail in the following illustrative examples. Although the examples may represent only selected embodiments of the invention, it should be understood that the following examples are illustrative and not limiting.

EXAMPLES

Example 1

Transcription and Transcriptional Control Using Nucleotide and Amino Acid Sequences from *Alicyclobacillus Acidocaldarius*

Provided in SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 are a nucleotide sequences isolated from *Alicyclobacillus acidocaldarius* and coding for the polypeptides of SEQ ID NOS:

1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927. The nucleotide sequences of SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 are placed into expression vectors using techniques standard in the art. The vectors are then provided to cells such as bacteria cells or eukaryotic cells such as Sf9 cells or CHO cells. In conjunction with the normal machinery in present in the cells, the vectors comprising SEQ ID NOS: 2, 19, 36, 53, 70, 87, 104, 121, 138, 155, 172, 189, 206, 223, 240, 257, 274, 291, 308, 325, 342, 359, 376, 393, 410, 427, 444, 461, 478, 495, 512, 529, 546, 563, 580, 597, 614, 631, 648, 665, 682, 699, 716, 733, 750, 767, 784, 801, 818, 835, 852, 869, 886, 903, 920, 937, 954, 971, 988, 1005, 1022, 1039, 1056, 1073, 1090, 1107, 1124, 1141, 1158, 1175, 1192, 1294, 1311, 1328, 1345, 1362, 1379, 1396, 1413, 1430, 1447, 1464, 1481, 1498, 1515, 1532, 1549, 1566, 1583, 1600, 1617, 1634, 1651, 1668, 1685, 1702, 1719, 1736, 1753, 1770, 1787, 1804, 1821, 1838, 1855, 1872, 1889, 1906, 1923, 1940, 1957, 1974, 1991, 2008, 2025, 2042, 2059, 2076, 2093, 2110, 2127, 2144, 2161, 2178, 2195, 2212, 2229, 2246, 2263, 2280, 2297, 2314, 2331, 2348, 2365, 2382, 2399, 2416, 2518, 2535, 2552, 2569, 2603, 2620, 2637, 2654, 2671, 2688, 2705, 2722, 2739, 2756, 2773, 2790, 2807, 2824, 2841, 2857, 2858, 2860, 2877, 2894, 2911, and 2928 produce the polypeptides of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927. The polypeptides of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 are then isolated and/or purified. The isolated and/or purified polypeptides of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 are then each demonstrated to have one or more of the activities provided in Table 1.

The isolated and/or purified polypeptides of SEQ ID NOS: 1, 18, 35, 52, 69, 86, 103, 120, 137, 154, 171, 188, 205, 222, 239, 256, 273, 290, 307, 324, 341, 358, 375, 392, 409, 426, 443, 460, 477, 494, 511, 528, 545, 562, 579, 596, 613, 630, 647, 664, 681, 698, 715, 732, 749, 766, 783, 800, 817, 834, 851, 868, 885, 902, 819, 936, 953, 970, 987, 1004, 1021, 1038, 1055, 1072, 1089, 1106, 1123, 1140, 1157, 1174, 1191, 1293, 1310, 1327, 1344, 1361, 1378, 1395, 1412, 1429, 1446, 1463, 1480, 1497, 1514, 1531, 1548, 1565, 1582, 1599, 1616, 1633, 1650, 1667, 1684, 1701, 1718, 1735, 1752, 1769, 1786, 1803, 1820, 1837, 1854, 1871, 1888, 1905, 1922, 1939, 1956, 1973, 1990, 2007, 2024, 2041, 2058, 2075, 2092, 2109, 2126, 2143, 2160, 2177, 2194, 2211, 2228, 2245, 2262, 2279, 2296, 2313, 2330, 2347, 2364, 2381, 2398, 2415, 2517, 2534, 2551, 2568, 2602, 2619, 2636, 2653, 2670, 2687, 2704, 2721, 2738, 2755, 2772, 2789, 2806, 2823, 2840, 2859, 2876, 2893, 2910, and 2927 are placed in an extracellular transcription system and are demonstrated to have activity in transcription or modulating transcription.

Example 2

Transcriptional Control Using Catabolite-Responsive Elements from *Alicyclobacillus Acidocaldarius*

Provided in SEQ ID NOS: 2857, 2858, 2860, 2877, 2894, 2911, and 2928 are a nucleotide sequences isolated from *Alicyclobacillus acidocaldarius*. The nucleotide sequences of SEQ ID NOS: 2857, 2858, 2860, 2877, 2894, 2911, and 2928 are placed into expression vectors and functionally linked to a reporter gene using techniques standard in the art. The vectors are then provided to cells such as bacteria cells or eukaryotic cells such as Sf9 cells or CHO cells. In conjunction with the normal machinery in present in the cells, the vectors comprising SEQ ID NOS: 2857, 2858, 2860, 2877, 2894, 2911, and 2928 attempt to produce the protein coded for by the reporter gene in an environment designed to assay the function of a catabolite-responsive element. The cells are then assayed for the presence or absence and/or level of the reporter gene product. SEQ ID NOS: 2857, 2858, 2860, 2877, 2894, 2911, and 2928 are then each demonstrated to have activity as a catabolite-responsive element.

All references, including publications, patents, and patent applications, cited herein are hereby incorporated by reference to the same extent as if each reference were individually and specifically indicated to be incorporated by reference and were set forth in its entirety herein.

While this invention has been described in certain embodiments, the present invention can be further modified within the spirit and scope of this disclosure. This application is therefore intended to cover any variations, uses, or adaptations of the invention using its general principles. Further, this application is intended to cover such departures from the present disclosure as come within known or customary practice in the art to which this invention pertains and that fall within the limits of the appended claims and their legal equivalents.

BIBLIOGRAPHIC REFERENCES

Barany, F., 1911, PNAS. USA, 88:189-193.
Buckholz, R. G., 1993, Yeast systems for the expression of heterologous gene products. Curr. Op. Biotechnology 4: 538-542.
Burg, J. L. et al., 1996, Mol. and Cell. Probes, 10:257-271.
Chu, B. C. F. et al., 1986, NAR, 14:5591-5603.
Duck, P. et al., 1990, Biotechniques, 9:142-147.
Edwards, C. P., and Aruffo, A., 1993, Current applications of COS cell based transient expression systems. Curr. Op. Biotechnology 4:558-563.
Guateli, J. C. et al., 1990, PNAS USA, 87:1874-1878.
Houben-Weyl, 1974, in Methoden der Organischen Chemie, E. Wunsch ed., Volume 15-I and 15-II, Thieme, Stuttgart.
Innis, M. A. et al., 1990, in PCR Protocols. A guide to Methods and Applications, San Diego, Academic Press.
Kievitis, T. et al., 1991, J. Virol. Methods, 35:273-286.
Kohler, G. et al., 1975, Nature, 256(5517):495-497.
Kwoh, D. Y. et al., 1989, PNAS. USA, 86:1173-1177.
Luckow, V. A., 1993, Baculovirus systems for the expression of human gene products. Curr. Op. Biotechnology 4:564-572.
Matthews, J. A. et al., 1988, Anal. Biochem., 169:1-25.
Merrifield, R. D., 1966, J. Am. Chem. Soc., 88(21):5051-5052.
Miele, E. A. et al., 1983, J. Mol. Biol., 171:281-295.
Olins, P. O., and Lee, S. C., 1993, Recent advances in heterologous gene expression in $E.\ coli$. Curr. Op. Biotechnology 4:520-525.
Rolfs, A. et al., 1991, In PCR Topics. Usage of Polymerase Chain reaction in Genetic and Infectious Disease. Berlin: Springer-Verlag.
Sambrook, J. et al., 1989, In Molecular cloning: A Laboratory Manual. Cold Spring Harbor, N.Y.: Cold Spring Harbor Laboratory Press.
Sanchez-Pescador, R., 1988, J. Clin. Microbiol., 26(10): 1934-1938.
Segev D., 1992, in "Non-radioactive Labeling and Detection of Biomolecules." Kessler C. Berlin: Springer-Verlag, New York: 197-205.
Urdea, M. S., 1988, Nucleic Acids Research, II:4937-4957.
Walker, G. T. et al., 1992, NAR 20:1691-1696.
Walker, G. T. et al., 1992, PNAS USA, 89: 392-396.
White, B. A. et al., 1997, Methods in Molecular Biology, 67, Humana Press, Totowa, N.J.

SEQUENCE LISTING (2943 sequences)

SEQ ID NO: 1 - protein, 374 aa, Alicyclobacillus acidocaldarius
MGGDGMHIIRQFGVNWFTTVMGIGIVAALTYTSPIHLPFQHAVGEILFIGVNVVFVFAFAMWILRWLLTPDAAIDDFRHPGRALFYGAFAMGINVVGNDYFLIGTHMMPKHTAIAISFAIWLAGVAASVFSVIVVPYLLFTEHKVERDETVASWLIPLVPPIVAAATGTNLIPYAGGPGAQFSMTAGIVALFGMTFFLFIMTSALVYSRLVFHRRLSGQEAPTLWIEIGPIGMAMGTFCGIPLNAPHVFGPYFGGLRDLGAVFSIAMWGVGVWWILLSALYTFLHLTPKGDGLPFHLGWWSYVFPIGSFTNGTYALHRLLGHPFFAVAGLVQLGILWLCFAIVIVRTVHGVAAGHLIQWRRDHAHRHELKARRA

SEQ ID NO: 2 - DNA, 1125 bp, Alicyclobacillus acidocaldarius
gtgggaggtgacggaatgcacatcatacgtcagttcggcgtcaactggttcacgaccgtcatgggcatcggcattgtcgcggcgctcacctacacgtcgcccatccacctgccgttccagcacgcggtgggggagatcttgttcattggcgtcaatgtggtcttcgtcttcgcctttgcgatgtggattctgcgctggctgctcacgcccgacgccgccatcgacgatttccggcatccgggtcgggcgctgttttacggcgcgttcgcgatgggcatcaacgtcgtcggcaacgattactttctcatcggcacacatatgatgccgaagcataccgccatcgccatcagcttcgcgatttggctcgctggggtcgccgcatccgtgttctccgtcatcgtcgtgccgtatctgctcttcacagagcacaaggtggagcgagacgaaaccgtggcgtcctggctcatcccactcgttcctcccatcgtggcggcggccacgggcaccaatctcattccgtacgcggggggacctggcgcgcagttctccatgacggcaggcatcgtcgccctgttcggcatgacgttcttcctgttcatcatgacgagcgccttggtctattcgcgcctcgtgtttcacaggcggctcagcggccaagaggcgccgaccttgtggattgagattgggcccatcggcatggcgatgggcacgttctgcggcattccgctgaacgcccctcacgtcttcggcccctacttcggcggcctgcgcgatctcggcgctgtcttctccatcgccatgtggggcgtgggcgtctggtggatcctcctctcggcgctctacacgtttctgcacctgacgccgaagggcgacgggctgccatttcatctgggttggtggagctacgtcttccccatcggcagcttcaccaacggcacgtatgcgctccatcgcctgctcgggcacccgttcttcgccgtggctggcttggtgcagctcgggattttgtggctgtgtttcgccatcgtcatcgtgcgcacggttcacggcgtggccgcaggccacctgattcagtggcggcgcgatcacgcccatcgtcatgaactcaaagcgcgccgcgcgtga

SEQ ID NO: 3 - protein, 351 aa, Mycobacterium ulcerans Agy99
VEVLGNIGPNWFASVMGTGIVAVAGATLPVHVVGLRAFTQVVWVIAAALLLALIVLVGGHWLRHPTVARSHARNPQMAHFYGAAPMALMTVGADAVLAGGPLIGERLAVDLDWVLWTAGTIGGLFTAVSIPFLMFTQHRVEPDAAFGGWLMPVVPPMVSAATGALLLPHMPAGSGRETMLYGCYAMFGLSFVASLNIIAMIWSRLVLYGTSGTARVPTLWIVLGPLGQSITAAGLLGAAAATGAVDHELAETMQAFAIIFGVPVWGFAMLWIALSTALTVRTLRRGMPFALTWWSLTFPVGTFVTGTSQLALHTHLPAFRVAAAAAYAGLLATWVLVAIRTVRGSLRGNLL

SEQ ID NO: 4 - protein, 347 aa, Mycobacterium vanbaalenii PYR-1
ILGYLGPNWFASVMGTGIVATAGASLPVHVPGLRGFALVVWVLSALWLLVLIFATFAHWLRNPVVARSHVRNPQMAHFYGAAPMALLTVGSGALLVGRDLIGERAAVDLAWVLWTTGTLGALFTAMTIPYLMFTQYRVEPDAAFGGWLMPVVPPMVAAATGSLLIPHMAEGPGRATMLYGCYAMFGLSLVASLIIITMVWSRLAHYGTSGTARVPTLWIVLGPLGQSITVAGLLGTDAALAVDARLADGMAVFAVLYGVPVWGFAVLWIALAAALTVRTLRRGMPFALTWWSLTFPVGTFVTGTAQLALHTGLPAFRYAAAVAYLGLLCTWLLVAVRTVRGGLRGGL

SEQ ID NO: 5 - protein, 344 aa, Janibacter sp. HTCC2649
GPNWFAAVMGTGIVANAVATLPVQVPGLLAFARVVWALDVLLLALILAATAVHWVQHHDTARSHLDHPVMSHFYGAPAMALMTVGAGALLVGQPVVGRSVAIDMASALWVSGTLLGLWTAVAVPVKAFTTHEVAPDAAFGGWLMPVVPPMVSAATGPLLLPHLPAGQWQLAMQLACTMMFGLTLVASLIVITLIWGRLVHHKVGASAAVPTLWIVLGPLGQSVTAAHTLGVAAPTVLPEPFGSAFTAMGLVFGLPMWGFAMLWLAIAATVTLRTARSGLPFTLGWWSFTFPAGTVVTGTSGLAAATGATFLQFTALALYAGLVLAWATVAFRTARGAWDGRLLR

SEQ ID NO: 6 - protein, 350 aa, Mycobacterium gilvum PYR-GCK
DRPSILGYLGPNWFASVMGTGIVATAGASLPVHMPGLRGFATAVWVLSALWLVVLILAMLAHWLRNPTVARGHVRNPTMAHFYGAAPMALLTVGSGALLVGEDLIGARLAVDLAWALWVAGTLGGLFTAMTIPYLMFTQYRVEPDAAFGGWLMPVVPPMVAAATGSLLIPHMAEGVGRATMLYGCYAMFGLSLVASLIIITMVWSRLAHFGTSGTARVPTLWIVLGPLGQSITVAGLLGTDAALAVDENLADGMRVFAVLYGVPVWGFAVLWIGLATALTVRTLRRGMPFALTWWSLTFPVGTFVTGTTQLAVHTSLPAFRYAAAIAYIGLLCTWLLVAVRTLRVGIGRG

SEQ ID NO: 7 - protein, 343 aa, Arthrobacter sp. FB24
NWFASIMGTGIVATAAATLPLQFPGLRTGATVVWALASMLLILLTTATVVHWIRHRETAQSHHSHPVMAHFYGAPPMALLTVGAGTLLLGKDVLGEQLALGIDTVLWVAGTVLGLASAVAVPYLQFTRHQVTQDSAFGGWLMPVVPPMVSASTGALLLPYVPAGQARLSLLMGCYAMFGLSLLASIIITTLIWNRLAGHKIGAAAAVPTLWIVLGPLGQSITAANLLGGNAHLAVSGTLAQAMEALGVLYGVPVLGFALMWAALATAITIRTARRGLPFSLTWWSFTFPIGTCVTGLTGLAAHTHLAVFDAMAVAGYTLLVAAWIIVAARTFHGSILQGTLFQ

SEQ ID NO: 8 - protein, 374 aa, Artificial
  Substituion in SEQ ID NO 1
MGGDGMHIIRQFGVNWFTTVMGIGIVAALTYTSPIHLPFQHAVGEILFIGVNVVFVFAFAMWILRWLLTPDAAIDDFKHPGRALFYGAFAMGINVVGNDYFLIGTHMMPKHTAIAISFAIWLAGVAASVFSVIVVPYLLFTEHKVERDETVASWLIPLVPPIVAAATGTNLIPYAGGPGAQFSMTAGIVALFGMTFFLFIMTSALVYSRLVFHRRLSGQEAPTLWIEIGPIGMAMGTFCGIPLNAPHVFGPYFGGLRDLGAVFSIAMWGVGVWWILLSALYTFLHLTPKGDGLPFHLGWWSYVFPIGSFTNGTYALHRLLGHPFFAVAGLVQLGILWLCFAIVIVRTVHGVAAGHLIQWRRDHAHRHELKARRA

SEQ ID NO: 9 - protein, 374 aa, Artificial
  Substituion in SEQ ID NO 1
MGGEGMHIIRQFGVNWFTTVMGIGIVAALTYTSPIHLPFQHAVGEILFIGVNVVFVFAFAMWILRWLLTPDAAIDDFRHPGRALFYGAFAMGINVVGNDYFLIGTHMMPKHTAIAISFAIWLAGVAASVFSVIVVPYLLFTEHKVERDETVASWLIPLVPPIVAAATGTNLIPYAGGPGAQFSMTAGIVALFGMTFFLFIMTSALVYSRLVFHRRLSGQEAPTLWIEIGPIGMAMGTFCGIPLNAPHVFGPYFGGLRDLGAVFSIAMWGVGVWWILLSALYTFLHLTPKGDGLPFHLGWWSYVFPIGSFTNGTYALHRLLGHPFFAVAGLVQLGILWLCFAIVIVRTVHGVAAGHLIQWRRDHAHRHELKARRA

SEQ ID NO: 10 - protein, 374 aa, Artificial
  Substituion in SEQ ID NO 1
MGGDGMHIIRQFGVNWFTTVMGIGIVAALTYTSPIHLPFQHAVGEIIFIGVNVVFVFAFAMWILRWLLTPDAAIDDFRHPGRALFYGAFAMGINVVGNDYFLIGTHMMPKHTAIAISFAIWLAGVAASVFSVIVVPYLLFTEHKVERDETVASWLIPLVPPIVAAATGTNLIPYAGGPGAQFSMTAGIVALFGMTFFLFIMTSALVYSRLVFHRRLSGQEAPTLWIEIGPIGMAMGTFCGIPLNAPHVFGPYFGGLRDLGAVFSIAMWGVGVWWILLSALYTFLHLTPKGDGLPFHLGWWSYVFPIGSFTNGTYALHRLLGHPFFAVAGLVQLGILWLCFAIVIVRTVHGVAAGHLIQWRRDHAHRHELKARRA

SEQ ID NO: 11 - protein, 374 aa, Artificial
  Substituion in SEQ ID NO 1
MGGDGMHIIRQFGVNWFTTVMGIGIVAALTYTSPIHLPFQHAVGEILFIGVNVVFVFAFAMWILRWLLTPDAAIDDFRHPGRALFYGAFAMGINVVGNDYFLLGTHMMPKHTAIAISFAIWLAGVAASVFSVIVVPYLLFTEHKVERDETVASWLIPLVPPIVAAATGTNLIPYAGGPGAQFSMTAGIVALFGMTFFLFIMTSALVYSRLVFHRRLSGQEAPTLWIEIGPIGMAMGTFCGIPLNAPHVFGPYFGGLRDLGAVFSIAMWGVGVWWILLSALYTFLHLTPKGDGLPFHLGWWSYVFPIGSFTNGTYALHRLLGHPFFAVAGLVQLGILWLCFAIVIVRTVHGVAAGHLIQWRRDHAHRHELKARRA

SEQ ID NO: 12 - protein, 374 aa, Artificial
  Substituion in SEQ ID NO 1
MGGDGMHIIRQFGVNWFTTVMGIGIVAALTYTSPIHLPFQHAVGEILFIGVNVVFVFAFAMWILRWLLTPDAAIDDFRHPGKALFYGAFAMGINVVGNDYFLIGTHMMPKHTAIAISFAIWLAGVAASVFSVIVVPYLLFTEHKVERDETVASWLIPLVPPIVAAATGTNLIPYAGGPGAQFSMTAGIVALFGMTFFLFIMTSALVYSRLVFHRRLSGQEAPTLWIEIGPIGMAMGTFCGIPLNAPHVFGPYFGGLRDLGAVFSIAMWGVGVWWILLSALYTFLHLTPKGDGLPFHLGWWSYVFPIGSFTNGTYALHRLLGHPFFAVAGLVQLGILWLCFAIVIVRTVHGVAAGHLIQWRRDHAHRHELKARRA

SEQ ID NO: 13 - DNA, 1125 bp, Artificial
  Substituion in SEQ ID NO 2
gtgggaggtgacggaatgcacatcatacgtcagttcggcgtcaactggttcacgaccgtcatgggcatcggcattgtcgcggcgctcacctacacgtcgcccatccacctgccgttccagcacgcggtgggggagatcttgttcattggcgtcaatgtggtcttcgtcttcgcctttgcgatgtggattctgcgctggctgctcacgcccgacgccgccatcgacgatttcaaacatccgggtcgggcgctgttttacggcgcgttcgcgatgggcatcaacgtcgtcggcaacgattactttctcatcggcacacatatgatgccgaagcataccgccatcgccatcagcttcgcgatttggctcgctggggtcgccgcatccgtgttctccgtcatcgtcgtgccgtatctgctcttcacagagcacaaggtggagcgagacgaaaccgtggcgtcctggctcatcccactcgttcctcccatcgtggcggcggccacgggcaccaatctcattccgtacgcggggggacctggcgcgcagttctccatgacggcaggcatcgtcgccctgttcggcatgacgttcttcctgttcatcatgacgagcgccttggtctattcgcgcctcgtgtttcacaggcggctcagcggccaagaggcgccgaccttgtggattgagattgggcccatcggcatggcgatgggcacgttctgcggcattccgctgaacgcccctcacgtcttcggcccctacttcggcggcctgcgcgatctcggcgctgtcttctccatcgccatgtggggcgtgggcgtctggtggatcctcctctcggcgctctacacgtttctgcacctgacgccgaagggcgacgggctgccatttcatctgggttggtggagctacgtcttccccatcggcagcttcaccaacggcacgtatgcgctccatcgcctgctcgggcacccgttcttcgccgtggctggcttggtgcagctcgggattttgtggctgtgtttcgccatcgtcatcgtgcgcacggttcacggcgtggccgcaggccacctgattcagtggcggcgcgatcacgcccatcgtcatgaactcaaagcgcgccgcgcgtga

SEQ ID NO: 14 - DNA, 1125 bp, Artificial
  Substituion in SEQ ID NO 2
gtgggaggtgaaggaatgcacatcatacgtcagttcggcgtcaactggttcacgaccgtcatgggcatcggcattgtcgcggcgctcacctacacgtcgcccatccacctgccgttccagcacgcggtgggggagatcttgttcattggcgtcaatgtggtcttcgtcttcgcctttgcgatgtggattctgcgctggctgctcacgcccgacgccgccatcgacgatttccggcatccgggtcgggcgctgttttacggcgcgttcgcgatgggcatcaacgtcgtcggcaacgattactttctcatcggcacacatatgatgccgaagcataccgccatcgccatcagcttcgcgatttggctcgctggggtcgccgcatccgtgttctccgtcatcgtcgtgccgtatctgctcttcacagagcacaaggtggagcgagacgaaaccgtggcgtcctggctcatcccactcgttcctcccatcgtggcggcggccacgggcaccaatctcattccgtacgcggggggacctggcgcgcagttctccatgacggcaggcatcgtcgccctgttcggcatgacgttcttcctgttcatcatgacgagcgccttggtctattcgcgcctcgtgtttcacaggcggctcagcggccaagaggcgccgaccttgtggattgagattgggcccatcggcatggcgatgggcacgttctgcggcattccgctgaacgcccctcacgtcttcggcccctacttcggcggcctgcgcgatctcggcgctgtcttctccatcgccatgtggggcgtgggcgtctggtggatcctcctctcggcgctctacacgtttctgcacctgacgccgaagggcgacgggctgccatttcatctgggttggtggagctacgtcttccccatcggcagcttcaccaacggcacgtatgcgctccatcgcctgctcgggcacccgttcttcgccgtggctggcttggtgcagctcgggattttgtggctgtgtttcgccatcgtcatcgtgcgcacggttcacggcgtggccgcaggccacctgattcagtggcggcgcgatcacgcccatcgtcatgaactcaaagcgcgccgcgcgtga

SEQ ID NO: 15 - DNA, 1125 bp, Artificial
  Substituion in SEQ ID NO 2
gtgggaggtgacggaatgcacatcatacgtcagttcggcgtcaactggttcacgaccgtcatgggcatcggcattgtcgcggcgctcacctacacgtcgcccatccacctgccgttccagcacgcggtgggggagatcattttcattggcgtcaatgtggtcttcgtcttcgcctttgcgatgtggattctgcgctggctgctcacgcccgacgccgccatcgacgatttccggcatccgggtcgggcgctgttttacggcgcgttcgcgatgggcatcaacgtcgtcggcaacgattactttctcatcggcacacatatgatgccgaagcataccgccatcgccatcagcttcgcgatttggctcgctggggtcgccgcatccgtgttctccgtcatcgtcgtgccgtatctgctcttcacagagcacaaggtggagcgagacgaaaccgtggcgtcctggctcatcccactcgttcctcccatcgtggcggcggccacgggcaccaatctcattccgtacgcggggggacctggcgcgcagttctccatgacggcaggcatcgtcgccctgttcggcatgacgttcttcctgttcatcatgacgagcgccttggtctattcgcgcctcgtgtttcacaggcggctcagcggccaagaggcgccgaccttgtggattgagattgggcccatcggcatggcgatgggcacgttctgcggcattccgctgaacgcccctcacgtcttcggcccctacttcggcggcctgcgcgatctcggcgctgtcttctccatcgccatgtggggcgtgggcgtctggtggatcctcctctcggcgctctacacgtttctgcacctgacgccgaagggcgacgggctgccatttcatctgggttggtggagctacgtcttccccatcggcagcttcaccaacggcacgtatgcgctccatcgcctgctcgggcacccgttcttcgccgtggctggcttggtgcagctcgggattttgtggctgtgtttcgccatcgtcatcgtgcgcacggttcacggcgtggccgcaggccacctgattcagtggcggcgcgatcacgcccatcgtcatgaactcaaagcgcgccgcgcgtga

SEQ ID NO: 16 - DNA, 1125 bp, Artificial
  Substituion in SEQ ID NO 2
gtgggaggtgacggaatgcacatcatacgtcagttcggcgtcaactggttcacgaccgtcatgggcatcggcattgtcgcggcgctcacctacacgtcgcccatccacctgccgttccagcacgcggtgggggagatcttgttcattggcgtcaatgtggtcttcgtcttcgcctttgcgatgtggattctgcgctggctgctcacgcccgacgccgccatcgacgatttccggcatccgggtcgggcgctgttttacggcgcgttcgcgatgggcatcaacgtcgtcggcaacgattactttctcttaggcacacatatgatgccgaagcataccgccatcgccatcagcttcgcgatttggctcgctggggtcgccgcatccgtgttctccgtcatcgtcgtgccgtatctgctcttcacagagcacaaggtggagcgagacgaaaccgtggcgtcctggctcatcccactcgttcctcccatcgtggcggcggccacgggcaccaatctcattccgtacgcggggggacctggcgcgcagttctccatgacggcaggcatcgtcgccctgttcggcatgacgttcttcctgttcatcatgacgagcgccttggtctattcgcgcctcgtgtttcacaggcggctcagcggccaagaggcgccgaccttgtggattgagattgggcccatcggcatggcgatgggcacgttctgcggcattccgctgaacgcccctcacgtcttcggcccctacttcggcggcctgcgcgatctcggcgctgtcttctccatcgccatgtggggcgtgggcgtctggtggatcctcctctcggcgctctacacgtttctgcacctgacgccgaagggcgacgggctgccatttcatctgggttggtggagctacgtcttccccatcggcagcttcaccaacggcacgtatgcgctccatcgcctgctcgggcacccgttcttcgccgtggctggcttggtgcagctcgggattttgtggctgtgtttcgccatcgtcatcgtgcgcacggttcacggcgtggccgcaggccacctgattcagtggcggcgcgatcacgcccatcgtcatgaactcaaagcgcgccgcgcgtga

SEQ ID NO: 17 - DNA, 1125 bp, Artificial
  Substituion in SEQ ID NO 2
gtgggaggtgacggaatgcacatcatacgtcagttcggcgtcaactggttcacgaccgtcatgggcatcggcattgtcgcggcgctcacctacacgtcgcccatccacctgccgttccagcacgcggtgggggagatcttgttcattggcgtcaatgtggtcttcgtcttcgcctttgcgatgtggattctgcgctggctgctcacgcccgacgccgccatcgacgatttccggcatccgggtaaagcgctgttttacggcgcgttcgcgatgggcatcaacgtcgtcggcaacgattactttctcatcggcacacatatgatgccgaagcataccgccatcgccatcagcttcgcgatttggctcgctggggtcgccgcatccgtgttctccgtcatcgtcgtgccgtatctgctcttcacagagcacaaggtggagcgagacgaaaccgtggcgtcctggctcatcccactcgttcctcccatcgtggcggcggccacgggcaccaatctcattccgtacgcggggggacctggcgcgcagttctccatgacggcaggcatcgtcgccctgttcggcatgacgttcttcctgttcatcatgacgagcgccttggtctattcgcgcctcgtgtttcacaggcggctcagcggccaagaggcgccgaccttgtggattgagattgggcccatcggcatggcgatgggcacgttctgcggcattccgctgaacgcccctcacgtcttcggcccctacttcggcggcctgcgcgatctcggcgctgtcttctccatcgccatgtggggcgtgggcgtctggtggatcctcctctcggcgctctacacgtttctgcacctgacgccgaagggcgacgggctgccatttcatctgggttggtggagctacgtcttccccatcggcagcttcaccaacggcacgtatgcgctccatcgcctgctcgggcacccgttcttcgccgtggctggcttggtgcagctcgggattttgtggctgtgtttcgccatcgtcatcgtgcgcacggttcacggcgtggccgcaggccacctgattcagtggcggcgcgatcacgcccatcgtcatgaactcaaagcgcgccgcgcgtga

SEQ ID NO: 18 - protein, 305 aa, Alicyclobacillus acidocaldarius
MKRVDLQLRVFVTVVEENSFTRAAEKLHISQPAISQHVQTLEQRLGVRLIDRGRRRLQVNPAGRIVYEHAKEILALYRRMERLIADMQEMPAGPVHVGASLTYGEYVLPHVIARFRKAYPAVQPSVSIANTQTIAHAVAVRQLDIGIVEGQDVVEDEVVLTPFAEDEMLVVASPASPWYAEAPDRSLLERATWFIREPGSGTREMTDRLFTQLGIQPRDLVEYTSSQVIKESVAAGLGLACLSRWVVARELAWGMLRTLPIPCAPVKRTFSIVTPKSAFETKASKLLYSFLMEHGSPENPSLAGE

SEQ ID NO: 19 - DNA, 918 bp, Alicyclobacillus acidocaldarius
gtgaagcgcgtggatctgcagttgcgagtgtttgtcacggtcgtggaggagaacagcttcacccgcgcggccgagaagttgcacatcagccagccggccatcagtcagcacgtccagacgctcgaacaacgcctcggcgtgcgcctgatcgatcgcggccgcaggcggctgcaggtgaatcccgccggccgaatcgtatacgagcacgccaaggaaatcctcgcgttgtaccgccgcatggaacggctcatcgcggatatgcaggagatgccggccgggcctgtgcacgtgggggccagcctgacctacggggaatacgtgctgccgcacgtcatcgcccgattccgcaaggcataccccgccgtgcagccgtccgtctccattgccaacacccagaccatcgcccacgccgtggcggtgcgccagctcgacatcggcatcgtcgaaggccaggacgtggtggaggacgaggtggtgctcacgccgttcgcggaggacgagatgctggtggtggcaagccccgcgtcgccctggtacgccgaagcgccggatcgatctctgctggagcgcgccacctggttcattcgcgagcccggatccggcacgcgggagatgacggatcgcctgtttacccagttgggcattcagccgcgcgatcttgtcgaatacacgagcagccaggtcatcaaggagtcggtggccgcgggcctcggcctcgcgtgcctctcccgctgggtggtggcgcgagaactcgcctgggggatgttgcgcacgcttcccatcccgtgcgcgcccgtgaagcggacgttttccatcgtgacgccgaaatcggcgttcgagacgaaggcgtcgaagcttctgtacagctttctcatggaacacggatccccggagaacccgagcctcgccggagagtga

SEQ ID NO: 20 - protein, 303 aa, Geobacillus kaustophilus HTA426
MDQLLYVFVKVVEKGNFTKAAEELHMTQPAVSQHIQTLERLFDTKLLDRTNKYVKLNKAGEIVYHYAKEILGLYTRMNQLLDDLMNRASGELSIGASYTYGEYVLPQMIAKLHQHYPLIKPTITIGNSNEIVEMVRDHQLDVGIIEMDIEPKNVYIEPFAKDQMVVVASAHHPYAQKETVQMEDLCNATWIVRETGSGTRKATDEFFLKHNFFPSSIMEFGSTQLIKEAVEAGLGLTFLSLWTIKKELSFGTLKIIPINDEPFFRHFSLVTPKTPFYTKAMEVFLTIVRTHQPSISHSPQPPS

SEQ ID NO: 21 - protein, 276 aa, Bacillus weihenstephanensis KBAB4
LKIFVTVVEQKHFSRAAELLNLSQPGVSMHIRNLENEFGTTLIQRSPKHVQVTEAGNILYIHAKQMLSLYEDAKQEINALHNVVTGTLRIGASFTIGEYLLPKILARFANENAHVEVHTFISNTEEVLQSLRSNQIDIGLVEGQVVYADVDVETFMQDEMKLVVPPNHPLLHIKGINENTLQDQVWVLRESGSGTRAYSDRFIHQHHLKMKRFFTFSSIQSVKEAVAAGLGIAILSDWTVRKELLAKELFHIPVPNEELIRPFSIVRGKYFIPSKA

SEQ ID NO: 22 - protein, 276 aa, Bacillus cereus ATCC 10987
LKIFVTVVEQKHFSRAAELLNLSQPGVSMHIRNLENEFGTTLIQRSPKHVQVTEAGNILYIHAKQMLSLYEDAKQEINELHNVVTGTLRIGASFTIGEYLLPKILANYANENPRVEVHTFISNTEDVLQSLRSNQIDIGLVEGQVVYADVDVETFMQDEMKLVVPPNHPLLDTKEVNERTLQDQVWVLRESGSGTRAYSDRFIHQHHLKMKRFFTFSSIQSVKEAVAAGLGIAILSDWTVRKELLAKELFHVEIPNEQLIRPFSIVRGKYFIPSKA

SEQ ID NO: 23 - protein, 276 aa, Bacillus cereus AH187
LKIFVTVVEQKHFSRAAELLNLSQPGVSMHIRNLENEFGTTLIQRSPKHVQVTEAGNILYIHAKQMLSLYEDAKQEINELHNVVTGTLRIGASFTIGEYLLPKILANYANENPRVEVHTFISNTEDVLQSLRSNQIDIGLVEGQVVYADVDVETFMQDEMKLVVPPNHPLLRTNEINERTLQDQVWVLRESGSGTRAYSDRFIHQHHLKMKRFFTFSSIQSVKEAVAAGLGIAILSDWTVRKELLAKELFHVEVPDEQLIRPFSIVRGKYFIPSKA

SEQ ID NO: 24 - protein, 276 aa, Bacillus thuringiensis str. Al Hakam
LKIFVTVVEQKHFSRAAELLNLSQPGVSMHIRNLENEFGTTLIQRSPKHVQVTEAGNILYIHAKQMLSLYEDAKQKINELHNVVTGTLRIGASFTIGEYLLPKILANYANENPHVEVHTFISNTEDVLQSLRSNQIDIGLVEGQVVYADVDVETFMQDEMKLVVPPNHPLLRTNEMNESTLQDQVWVLRESGSGTRAYSDRFIHQHHLKMKRFFTFSSIQSVKEAVSAGLGIAILSDWTVRKELLAKELFHVEVPNEQLIRPFSIVRGKYFIPSKA

SEQ ID NO: 25 - protein, 305 aa, Artificial
  Substituion in SEQ ID NO 18
MKRVDLQLKVFVTVVEENSFTRAAEKLHISQPAISQHVQTLEQRLGVRLIDRGRRRLQVNPAGRIVYEHAKEILALYRRMERLIADMQEMPAGPVHVGASLTYGEYVLPHVIARFRKAYPAVQPSVSIANTQTIAHAVAVRQLDIGIVEGQDVVEDEVVLTPFAEDEMLVVASPASPWYAEAPDRSLLERATWFIREPGSGTREMTDRLFTQLGIQPRDLVEYTSSQVIKESVAAGLGLACLSRWVVARELAWGMLRTLPIPCAPVKRTFSIVTPKSAFETKASKLLYSFLMEHGSPENPSLAGE

SEQ ID NO: 26 - protein, 305 aa, Artificial
  Substituion in SEQ ID NO 18
MKRVDLNLRVFVTVVEENSFTRAAEKLHISQPAISQHVQTLEQRLGVRLIDRGRRRLQVNPAGRIVYEHAKEILALYRRMERLIADMQEMPAGPVHVGASLTYGEYVLPHVIARFRKAYPAVQPSVSIANTQTIAHAVAVRQLDIGIVEGQDVVEDEVVLTPFAEDEMLVVASPASPWYAEAPDRSLLERATWFIREPGSGTREMTDRLFTQLGIQPRDLVEYTSSQVIKESVAAGLGLACLSRWVVARELAWGMLRTLPIPCAPVKRTFSIVTPKSAFETKASKLLYSFLMEHGSPENPSLAGE

SEQ ID NO: 27 - protein, 305 aa, Artificial
  Substituion in SEQ ID NO 18
MKRVDLQLRVFVTVVEENSFTRAAEKLHISQPAISQHVQTLEQRLGVRLIDRGRRRLQVNPAGRIVYEHAKEILALYRRMERLIAEMQEMPAGPVHVGASLTYGEYVLPHVIARFRKAYPAVQPSVSIANTQTIAHAVAVRQLDIGIVEGQDVVEDEVVLTPFAEDEMLVVASPASPWYAEAPDRSLLERATWFIREPGSGTREMTDRLFTQLGIQPRDLVEYTSSQVIKESVAAGLGLACLSRWVVARELAWGMLRTLPIPCAPVKRTFSIVTPKSAFETKASKLLYSFLMEHGSPENPSLAGE

SEQ ID NO: 28 - protein, 305 aa, Artificial
  Substituion in SEQ ID NO 18
MKRVDLQLRVFVTVVEENSFTRAAEKLHISQPAISQHVQTLEQRLGVRLIDRGRRRLQVNPAGRIVYEHAKEILALYRRMERLIADMQEMPAGPVHVGASLTYGEYVLPHVIARFRKAYPAVQPSVSIANTQTIAHAVAIRQLDIGIVEGQDVVEDEVVLTPFAEDEMLVVASPASPWYAEAPDRSLLERATWFIREPGSGTREMTDRLFTQLGIQPRDLVEYTSSQVIKESVAAGLGLACLSRWVVARELAWGMLRTLPIPCAPVKRTFSIVTPKSAFETKASKLLYSFLMEHGSPENPSLAGE

SEQ ID NO: 29 - protein, 305 aa, Artificial
  Substituion in SEQ ID NO 18
MKRVDLQLRVFVTVVEENSFTRAAEKLHISQPAISQHVQTLEQRLGVRLIDRGRRRLQVNPAGRIVYEHAKEILALYRRMERLIADMQEMPAGPVHVGASLTYGEYVLPHVIARFRKAYPAVQPSVSIANTQTIAHAVAVRQLDLGIVEGQDVVEDEVVLTPFAEDEMLVVASPASPWYAEAPDRSLLERATWFIREPGSGTREMTDRLFTQLGIQPRDLVEYTSSQVIKESVAAGLGLACLSRWVVARELAWGMLRTLPIPCAPVKRTFSIVTPKSAFETKASKLLYSFLMEHGSPENPSLAGE

SEQ ID NO: 30 - DNA, 918 bp, Artificial
  Substituion in SEQ ID NO 19
gtgaagcgcgtggatctgcagttgaaagtgtttgtcacggtcgtggaggagaacagcttcacccgcgcggccgagaagttgcacatcagccagccggccatcagtcagcacgtccagacgctcgaacaacgcctcggcgtgcgcctgatcgatcgcggccgcaggcggctgcaggtgaatcccgccggccgaatcgtatacgagcacgccaaggaaatcctcgcgttgtaccgccgcatggaacggctcatcgcggatatgcaggagatgccggccgggcctgtgcacgtgggggccagcctgacctacggggaatacgtgctgccgcacgtcatcgcccgattccgcaaggcataccccgccgtgcagccgtccgtctccattgccaacacccagaccatcgcccacgccgtggcggtgcgccagctcgacatcggcatcgtcgaaggccaggacgtggtggaggacgaggtggtgctcacgccgttcgcggaggacgagatgctggtggtggcaagccccgcgtcgccctggtacgccgaagcgccggatcgatctctgctggagcgcgccacctggttcattcgcgagcccggatccggcacgcgggagatgacggatcgcctgtttacccagttgggcattcagccgcgcgatcttgtcgaatacacgagcagccaggtcatcaaggagtcggtggccgcgggcctcggcctcgcgtgcctctcccgctgggtggtggcgcgagaactcgcctgggggatgttgcgcacgcttcccatcccgtgcgcgcccgtgaagcggacgttttccatcgtgacgccgaaatcggcgttcgagacgaaggcgtcgaagcttctgtacagctttctcatggaacacggatccccggagaacccgagcctcgccggagagtga

SEQ ID NO: 31 - DNA, 918 bp, Artificial
  Substituion in SEQ ID NO 19
gtgaagcgcgtggatctgaatttgcgagtgtttgtcacggtcgtggaggagaacagcttcacccgcgcggccgagaagttgcacatcagccagccggccatcagtcagcacgtccagacgctcgaacaacgcctcggcgtgcgcctgatcgatcgcggccgcaggcggctgcaggtgaatcccgccggccgaatcgtatacgagcacgccaaggaaatcctcgcgttgtaccgccgcatggaacggctcatcgcggatatgcaggagatgccggccgggcctgtgcacgtgggggccagcctgacctacggggaatacgtgctgccgcacgtcatcgcccgattccgcaaggcataccccgccgtgcagccgtccgtctccattgccaacacccagaccatcgcccacgccgtggcggtgcgccagctcgacatcggcatcgtcgaaggccaggacgtggtggaggacgaggtggtgctcacgccgttcgcggaggacgagatgctggtggtggcaagccccgcgtcgccctggtacgccgaagcgccggatcgatctctgctggagcgcgccacctggttcattcgcgagcccggatccggcacgcgggagatgacggatcgcctgtttacccagttgggcattcagccgcgcgatcttgtcgaatacacgagcagccaggtcatcaaggagtcggtggccgcgggcctcggcctcgcgtgcctctcccgctgggtggtggcgcgagaactcgcctgggggatgttgcgcacgcttcccatcccgtgcgcgcccgtgaagcggacgttttccatcgtgacgccgaaatcggcgttcgagacgaaggcgtcgaagcttctgtacagctttctcatggaacacggatccccggagaacccgagcctcgccggagagtga

SEQ ID NO: 32 - DNA, 918 bp, Artificial
  Substituion in SEQ ID NO 19
gtgaagcgcgtggatctgcagttgcgagtgtttgtcacggtcgtggaggagaacagcttcacccgcgcggccgagaagttgcacatcagccagccggccatcagtcagcacgtccagacgctcgaacaacgcctcggcgtgcgcctgatcgatcgcggccgcaggcggctgcaggtgaatcccgccggccgaatcgtatacgagcacgccaaggaaatcctcgcgttgtaccgccgcatggaacggctcatcgcggaaatgcaggagatgccggccgggcctgtgcacgtgggggccagcctgacctacggggaatacgtgctgccgcacgtcatcgcccgattccgcaaggcataccccgccgtgcagccgtccgtctccattgccaacacccagaccatcgcccacgccgtggcggtgcgccagctcgacatcggcatcgtcgaaggccaggacgtggtggaggacgaggtggtgctcacgccgttcgcggaggacgagatgctggtggtggcaagccccgcgtcgccctggtacgccgaagcgccggatcgatctctgctggagcgcgccacctggttcattcgcgagcccggatccggcacgcgggagatgacggatcgcctgtttacccagttgggcattcagccgcgcgatcttgtcgaatacacgagcagccaggtcatcaaggagtcggtggccgcgggcctcggcctcgcgtgcctctcccgctgggtggtggcgcgagaactcgcctgggggatgttgcgcacgcttcccatcccgtgcgcgcccgtgaagcggacgttttccatcgtgacgccgaaatcggcgttcgagacgaaggcgtcgaagcttctgtacagctttctcatggaacacggatccccggagaacccgagcctcgccggagagtga

SEQ ID NO: 33 - DNA, 918 bp, Artificial
  Substituion in SEQ ID NO 19
gtgaagcgcgtggatctgcagttgcgagtgtttgtcacggtcgtggaggagaacagcttcacccgcgcggccgagaagttgcacatcagccagccggccatcagtcagcacgtccagacgctcgaacaacgcctcggcgtgcgcctgatcgatcgcggccgcaggcggctgcaggtgaatcccgccggccgaatcgtatacgagcacgccaaggaaatcctcgcgttgtaccgccgcatggaacggctcatcgcggatatgcaggagatgccggccgggcctgtgcacgtgggggccagcctgacctacggggaatacgtgctgccgcacgtcatcgcccgattccgcaaggcataccccgccgtgcagccgtccgtctccattgccaacacccagaccatcgcccacgccgtggcgattcgccagctcgacatcggcatcgtcgaaggccaggacgtggtggaggacgaggtggtgctcacgccgttcgcggaggacgagatgctggtggtggcaagccccgcgtcgccctggtacgccgaagcgccggatcgatctctgctggagcgcgccacctggttcattcgcgagcccggatccggcacgcgggagatgacggatcgcctgtttacccagttgggcattcagccgcgcgatcttgtcgaatacacgagcagccaggtcatcaaggagtcggtggccgcgggcctcggcctcgcgtgcctctcccgctgggtggtggcgcgagaactcgcctgggggatgttgcgcacgcttcccatcccgtgcgcgcccgtgaagcggacgttttccatcgtgacgccgaaatcggcgttcgagacgaaggcgtcgaagcttctgtacagctttctcatggaacacggatccccggagaacccgagcctcgccggagagtga

SEQ ID NO: 34 - DNA, 918 bp, Artificial
  Substituion in SEQ ID NO 19
gtgaagcgcgtggatctgcagttgcgagtgtttgtcacggtcgtggaggagaacagcttcacccgcgcggccgagaagttgcacatcagccagccggccatcagtcagcacgtccagacgctcgaacaacgcctcggcgtgcgcctgatcgatcgcggccgcaggcggctgcaggtgaatcccgccggccgaatcgtatacgagcacgccaaggaaatcctcgcgttgtaccgccgcatggaacggctcatcgcggatatgcaggagatgccggccgggcctgtgcacgtgggggccagcctgacctacggggaatacgtgctgccgcacgtcatcgcccgattccgcaaggcataccccgccgtgcagccgtccgtctccattgccaacacccagaccatcgcccacgccgtggcggtgcgccagctcgacttaggcatcgtcgaaggccaggacgtggtggaggacgaggtggtgctcacgccgttcgcggaggacgagatgctggtggtggcaagccccgcgtcgccctggtacgccgaagcgccggatcgatctctgctggagcgcgccacctggttcattcgcgagcccggatccggcacgcgggagatgacggatcgcctgtttacccagttgggcattcagccgcgcgatcttgtcgaatacacgagcagccaggtcatcaaggagtcggtggccgcgggcctcggcctcgcgtgcctctcccgctgggtggtggcgcgagaactcgcctgggggatgttgcgcacgcttcccatcccgtgcgcgcccgtgaagcggacgttttccatcgtgacgccgaaatcggcgttcgagacgaaggcgtcgaagcttctgtacagctttctcatggaacacggatccccggagaacccgagcctcgccggagagtga

SEQ ID NO: 35 - protein, 589 aa, Alicyclobacillus acidocaldarius
MMRFRSLRVKLVMVYTLLILFAVELIGAYFVQALTSSLVRNQAQTARTQAQLMATLIAPELAPGARVSNSAVSNLLQSVPQFLNGTVYVLNQSGYVMYTTAGGALVGQKRIDSVATQALLHHTFAQSVRYDPLSKSHLLAVAVPVTLHGTYLGVLEYVLSIQSTYETIHQATTIFYTGSIAVLAIVMILGAIVARALTRPVMEVTRQAEVMARGDFSQRLEAMSNDEIGDLVASINHLADELEEAIAANRLEQERLRAVITSMGEGVIVLDSSGQVLMMNRAARQMLSQAAGGEEEAIRQLELDRLMQGDVATGVREVRVIGNTIFHVILTSVQRRGQVDGYVAVVRDVTEQEKLDQARRDFVSNVSHELRTPLTTVKSYLEVMRDLGDDEAETKREFLEVIARETDRMVRLTRDLLLLSGLDRGGPRSVEMRAIPVHGLLEGVVERFQLQAAKQELSLRVHLPQRRDVCVYGDEDMVNRVLDNVLSNALKYTPPGGRIEVRADVTAQHVTFIISDTGIGIPPEDLPHVFERFYRVEKGRSRRGGGTGLGLALAREMVERMGGEIRMESEPQRGTTVYVTLRRAEEDAV

SEQ ID NO: 36 - DNA, 1770 bp, Alicyclobacillus acidocaldarius
atgatgcggttccgaagcctgcgcgtgaagctcgtcatggtctacacgctgctcatcctgttcgccgtggagctcatcggcgcgtacttcgtccaggcgctgacgtcctcgctcgtgcgcaatcaggcgcagaccgcgcgcacgcaggcgcagctcatggcgacactcatcgcgccggaactcgcgcctggcgcgcgcgtgtccaacagtgcggtgtcgaatctgctccagtcggtgccccagttcctgaacggcaccgtgtacgtgctcaaccaaagcggctacgtgatgtacaccaccgccggcggcgcgctcgtggggcagaagcggattgactccgtcgccacgcaggcgctgcttcaccacacgtttgcgcagtccgtgcgctacgatcccctgtcgaagagccacctgcttgccgtggctgtgcccgtgacgctgcacgggacctatctcggcgtgctcgaatacgtcctgtccatccagtccacctacgagaccatccaccaagccaccaccatcttctacaccggttccatcgctgttctggccatcgtcatgatcctcggagccatcgtcgcccgtgccctgacgcgcccggtgatggaggtgacgcgacaggcggaggtgatggcgcgaggagacttctcgcagcgcctcgaggcgatgagcaacgacgaaatcggcgatctcgtcgcgtccatcaaccacctcgcggacgagctcgaagaggcgatcgcggcgaaccggttggagcaggaacggctgcgcgccgtcatcacgtcgatgggcgagggcgtgatcgtgctcgattcgtccgggcaggtgttgatgatgaatcgcgcggcgaggcagatgttgagccaggccgccggcggcgaagaggaggccattcggcagctcgagctggatcggctgatgcagggagacgtggcgacgggcgtgcgagaggtgcgcgtgattggcaacaccatctttcacgtcatcctgacgagcgttcagcgccgcggccaggtggacggctacgtcgcggtcgtccgagacgtgaccgagcaggagaaactcgaccaggcgcgccgggacttcgtcagcaacgtgtcgcacgagctgcgcacgccgctcaccacggtgaagtcgtacctcgaggtgatgcgcgatctcggcgacgacgaggcggagaccaagcgcgagttcctcgaggtcattgcgcgcgagacggatcgcatggtgcggctgacgcgggacctgctcttgttgtcagggctggaccggggcggcccgcgcagcgtggagatgagggccatcccggtgcacggcctgctcgaaggcgtggtggagcggtttcagctccaggcggcgaagcaggagctgtcccttcgcgttcacctgccgcagcgccgcgacgtgtgcgtgtacggggatgaggacatggtcaaccgcgtgctggacaacgtcctgtcgaacgcgctgaaatacacgccgccgggcgggcggatcgaggtgcgggcggacgtcacagcgcagcacgtgaccttcatcatctcggataccggcatcggcattcctcccgaagacctgccgcacgtcttcgagcggttctaccgggtcgaaaaggggcgaagccgccgcggcggcggcacggggctcggacttgccctggcgcgcgagatggtggagcgcatgggtggcgagatccggatggagagcgaaccgcagcgaggcaccaccgtgtacgtgacgctgcgccgcgccgaggaggatgccgtatga

SEQ ID NO: 37 - protein, 591 aa, Bacillus selenitireducens MLS10
FKSIHVKIVTIYVLLILIAMQVIGVYFTQQLEDQLVENFYETLDERANLLAYNVQQEMSRDEDEEEQSLRVRTDNVLGELFNMENAQARVVDQFSNVVTVTNPEEDIYIGQRTTNFRIIRALGGSTEEAVLRNENTGHRTRVLAVPVETEENQVVGAIYIEASMEEIYEQMAQTNQILLTGTMISLVLTAALGIFLSRTITRPIVEMRRQADFLGKGDFSQNVEVYGDDEIGQLSATFNELTNKLEEAHATTEGERRKLSSVLTHMTDGVIATDREGQIILMNRRAEELTGYSQEEAIGYDLVGMLNLAHFMKLSDLYNMDDPILLDFEHHDEELILEANFSVIEKENGRKNGLIAVLHDVTEQERIEQERREFVANVSHELRTPLTSMKSYLEALLDGAVNDSDVAPQFLQVTSNETDRMIRLVNDLLQLSKMDARDDHMLMAEVNIVNMIHHVIDRFEMSNKQENIQFRRRLPDVPLSVMGDRDKLVQLLDNMVSNAVKYSPEGGVITITLKQEKERLIVSVKDEGVGIPKENLPHVFDRFYRVDKARSRSLGGTGLGLAIAKEIVEVHGGHIWVSSDWGKGTTFFFSL

SEQ ID NO: 38 - protein, 596 aa, Listeria welshimeri serovar 6b str. SLCC5334
MRFFQSVQFKLVIMYLLLIIVAMQVIGAYFVRELEGQLEKNFQNSITNSITLLDYNAREEIIKNSDNSVKLQNDIRELLVDFSRASSNLIEVRIVDEKGKILGTSNLNNQGIVGQKSNDPLVKRTLSLGTTSEDKIYKDESNKNNRVWVNVSSIKNKGEVIGAIYLVADIESVYKQVDDITNIFITGTLIAMVITAILGILLSRTITKPIVEMKRQAYAMARGNYSRKVKVYGVDEIGELADSFNTLTKRVQEAQAMTEGERRKLSSVLAYMTDGVIATDRRGKVILINTPAEKMLRVKHESANGRSIIDVLDIGDSYQFEDLMEVDGSLTMDRSTLDKPYILRANFSVIQRETGFNNGVIAVLHDITDQEKVDQERRDFVSNVSHELRTPLTSMHSYLEALSDGAWEDKEIAPRFLEVTQNETERMIRLVNDLLKLSRMDGGREHLEKSFVNFTDFFNHIIDRFEMMKKETIMFKRHIPKEPVIIEIDEDKVMQVLDNIISNANKYSPDGGRISFYLKKFEDEIEISIADEGLGVPEEDLANVFDRFFRVDKARSREMGGTGLGLAIAREVIEAHGGRIWAERNKSKGTVIKFTL

SEQ ID NO: 39 - protein, 595 aa, Oceanobacillus iheyensis HTE831
FRSIQLKFIIIYILLLIIAVQVIGSFFTDRLNEELTRNFKTTVGERVEMLSHNLEQAFARDRSEESGTIESLEEEIRRIINDINRGNASTTINVVDNQSRVRGTNVLDDQNQIGQKLAHPMVRDALLFNSTDDSIFYEKDTDSRVYVYVKPILGEDNMAVGAIFYKSSLEEVYGQIEDINNIFLQGSILAITISAIIGILVARTITKPIMEMREQALIMANGDFTQKVNVYGRDEIGQLAETFNDLNSRLKHSYATIEEERRKLSSILANMSDGVIATDNDGSVTLMNDAAAKLIGENPEDLIGDSVIDVLHLEGKEIDLSELHSNGSMIIDFSNEDTPFLIRANFSTVVDEEEEVTGFITVISDVTEQQKMEQERRDFVSNVSHELRTPLTTMKSYLEALSDGAWENKEIAPRFLDVTQKETNRMIRMVNDLLQLSKMDSDELPMHKQREEFTSYLYQVLDRYEMNKPESIHMEKNIPNTKAYVWMDRDKITQVLDNVITNAIKYSPDGGKIRVKLDIRRHYLLVSIQDQGMGIAYDKLDKIFERFYRVDKARNRKLGGTGLGLAITKELVEAHHGQIWAQSSEGKGTTILFTL

SEQ ID NO: 40 - protein, 597 aa, Bacillus coagulans 36D1
FQSIHFKFVLIYILLIVVAMEIIGVYFINKLENQLETNFKKSIYDQVNVLEYSIEDLLTKKQNQAADITLKVRKVLGDFKSTDVSEIRLIDAHSGVILGTSSNDQSIVGQKTTEDIVKSVRVTGQPEDQIYLDKQTGDRMWVLASPIKANGELIGIIYLVSKIETVYRQVQAINQIFMTGTVIAVLVTALLGIITARTISKPLSEIRKQAMAMARGNFARKVKVIGNDEIGQLAYSFNHMTKKLQEAQASTEGERRKLDSILTHMTDGVIATDRRGRIILINEPAAEMLDVSRETVLSQPLISVLKIENEHKFDDLLTEQDSVILDFSTEEEPYILRANFSVIQNEAGFVSGLITVLHDVTEQEKIDMERREFVANVSHELRTPLTTMRSYLEALTDGAWKDEKIAPQFLGVTQNETERMIRLVNDLLKLSKMDSKDEHLNKEWVNFVEFFHHVIDRFEMAKQQNVTFKRKLPNTEIFVEIDEDKMTQVLYNIISNALKYSPEGGQITFKLRELNEKIEVSISDQGVGIPKENVKKIFERFYRVDKARSRKLGGTGLGLAIAKEMVEMHGGSIWASSKEGKGTTIYFTLPYEPAQED

SEQ ID NO: 41 - protein, 598 aa, Exiguobacterium sibiricum 255-15
FKSIQWKLVVIYALLILVAMQVIGVYFVRSLEKQYITNFSKSVEDRAGLVAYNVGKEFDKTGDDEASKRQLSESLGQLLSEFSSGSTSRNDILEVQIIDQDSIIQATSDEDNQSAVGQRATNSLIKKAQATSSSRVDTVLDPTTEDKIRIFAVPVTSERTGATTGMIYVRASMESIYSQMQQVTRILATGTVIALVITSILGVLLSRTITRPISDMRRQAIEMRRGNFSRKVKVYSDDEIGQLARSFNELTDELLEANATTEAERRKLTSVLENMTDGVIATDRTLRVILMNDQAKDIVGVDESGIVGTNLKDLLALGDDFMIPEDGTMPPRLLDFSSEDELFLVRAFFSPVKKHSGPITGMIIVLHDVTEQEQVEQDRREFVANVSHELRTPLTTMRSYLEALAEGAYQDEELAPRFLETTQNETERMIRLVTDLLQLSKMDSKEYKMNKVRFDYIQFLNDILDRHDMTKPERIRFRRKIMKRKVYIRGDQDKLIQVADNILTNAIKYSPEGGTITVRTMLRAKRIVISIKDEGVGIPKANLQKIFERFYRVDKARARKIGGTGLGLSIAKDVVSAHGGDIWAESEWGRGTTIYFTL

SEQ ID NO: 42 - protein, 589 aa, Artificial
  Substituion in SEQ ID NO 35
MMRFRSLRVKLVMVYTLLILFAVELIGAYFVQALTSSLVRNQAQTARTQAQLMATLIAPELAPGARVSNSAVSNLLQSVPQFLNGTVYVLNQSGYVMYTTAGGALVGQKRIDSVATQALLHHTFAQSVRYDPLSKSHLLAVAVPVTLHGTYLGVLEYVLSIQSTYETIHQATTIFYTGSIAVLAIVMILGAIVARALTRPVMEVTRQAEVMARGDFSQRLEAMSNDEIGDLVASINHLADELEEAIAANRLEQERLRAVITSMGEGVIVLDSSGQVLMMNRAARQMLSQAAGGEEEAIRQLELDRLMQGDVATGVREVRVIGNTIFHVILTSVQRRGQVDGYVAVVRDVTEQEKLDQARRDFVSNVSHELRTPLTTVKSYLEVMRDLGDDEAETKREFLEVIARETDRMVRLTRDLLLLSGLDRGGPRSVEMRAIPVHGLLEGVVERFQLQAAKQELSLRVHLPQRRDVCVYGDEDMVNRVLENVLSNALKYTPPGGRIEVRADVTAQHVTFIISDTGIGIPPEDLPHVFERFYRVEKGRSRRGGGTGLGLALAREMVERMGGEIRMESEPQRGTTVYVTLRRAEEDAV

SEQ ID NO: 43 - protein, 589 aa, Artificial
  Substituion in SEQ ID NO 35
MMRFRSLRVKLVMVYTLLILFAVELIGAYFVQALTSSLVRNQAQTARTQAQLMATLIAPELAPGARVSNSAVSNLLQSVPQFLNGTVYVLNQSGYVMYTTAGGALVGQKRIDSVATQALLHHTFAQSVRYDPLSKSHLLAVAVPVTLHGTYLGVLEYVLSIQSTYETIHQATTIFYTGSIAVLAIVMILGAIVARALTRPVMEVTRQAEVMARGDFSQRLEAMSNDEIGDLVASINHLADELEEAIAANRLEQERLRAVITSMGEGVIVLDSSGQVLMMNRAARQMLSQAAGGDEEAIRQLELDRLMQGDVATGVREVRVIGNTIFHVILTSVQRRGQVDGYVAVVRDVTEQEKLDQARRDFVSNVSHELRTPLTTVKSYLEVMRDLGDDEAETKREFLEVIARETDRMVRLTRDLLLLSGLDRGGPRSVEMRAIPVHGLLEGVVERFQLQAAKQELSLRVHLPQRRDVCVYGDEDMVNRVLDNVLSNALKYTPPGGRIEVRADVTAQHVTFIISDTGIGIPPEDLPHVFERFYRVEKGRSRRGGGTGLGLALAREMVERMGGEIRMESEPQRGTTVYVTLRRAEEDAV

SEQ ID NO: 44 - protein, 589 aa, Artificial
  Substituion in SEQ ID NO 35
MMRFRSLRVKLVMVYTLLILFAVELIGAYFVQALTSSLVRNQAQTARTQAQLMATLIAPELAPGARVSNSAVSNLLQSVPQFLNGTVYVLNQSGYVMYTTAGGALVGQKRIDSVATQALLHHTFAQSVRYDPLSKSHLLAVAVPVTLHGTYLGVLEYVLSIQSTYETIHQATTIFYTGSIAVLAIIMILGAIVARALTRPVMEVTRQAEVMARGDFSQRLEAMSNDEIGDLVASINHLADELEEAIAANRLEQERLRAVITSMGEGVIVLDSSGQVLMMNRAARQMLSQAAGGEEEAIRQLELDRLMQGDVATGVREVRVIGNTIFHVILTSVQRRGQVDGYVAVVRDVTEQEKLDQARRDFVSNVSHELRTPLTTVKSYLEVMRDLGDDEAETKREFLEVIARETDRMVRLTRDLLLLSGLDRGGPRSVEMRAIPVHGLLEGVVERFQLQAAKQELSLRVHLPQRRDVCVYGDEDMVNRVLDNVLSNALKYTPPGGRIEVRADVTAQHVTFIISDTGIGIPPEDLPHVFERFYRVEKGRSRRGGGTGLGLALAREMVERMGGEIRMESEPQRGTTVYVTLRRAEEDAV

SEQ ID NO: 45 - protein, 589 aa, Artificial
  Substituion in SEQ ID NO 35
MMRFRSLRVKLVMVYTLLILFAVELIGAYFVQALTSSLVRNQAQTARTQAQLMATLIAPELAPGARVSNSAVSNLLQSVPQFLNGTVYVINQSGYVMYTTAGGALVGQKRIDSVATQALLHHTFAQSVRYDPLSKSHLLAVAVPVTLHGTYLGVLEYVLSIQSTYETIHQATTIFYTGSIAVLAIVMILGAIVARALTRPVMEVTRQAEVMARGDFSQRLEAMSNDEIGDLVASINHLADELEEAIAANRLEQERLRAVITSMGEGVIVLDSSGQVLMMNRAARQMLSQAAGGEEEAIRQLELDRLMQGDVATGVREVRVIGNTIFHVILTSVQRRGQVDGYVAVVRDVTEQEKLDQARRDFVSNVSHELRTPLTTVKSYLEVMRDLGDDEAETKREFLEVIARETDRMVRLTRDLLLLSGLDRGGPRSVEMRAIPVHGLLEGVVERFQLQAAKQELSLRVHLPQRRDVCVYGDEDMVNRVLDNVLSNALKYTPPGGRIEVRADVTAQHVTFIISDTGIGIPPEDLPHVFERFYRVEKGRSRRGGGTGLGLALAREMVERMGGEIRMESEPQRGTTVYVTLRRAEEDAV

SEQ ID NO: 46 - protein, 589 aa, Artificial
  Substituion in SEQ ID NO 35
MMRFRSLRVKLVMVYTLLILFAIELIGAYFVQALTSSLVRNQAQTARTQAQLMATLIAPELAPGARVSNSAVSNLLQSVPQFLNGTVYVLNQSGYVMYTTAGGALVGQKRIDSVATQALLHHTFAQSVRYDPLSKSHLLAVAVPVTLHGTYLGVLEYVLSIQSTYETIHQATTIFYTGSIAVLAIVMILGAIVARALTRPVMEVTRQAEVMARGDFSQRLEAMSNDEIGDLVASINHLADELEEAIAANRLEQERLRAVITSMGEGVIVLDSSGQVLMMNRAARQMLSQAAGGEEEAIRQLELDRLMQGDVATGVREVRVIGNTIFHVILTSVQRRGQVDGYVAVVRDVTEQEKLDQARRDFVSNVSHELRTPLTTVKSYLEVMRDLGDDEAETKREFLEVIARETDRMVRLTRDLLLLSGLDRGGPRSVEMRAIPVHGLLEGVVERFQLQAAKQELSLRVHLPQRRDVCVYGDEDMVNRVLDNVLSNALKYTPPGGRIEVRADVTAQHVTFIISDTGIGIPPEDLPHVFERFYRVEKGRSRRGGGTGLGLALAREMVERMGGEIRMESEPQRGTTVYVTLRRAEEDAV

SEQ ID NO: 47 - DNA, 1770 bp, Artificial
  Substituion in SEQ ID NO 36
atgatgcggttccgaagcctgcgcgtgaagctcgtcatggtctacacgctgctcatcctgttcgccgtggagctcatcggcgcgtacttcgtccaggcgctgacgtcctcgctcgtgcgcaatcaggcgcagaccgcgcgcacgcaggcgcagctcatggcgacactcatcgcgccggaactcgcgcctggcgcgcgcgtgtccaacagtgcggtgtcgaatctgctccagtcggtgccccagttcctgaacggcaccgtgtacgtgctcaaccaaagcggctacgtgatgtacaccaccgccggcggcgcgctcgtggggcagaagcggattgactccgtcgccacgcaggcgctgcttcaccacacgtttgcgcagtccgtgcgctacgatcccctgtcgaagagccacctgcttgccgtggctgtgcccgtgacgctgcacgggacctatctcggcgtgctcgaatacgtcctgtccatccagtccacctacgagaccatccaccaagccaccaccatcttctacaccggttccatcgctgttctggccatcgtcatgatcctcggagccatcgtcgcccgtgccctgacgcgcccggtgatggaggtgacgcgacaggcggaggtgatggcgcgaggagacttctcgcagcgcctcgaggcgatgagcaacgacgaaatcggcgatctcgtcgcgtccatcaaccacctcgcggacgagctcgaagaggcgatcgcggcgaaccggttggagcaggaacggctgcgcgccgtcatcacgtcgatgggcgagggcgtgatcgtgctcgattcgtccgggcaggtgttgatgatgaatcgcgcggcgaggcagatgttgagccaggccgccggcggcgaagaggaggccattcggcagctcgagctggatcggctgatgcagggagacgtggcgacgggcgtgcgagaggtgcgcgtgattggcaacaccatctttcacgtcatcctgacgagcgttcagcgccgcggccaggtggacggctacgtcgcggtcgtccgagacgtgaccgagcaggagaaactcgaccaggcgcgccgggacttcgtcagcaacgtgtcgcacgagctgcgcacgccgctcaccacggtgaagtcgtacctcgaggtgatgcgcgatctcggcgacgacgaggcggagaccaagcgcgagttcctcgaggtcattgcgcgcgagacggatcgcatggtgcggctgacgcgggacctgctcttgttgtcagggctggaccggggcggcccgcgcagcgtggagatgagggccatcccggtgcacggcctgctcgaaggcgtggtggagcggtttcagctccaggcggcgaagcaggagctgtcccttcgcgttcacctgccgcagcgccgcgacgtgtgcgtgtacggggatgaggacatggtcaaccgcgtgctggaaaacgtcctgtcgaacgcgctgaaatacacgccgccgggcgggcggatcgaggtgcgggcggacgtcacagcgcagcacgtgaccttcatcatctcggataccggcatcggcattcctcccgaagacctgccgcacgtcttcgagcggttctaccgggtcgaaaaggggcgaagccgccgcggcggcggcacggggctcggacttgccctggcgcgcgagatggtggagcgcatgggtggcgagatccggatggagagcgaaccgcagcgaggcaccaccgtgtacgtgacgctgcgccgcgccgaggaggatgccgtatga

SEQ ID NO: 48 - DNA, 1770 bp, Artificial
  Substituion in SEQ ID NO 36
atgatgcggttccgaagcctgcgcgtgaagctcgtcatggtctacacgctgctcatcctgttcgccgtggagctcatcggcgcgtacttcgtccaggcgctgacgtcctcgctcgtgcgcaatcaggcgcagaccgcgcgcacgcaggcgcagctcatggcgacactcatcgcgccggaactcgcgcctggcgcgcgcgtgtccaacagtgcggtgtcgaatctgctccagtcggtgccccagttcctgaacggcaccgtgtacgtgctcaaccaaagcggctacgtgatgtacaccaccgccggcggcgcgctcgtggggcagaagcggattgactccgtcgccacgcaggcgctgcttcaccacacgtttgcgcagtccgtgcgctacgatcccctgtcgaagagccacctgcttgccgtggctgtgcccgtgacgctgcacgggacctatctcggcgtgctcgaatacgtcctgtccatccagtccacctacgagaccatccaccaagccaccaccatcttctacaccggttccatcgctgttctggccatcgtcatgatcctcggagccatcgtcgcccgtgccctgacgcgcccggtgatggaggtgacgcgacaggcggaggtgatggcgcgaggagacttctcgcagcgcctcgaggcgatgagcaacgacgaaatcggcgatctcgtcgcgtccatcaaccacctcgcggacgagctcgaagaggcgatcgcggcgaaccggttggagcaggaacggctgcgcgccgtcatcacgtcgatgggcgagggcgtgatcgtgctcgattcgtccgggcaggtgttgatgatgaatcgcgcggcgaggcagatgttgagccaggccgccggcggcgatgaggaggccattcggcagctcgagctggatcggctgatgcagggagacgtggcgacgggcgtgcgagaggtgcgcgtgattggcaacaccatctttcacgtcatcctgacgagcgttcagcgccgcggccaggtggacggctacgtcgcggtcgtccgagacgtgaccgagcaggagaaactcgaccaggcgcgccgggacttcgtcagcaacgtgtcgcacgagctgcgcacgccgctcaccacggtgaagtcgtacctcgaggtgatgcgcgatctcggcgacgacgaggcggagaccaagcgcgagttcctcgaggtcattgcgcgcgagacggatcgcatggtgcggctgacgcgggacctgctcttgttgtcagggctggaccggggcggcccgcgcagcgtggagatgagggccatcccggtgcacggcctgctcgaaggcgtggtggagcggtttcagctccaggcggcgaagcaggagctgtcccttcgcgttcacctgccgcagcgccgcgacgtgtgcgtgtacggggatgaggacatggtcaaccgcgtgctggacaacgtcctgtcgaacgcgctgaaatacacgccgccgggcgggcggatcgaggtgcgggcggacgtcacagcgcagcacgtgaccttcatcatctcggataccggcatcggcattcctcccgaagacctgccgcacgtcttcgagcggttctaccgggtcgaaaaggggcgaagccgccgcggcggcggcacggggctcggacttgccctggcgcgcgagatggtggagcgcatgggtggcgagatccggatggagagcgaaccgcagcgaggcaccaccgtgtacgtgacgctgcgccgcgccgaggaggatgccgtatga

SEQ ID NO: 49 - DNA, 1770 bp, Artificial
  Substituion in SEQ ID NO 36
atgatgcggttccgaagcctgcgcgtgaagctcgtcatggtctacacgctgctcatcctgttcgccgtggagctcatcggcgcgtacttcgtccaggcgctgacgtcctcgctcgtgcgcaatcaggcgcagaccgcgcgcacgcaggcgcagctcatggcgacactcatcgcgccggaactcgcgcctggcgcgcgcgtgtccaacagtgcggtgtcgaatctgctccagtcggtgccccagttcctgaacggcaccgtgtacgtgctcaaccaaagcggctacgtgatgtacaccaccgccggcggcgcgctcgtggggcagaagcggattgactccgtcgccacgcaggcgctgcttcaccacacgtttgcgcagtccgtgcgctacgatcccctgtcgaagagccacctgcttgccgtggctgtgcccgtgacgctgcacgggacctatctcggcgtgctcgaatacgtcctgtccatccagtccacctacgagaccatccaccaagccaccaccatcttctacaccggttccatcgctgttctggccatcattatgatcctcggagccatcgtcgcccgtgccctgacgcgcccggtgatggaggtgacgcgacaggcggaggtgatggcgcgaggagacttctcgcagcgcctcgaggcgatgagcaacgacgaaatcggcgatctcgtcgcgtccatcaaccacctcgcggacgagctcgaagaggcgatcgcggcgaaccggttggagcaggaacggctgcgcgccgtcatcacgtcgatgggcgagggcgtgatcgtgctcgattcgtccgggcaggtgttgatgatgaatcgcgcggcgaggcagatgttgagccaggccgccggcggcgaagaggaggccattcggcagctcgagctggatcggctgatgcagggagacgtggcgacgggcgtgcgagaggtgcgcgtgattggcaacaccatctttcacgtcatcctgacgagcgttcagcgccgcggccaggtggacggctacgtcgcggtcgtccgagacgtgaccgagcaggagaaactcgaccaggcgcgccgggacttcgtcagcaacgtgtcgcacgagctgcgcacgccgctcaccacggtgaagtcgtacctcgaggtgatgcgcgatctcggcgacgacgaggcggagaccaagcgcgagttcctcgaggtcattgcgcgcgagacggatcgcatggtgcggctgacgcgggacctgctcttgttgtcagggctggaccggggcggcccgcgcagcgtggagatgagggccatcccggtgcacggcctgctcgaaggcgtggtggagcggtttcagctccaggcggcgaagcaggagctgtcccttcgcgttcacctgccgcagcgccgcgacgtgtgcgtgtacggggatgaggacatggtcaaccgcgtgctggacaacgtcctgtcgaacgcgctgaaatacacgccgccgggcgggcggatcgaggtgcgggcggacgtcacagcgcagcacgtgaccttcatcatctcggataccggcatcggcattcctcccgaagacctgccgcacgtcttcgagcggttctaccgggtcgaaaaggggcgaagccgccgcggcggcggcacggggctcggacttgccctggcgcgcgagatggtggagcgcatgggtggcgagatccggatggagagcgaaccgcagcgaggcaccaccgtgtacgtgacgctgcgccgcgccgaggaggatgccgtatga

SEQ ID NO: 50 - DNA, 1770 bp, Artificial
  Substituion in SEQ ID NO 36
atgatgcggttccgaagcctgcgcgtgaagctcgtcatggtctacacgctgctcatcctgttcgccgtggagctcatcggcgcgtacttcgtccaggcgctgacgtcctcgctcgtgcgcaatcaggcgcagaccgcgcgcacgcaggcgcagctcatggcgacactcatcgcgccggaactcgcgcctggcgcgcgcgtgtccaacagtgcggtgtcgaatctgctccagtcggtgccccagttcctgaacggcaccgtgtacgtgattaaccaaagcggctacgtgatgtacaccaccgccggcggcgcgctcgtggggcagaagcggattgactccgtcgccacgcaggcgctgcttcaccacacgtttgcgcagtccgtgcgctacgatcccctgtcgaagagccacctgcttgccgtggctgtgcccgtgacgctgcacgggacctatctcggcgtgctcgaatacgtcctgtccatccagtccacctacgagaccatccaccaagccaccaccatcttctacaccggttccatcgctgttctggccatcgtcatgatcctcggagccatcgtcgcccgtgccctgacgcgcccggtgatggaggtgacgcgacaggcggaggtgatggcgcgaggagacttctcgcagcgcctcgaggcgatgagcaacgacgaaatcggcgatctcgtcgcgtccatcaaccacctcgcggacgagctcgaagaggcgatcgcggcgaaccggttggagcaggaacggctgcgcgccgtcatcacgtcgatgggcgagggcgtgatcgtgctcgattcgtccgggcaggtgttgatgatgaatcgcgcggcgaggcagatgttgagccaggccgccggcggcgaagaggaggccattcggcagctcgagctggatcggctgatgcagggagacgtggcgacgggcgtgcgagaggtgcgcgtgattggcaacaccatctttcacgtcatcctgacgagcgttcagcgccgcggccaggtggacggctacgtcgcggtcgtccgagacgtgaccgagcaggagaaactcgaccaggcgcgccgggacttcgtcagcaacgtgtcgcacgagctgcgcacgccgctcaccacggtgaagtcgtacctcgaggtgatgcgcgatctcggcgacgacgaggcggagaccaagcgcgagttcctcgaggtcattgcgcgcgagacggatcgcatggtgcggctgacgcgggacctgctcttgttgtcagggctggaccggggcggcccgcgcagcgtggagatgagggccatcccggtgcacggcctgctcgaaggcgtggtggagcggtttcagctccaggcggcgaagcaggagctgtcccttcgcgttcacctgccgcagcgccgcgacgtgtgcgtgtacggggatgaggacatggtcaaccgcgtgctggacaacgtcctgtcgaacgcgctgaaatacacgccgccgggcgggcggatcgaggtgcgggcggacgtcacagcgcagcacgtgaccttcatcatctcggataccggcatcggcattcctcccgaagacctgccgcacgtcttcgagcggttctaccgggtcgaaaaggggcgaagccgccgcggcggcggcacggggctcggacttgccctggcgcgcgagatggtggagcgcatgggtggcgagatccggatggagagcgaaccgcagcgaggcaccaccgtgtacgtgacgctgcgccgcgccgaggaggatgccgtatga

SEQ ID NO: 51 - DNA, 1770 bp, Artificial
  Substituion in SEQ ID NO 36
atgatgcggttccgaagcctgcgcgtgaagctcgtcatggtctacacgctgctcatcctgttcgccattgagctcatcggcgcgtacttcgtccaggcgctgacgtcctcgctcgtgcgcaatcaggcgcagaccgcgcgcacgcaggcgcagctcatggcgacactcatcgcgccggaactcgcgcctggcgcgcgcgtgtccaacagtgcggtgtcgaatctgctccagtcggtgccccagttcctgaacggcaccgtgtacgtgctcaaccaaagcggctacgtgatgtacaccaccgccggcggcgcgctcgtggggcagaagcggattgactccgtcgccacgcaggcgctgcttcaccacacgtttgcgcagtccgtgcgctacgatcccctgtcgaagagccacctgcttgccgtggctgtgcccgtgacgctgcacgggacctatctcggcgtgctcgaatacgtcctgtccatccagtccacctacgagaccatccaccaagccaccaccatcttctacaccggttccatcgctgttctggccatcgtcatgatcctcggagccatcgtcgcccgtgccctgacgcgcccggtgatggaggtgacgcgacaggcggaggtgatggcgcgaggagacttctcgcagcgcctcgaggcgatgagcaacgacgaaatcggcgatctcgtcgcgtccatcaaccacctcgcggacgagctcgaagaggcgatcgcggcgaaccggttggagcaggaacggctgcgcgccgtcatcacgtcgatgggcgagggcgtgatcgtgctcgattcgtccgggcaggtgttgatgatgaatcgcgcggcgaggcagatgttgagccaggccgccggcggcgaagaggaggccattcggcagctcgagctggatcggctgatgcagggagacgtggcgacgggcgtgcgagaggtgcgcgtgattggcaacaccatctttcacgtcatcctgacgagcgttcagcgccgcggccaggtggacggctacgtcgcggtcgtccgagacgtgaccgagcaggagaaactcgaccaggcgcgccgggacttcgtcagcaacgtgtcgcacgagctgcgcacgccgctcaccacggtgaagtcgtacctcgaggtgatgcgcgatctcggcgacgacgaggcggagaccaagcgcgagttcctcgaggtcattgcgcgcgagacggatcgcatggtgcggctgacgcgggacctgctcttgttgtcagggctggaccggggcggcccgcgcagcgtggagatgagggccatcccggtgcacggcctgctcgaaggcgtggtggagcggtttcagctccaggcggcgaagcaggagctgtcccttcgcgttcacctgccgcagcgccgcgacgtgtgcgtgtacggggatgaggacatggtcaaccgcgtgctggacaacgtcctgtcgaacgcgctgaaatacacgccgccgggcgggcggatcgaggtgcgggcggacgtcacagcgcagcacgtgaccttcatcatctcggataccggcatcggcattcctcccgaagacctgccgcacgtcttcgagcggttctaccgggtcgaaaaggggcgaagccgccgcggcggcggcacggggctcggacttgccctggcgcgcgagatggtggagcgcatgggtggcgagatccggatggagagcgaaccgcagcgaggcaccaccgtgtacgtgacgctgcgccgcgccgaggaggatgccgtatga

SEQ ID NO: 52 - protein, 230 aa, Alicyclobacillus acidocaldarius
MPAHILVVEDEEPIANILRFALEREGYRVSCAYDGAEALERWRALQPDLILLDVMLPEVDGFDVLRAIRQASGVPVIILTAKDDEVDKVLGLELGADDYVTKPFSTRELVARVKANLRRASDVLREHKENERYVVQDLVIDLAEYTVTKAGQPIPLTHREFQVLAVLAAHPGRVFTRDQLVDQVWGSDYVGDTRAVDVTIRRLREKLEPDPSQPRYVLTRRGVGYYVRNE

SEQ ID NO: 53 - DNA, 693 bp, Alicyclobacillus acidocaldarius
atgcctgcgcacatcctggtggtcgaagacgaggagcccatcgcaaacatcctccgctttgcgctggagcgagagggctaccgggtctcctgcgcgtacgacggggcggaggccttagagcgctggcgagccctccagccggacctgatcctgctcgacgtgatgttgccggaggtggacggcttcgatgtgctccgggcgatccgccaggcctcgggcgttccggtgatcatcctcacggcgaaagacgacgaggtcgacaaagtgctcgggctggagcttggggcggacgactacgtgacgaagccattcagcacgcgcgagcttgtggcgcgcgtcaaggcgaacctgcggcgcgcatcggacgtcctgcgggagcacaaggagaacgagcggtacgtggtgcaggacttggtgattgatctcgccgaatacaccgtcaccaaggcggggcagccgattccactcacgcaccgagagtttcaggtgctcgctgttctcgccgcgcatccgggccgcgtgttcacgcgcgatcagctggtggaccaggtctggggcagcgactacgtgggcgacacccgggcggtggacgtgaccatccgccgactgcgggagaagctggaacccgatccgagccagccgcggtacgtgttgacgcgccgcggcgtcgggtactatgtgaggaatgaatga

SEQ ID NO: 54 - protein, 232 aa, Bacillus sp. NRRL B-14911
MDKKILVVDDEKPIADILQFNLKKEGYEVHCAYDGNEALEKVEEVKPDLILLDIMLPQRDGMEVCREVRKKYEMPIIMLTAKDSEIDKVLGLELGADDYVTKPFSNRELIARVKANLRRHQQIAAKAGEEEETNEIAIGSLVIHPDAYVVSKRGETIELTHREFELLHYLAKHIGQVMTREHLLQTVWGYDYYGDVRTVDVTVRRLREKIEDNPSHPTWIVTRRGVGYYLRN

SEQ ID NO: 55 - protein, 232 aa, Bacillus coagulans 36D1
MDKKILVVDDEKPIADILQFNLTKEGYTVYCAYDGEEALEKVEEVQPDLIVLDIMLPKRDGMEVCREVRKKYNMPIIMVTAKDSEIDKVLGLELGADDYVTKPFSTRELIARVKANLRRHQQTPAAPGEEEESNEIAIGSLVIHPDAYVVSKRGETIELTHREFELLHYLAKHIGQVMTREHLLETVWGYDYYGDVRTVDVTVRRLREKVEDNPSHPEWIVTRRGVGYYLRN

SEQ ID NO: 56 - protein, 232 aa, Geobacillus thermodenitrificans NG80-2
MEKRILVVDDEKPIADILQFNLQKEGYEVICAYDGEEALQKVEETMPDLILLDIMLPLKDGMEVCREVRKKYDMPIIMLTAKDSEIDKVLGLELGADDYVTKPFSTRELLARVKANLRRHAQTATQEEEESETNEIVVGPLVIRPDAYVVQKRGETIELTHREFELLHYLAKHIGQVMTREHLLQTVWGYDYYGDVRTVDVTVRRLREKIEDNPSHPSWIVTRRGVGYYLRN

SEQ ID NO: 57 - protein, 232 aa, Geobacillus kaustophilus HTA426
MEKRILVVDDEKPIADILQFNLQKEGYEVICAYDGEEALQKVEETMPDLILLDIMLPLKDGMEVCREVRKKYDMPIIMLTAKDSEIDKVLGLELGADDYVTKPFSTRELLARVKANLRRHAQTANQEEGENETNEIVIGPLVIRPDAYVVQKRGETIELTHREFELLHYLAKHIGQVMTREHLLQTVWGYDYYGDVRTVDVTVRRLREKIEDNPSHPNWIVTRRGVGYYLRN

SEQ ID NO: 58 - protein, 229 aa, Lactobacillus salivarius UCC118
ILVVDDEKPISDIVKFNLTKEGYDVYTAYDGEEALQQVKEVEPDLILLDLMLPKIDGLEVAREVRKTHDMPIIMVTAKDSEIDKVLGLELGADDYVTKPFSNRELVARVKANLRRQSAVAAKSSAEDDKNSEITVGDLTIHPEAYTVSKNGQRIELTHREFELLHYLAQHLGQVMTREHLLQTVWGYDYFGDVRTVDVTVRRLREKIEDNPSRPTWLVTRRGVGYYLRN

SEQ ID NO: 59 - protein, 230 aa, Artificial
  Substituion in SEQ ID NO 52
MPAHILVVEDEEPIANILRFALEREGYRVSCAYDGAEALERWRALQPDLILLDVMLPEVDGFDVLRAIRQASGVPVIILTAKDDEVDKVLGLELGADDYVTKPFSTRELIARVKANLRRASDVLREHKENERYVVQDLVIDLAEYTVTKAGQPIPLTHREFQVLAVLAAHPGRVFTRDQLVDQVWGSDYVGDTRAVDVTIRRLREKLEPDPSQPRYVLTRRGVGYYVRNE

SEQ ID NO: 60 - protein, 230 aa, Artificial
  Substituion in SEQ ID NO 52
MPAHILVVEDEEPIANILRFALEREGYRVSCAYDGAEALERWRALQPDLILLDVMLPEVDGFDVLRAIRQASGVPVIILTAKDDEVDKVLGLELGADDYVTKPFSTRELVARVKANLRRASDVLREHKENERYVVNDLVIDLAEYTVTKAGQPIPLTHREFQVLAVLAAHPGRVFTRDQLVDQVWGSDYVGDTRAVDVTIRRLREKLEPDPSQPRYVLTRRGVGYYVRNE

SEQ ID NO: 61 - protein, 230 aa, Artificial
  Substituion in SEQ ID NO 52
MPAHILVVEDEEPIANILRFALEREGYRVSCAYDGAEALERWRALQPDLILLDVMLPEVDGFDVLRAIRQASGVPVIILTAKDDEVDKVLGLELGADDYVTKPFSTRELVARVKANLRRASDVLREHKENERYVVQDLVIDLAEYTVTKAGQPIPLTHREFQVLAVLAAHPGRVFTRDQLVDQVWGSDYVGDTRAVDVTIRRLREKLEPDPSQPRYVITRRGVGYYVRNE

SEQ ID NO: 62 - protein, 230 aa, Artificial
  Substituion in SEQ ID NO 52
MPAHILVVEDEEPIANILRFALEREGYKVSCAYDGAEALERWRALQPDLILLDVMLPEVDGFDVLRAIRQASGVPVIILTAKDDEVDKVLGLELGADDYVTKPFSTRELVARVKANLRRASDVLREHKENERYVVQDLVIDLAEYTVTKAGQPIPLTHREFQVLAVLAAHPGRVFTRDQLVDQVWGSDYVGDTRAVDVTIRRLREKLEPDPSQPRYVLTRRGVGYYVRNE

SEQ ID NO: 63 - protein, 230 aa, Artificial
  Substituion in SEQ ID NO 52
MPAHILVVEDEEPIANILRFALEREGYRVSCAYDGAEALERWRALQPDLILLDVMLPEVDGFDVLRAIRQASGVPVIILTAKDDEVDKVLGLELGADDYVTKPFSTRELVARVKANLRRASDVLREHKENERYVVQDLVIDLADYTVTKAGQPIPLTHREFQVLAVLAAHPGRVFTRDQLVDQVWGSDYVGDTRAVDVTIRRLREKLEPDPSQPRYVLTRRGVGYYVRNE

SEQ ID NO: 64 - DNA, 693 bp, Artificial
  Substituion in SEQ ID NO 53
atgcctgcgcacatcctggtggtcgaagacgaggagcccatcgcaaacatcctccgctttgcgctggagcgagagggctaccgggtctcctgcgcgtacgacggggcggaggccttagagcgctggcgagccctccagccggacctgatcctgctcgacgtgatgttgccggaggtggacggcttcgatgtgctccgggcgatccgccaggcctcgggcgttccggtgatcatcctcacggcgaaagacgacgaggtcgacaaagtgctcgggctggagcttggggcggacgactacgtgacgaagccattcagcacgcgcgagcttattgcgcgcgtcaaggcgaacctgcggcgcgcatcggacgtcctgcgggagcacaaggagaacgagcggtacgtggtgcaggacttggtgattgatctcgccgaatacaccgtcaccaaggcggggcagccgattccactcacgcaccgagagtttcaggtgctcgctgttctcgccgcgcatccgggccgcgtgttcacgcgcgatcagctggtggaccaggtctggggcagcgactacgtgggcgacacccgggcggtggacgtgaccatccgccgactgcgggagaagctggaacccgatccgagccagccgcggtacgtgttgacgcgccgcggcgtcgggtactatgtgaggaatgaatga

SEQ ID NO: 65 - DNA, 693 bp, Artificial
  Substituion in SEQ ID NO 53
atgcctgcgcacatcctggtggtcgaagacgaggagcccatcgcaaacatcctccgctttgcgctggagcgagagggctaccgggtctcctgcgcgtacgacggggcggaggccttagagcgctggcgagccctccagccggacctgatcctgctcgacgtgatgttgccggaggtggacggcttcgatgtgctccgggcgatccgccaggcctcgggcgttccggtgatcatcctcacggcgaaagacgacgaggtcgacaaagtgctcgggctggagcttggggcggacgactacgtgacgaagccattcagcacgcgcgagcttgtggcgcgcgtcaaggcgaacctgcggcgcgcatcggacgtcctgcgggagcacaaggagaacgagcggtacgtggtgaatgacttggtgattgatctcgccgaatacaccgtcaccaaggcggggcagccgattccactcacgcaccgagagtttcaggtgctcgctgttctcgccgcgcatccgggccgcgtgttcacgcgcgatcagctggtggaccaggtctggggcagcgactacgtgggcgacacccgggcggtggacgtgaccatccgccgactgcgggagaagctggaacccgatccgagccagccgcggtacgtgttgacgcgccgcggcgtcgggtactatgtgaggaatgaatga

SEQ ID NO: 66 - DNA, 693 bp, Artificial
  Substituion in SEQ ID NO 53
atgcctgcgcacatcctggtggtcgaagacgaggagcccatcgcaaacatcctccgctttgcgctggagcgagagggctaccgggtctcctgcgcgtacgacggggcggaggccttagagcgctggcgagccctccagccggacctgatcctgctcgacgtgatgttgccggaggtggacggcttcgatgtgctccgggcgatccgccaggcctcgggcgttccggtgatcatcctcacggcgaaagacgacgaggtcgacaaagtgctcgggctggagcttggggcggacgactacgtgacgaagccattcagcacgcgcgagcttgtggcgcgcgtcaaggcgaacctgcggcgcgcatcggacgtcctgcgggagcacaaggagaacgagcggtacgtggtgcaggacttggtgattgatctcgccgaatacaccgtcaccaaggcggggcagccgattccactcacgcaccgagagtttcaggtgctcgctgttctcgccgcgcatccgggccgcgtgttcacgcgcgatcagctggtggaccaggtctggggcagcgactacgtgggcgacacccgggcggtggacgtgaccatccgccgactgcgggagaagctggaacccgatccgagccagccgcggtacgtgattacgcgccgcggcgtcgggtactatgtgaggaatgaatga

SEQ ID NO: 67 - DNA, 693 bp, Artificial
  Substituion in SEQ ID NO 53
atgcctgcgcacatcctggtggtcgaagacgaggagcccatcgcaaacatcctccgctttgcgctggagcgagagggctacaaagtctcctgcgcgtacgacggggcggaggccttagagcgctggcgagccctccagccggacctgatcctgctcgacgtgatgttgccggaggtggacggcttcgatgtgctccgggcgatccgccaggcctcgggcgttccggtgatcatcctcacggcgaaagacgacgaggtcgacaaagtgctcgggctggagcttggggcggacgactacgtgacgaagccattcagcacgcgcgagcttgtggcgcgcgtcaaggcgaacctgcggcgcgcatcggacgtcctgcgggagcacaaggagaacgagcggtacgtggtgcaggacttggtgattgatctcgccgaatacaccgtcaccaaggcggggcagccgattccactcacgcaccgagagtttcaggtgctcgctgttctcgccgcgcatccgggccgcgtgttcacgcgcgatcagctggtggaccaggtctggggcagcgactacgtgggcgacacccgggcggtggacgtgaccatccgccgactgcgggagaagctggaacccgatccgagccagccgcggtacgtgttgacgcgccgcggcgtcgggtactatgtgaggaatgaatga

SEQ ID NO: 68 - DNA, 693 bp, Artificial
  Substituion in SEQ ID NO 53
atgcctgcgcacatcctggtggtcgaagacgaggagcccatcgcaaacatcctccgctttgcgctggagcgagagggctaccgggtctcctgcgcgtacgacggggcggaggccttagagcgctggcgagccctccagccggacctgatcctgctcgacgtgatgttgccggaggtggacggcttcgatgtgctccgggcgatccgccaggcctcgggcgttccggtgatcatcctcacggcgaaagacgacgaggtcgacaaagtgctcgggctggagcttggggcggacgactacgtgacgaagccattcagcacgcgcgagcttgtggcgcgcgtcaaggcgaacctgcggcgcgcatcggacgtcctgcgggagcacaaggagaacgagcggtacgtggtgcaggacttggtgattgatctcgccgattacaccgtcaccaaggcggggcagccgattccactcacgcaccgagagtttcaggtgctcgctgttctcgccgcgcatccgggccgcgtgttcacgcgcgatcagctggtggaccaggtctggggcagcgactacgtgggcgacacccgggcggtggacgtgaccatccgccgactgcgggagaagctggaacccgatccgagccagccgcggtacgtgttgacgcgccgcggcgtcgggtactatgtgaggaatgaatga

SEQ ID NO: 69 - protein, 156 aa, Alicyclobacillus acidocaldarius
MLNRVILIGRLTADPELRYTNNGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADDSQLIDISEDDLPF

SEQ ID NO: 70 - DNA, 471 bp, Alicyclobacillus acidocaldarius
atgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 71 - protein, 105 aa, Pelotomaculum thermopropionicum SI
MLNKVILIGRLTQDPELRYTPGGVAVARFTLAVNRARLNKQGERETDFIDVVVWQKQAETCANYIRKGRLVAVEGRLQVRSYDDSQGIRRKAAEVVAETVRFLDR

SEQ ID NO: 72 - protein, 88 aa, Bacillus halodurans C-125
MLNRVVLVGRLTRDPELRYTPNGVAVANFTLAVNRPFSNQQGEREADFINCVVWRKQAENVANYLKKGSLAGVDGRIQTRSYDNNEGR

SEQ ID NO: 73 - protein, 164 aa, Bacillus cereus subsp. cytotoxis NVH 391-98
MMNRVILVGRLTKDPDLRYTPNGVAVATFTLAVNRAFTNQQGEREADFINCVIWRKQAENVANYLKKGSLAGVDGRLQTRNYEGQDGRRVYVTEVLAESVQFLEPRNSGGEQRGSFNQQPSGAGFGNQGSNPFGQSGNSGFTKNDDPFSNVGQPIDISDDDLPF

SEQ ID NO: 74 - protein, 164 aa, Geobacillus kaustophilus HTA426
MINRVILVGRLTRDPELRYTPSGVAVATFTLAVNRPFTNQQGERETDFIQCVVWRRQAENVANFLKKGSLAGVDGRLQTRSYENQEGRRVYVTEVVADSVQFLEPKGTSEQRGATAGGYYGDPFPFGQDQNHQYPNEKGFGRIDDDPFANDGQPIDISDDDLPF

SEQ ID NO: 75 - protein, 108 aa, Symbiobacterium thermophilum IAM 14863
MLNSVVLIGRLTKDPELRYTPSGKAVATLRLAVDRGTVNQQGERETDFIDIVVWEKQAETVANYLQKGRLVAVQGRLQIRQYTTQDGQKREKAEVVATTVRFLDSARD

SEQ ID NO: 76 - protein, 156 aa, Artificial
  Substituion in SEQ ID NO 69
MLNRVILIGRLTADPELRYTQNGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADDSQLIDISEDDLPF

SEQ ID NO: 77 - protein, 156 aa, Artificial
  Substituion in SEQ ID NO 69
MLNRVILIGRLTADPELRYTNQGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADDSQLIDISEDDLPF

SEQ ID NO: 78 - protein, 156 aa, Artificial
  Substituion in SEQ ID NO 69
MLNRVILIGRLTADPELRYTNNGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADDSQLLDISEDDLPF

SEQ ID NO: 79 - protein, 156 aa, Artificial
  Substituion in SEQ ID NO 69
MLNRVILIGRLTADPELRYTNNGTAVASFTLAVDRMRSGPNGERQTDFINVVVWQKQAEIVAQYLQKGRLAAVEGRLQIRSYDNRDGQRVRVAEVVAETVRFLDRGPDQAQGSGYSAAGAQTRQQRPTPSSAPPFEDDPFADDSQLIDISEDDLPF

SEQ ID NO: 80 - protein, 156 aa, Artificial
  Substituion in SEQ ID NO 69
MLNRVLLIGRLTADPELRYTNNGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADDSQLIDISEDDLPF

SEQ ID NO: 81 - DNA, 471 bp, Artificial
  Substituion in SEQ ID NO 70
atgctgaaccgagtgattctgatcggccgcctgacggcggatccggaattgcgatacacccaaaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 82 - DNA, 471 bp, Artificial
  Substituion in SEQ ID NO 70
atgctgaaccgagtgattctgatcggccgcctgacggcggatccggaattgcgatacaccaaccaaggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 83 - DNA, 471 bp, Artificial
  Substituion in SEQ ID NO 70
atgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgttagatatctccgaagatgatcttccgttttga

SEQ ID NO: 84 - DNA, 471 bp, Artificial
  Substituion in SEQ ID NO 70
atgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgaaggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 85 - DNA, 471 bp, Artificial
  Substituion in SEQ ID NO 70
atgctgaaccgagtgttactgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 86 - protein, 282 aa, Alicyclobacillus acidocaldarius
MAKRGLGRGLDALIPQLNVSDEDQIVQIDIRDLRPNPYQPRRTFNEEKLQELCNSIREHGILQPLIVRRSQVKGFDIVAGERRYRAAKMAGLQVVPAVVRDLSDVLLMEIALIENLQREDLNPIEIADAYAKLIEKCHLTQDELAKRVGQSRSHITNMLRLLQLPAQIQDMVSRGTLTMGHARALLSVEDAEEQLRLAEQTVKEAWSVRKLEMVIYQPKKVSRETDKPALPTEYRRYQEQVQAYLGTSVRIQPGKKRGKIEIDYYSEDDLRRIMDLMLAHAP

SEQ ID NO: 87 - DNA, 849 bp, Alicyclobacillus acidocaldarius
gtggctaaacgtggtctggggcgcggtttggatgccttgatcccgcagctcaacgtgtcggacgaggatcagattgtccagattgacattcgggatcttcggccgaatccgtaccagccgcggcgaacgtttaatgaagaaaaactgcaggagttgtgcaattccattcgagaacatgggattcttcagccgctcattgttcgcaggagccaggtcaaagggttcgatattgtcgctggcgagcggcgatatcgcgccgcgaaaatggcagggctgcaggtggtgcccgcggtcgttcgcgacctgagtgatgtcctactgatggaaatcgccctcattgagaacttacagcgcgaagatctgaatcccatcgagatcgccgatgcgtacgccaagctcatcgagaaatgccacttgacgcaggatgagctggcgaagcgggtggggcagagtcggagtcacatcacgaacatgttgcggttgctgcagcttcccgctcaaattcaggacatggtttcacgtggaacattgacgatgggccacgcgcgagcgctgctctccgtggaggatgcggaggagcagcttcgactggccgagcagaccgtgaaagaggcatggagcgtgcgaaagctggaaatggtcatctaccagcccaagaaggtttcacgtgaaaccgacaagcctgcgcttccgaccgaataccggcgctatcaggaacaggttcaagcctatctgggcacatcggtccgcattcagccgggcaaaaaacgggggaagatcgagatcgattattattcggaggacgatctccggcgcatcatggacctcatgttggcgcacgctccatga

SEQ ID NO: 88 - protein, 278 aa, Bacillus clausii KSM-K16
KKGLGKGLQAFFPEQEDKQEEQIVQVDLADVRPNPYQPRKTFSEEALKELSNSIREHGILQPVTVRKAIKGYEIVMGERRVKAAKQAGLTQIPVIVQELDENKMMEIALIENLQREDLNPIEEAIAYEKLMEHTNSTQEQLAKRLGKSRPHIANHMRLLQLPKVVQEFISVGKLTMGHGRALLGLQDKQKLSQLLEKVLQDKLSVREVEQLVQRLNEHVPRETKQVKVKLPPIIKEQQERLRDTLGTSVLIKPGKKKGKIEIDYFSEDDLERILSLLV

SEQ ID NO: 89 - protein, 277 aa, Bacillus halodurans C-125
KGLGKGLNAFFPEAADETTEQVEEVKLLELRPNPYQPRKTFLEEALQELADSIKEHGILQPIVVRKSSVKGYEIVVGERRFRAAERAGLVKVPVVIRELDDQKMMEMALIENLQREDLNPIEEANAYEKLMTHLQMTQEQLAVRLGKSRPHIANHLRLLQLPKVVQEFISEGKLSMGHGRALLGLANKNEISSVLNKILEEKLSVRQVEALVQQMNERVSRGTKKAKPKLSPFLKERQDFLRSHFGTSVAIKKGKKKGKIEIEFFSDDDLERILEML

SEQ ID NO: 90 - protein, 278 aa, Bacillus amyloliquefaciens FZB42
MAKGGLGKGINALFNQVDLSEETVEEIKISDLRPNPYQPRKQFDDESLAELKESIIQHGILQPIIVRKSLKGYDIVAGERRYRAAKLAGKETVPAIVRDLSESLMREIALLENLQREDLSPLEEALAYDSLLKHLDLTQEQLAKRLGKSRPHIANHLRLLTLPESIQNLIAEGTLSMGHGRTLLGLKNKDKLEPLVKKVVEEQLNVRQLEQLIQQLNNNVPRETKKKEPVQDVVLKERESYLQNYFGTTVNIKRQKKKGKIEIEFFSNEDLERILELL

SEQ ID NO: 91 - protein, 279 aa, Paenibacillus larvae subsp. larvae BRL-230010
MSKRLGRGLDALLPSMDIEDDDKVIEIPLSKLRANPYQPRKSFNEDGIQELAASIKEHGVIQPIIVRSVLKGYEIIAGERRFRASQACGLKSIPAVVKKFSDQQVMEIALIENVQREDLNALEIAIAYQAIIDQFSLTQEELSAKVGKSRSHIANFLRLLTLPDSIKQHVSRGTLSMGHARAIVGVKDNQKKQILADACIREQWSVRQLEEEIKKLEGNSGNAKKKSKDKKRDPYIQQVEDQLRDVYRTTVKIKHQKNKGKIELLYYSNDDLERLLDML

SEQ ID NO: 92 - protein, 281 aa, Bacillus selenitireducens MLS10
KGLGKGIGAFFPDSERYEESDSQGAQNIKIKDLRPNPYQPRKHFDDEAIDELRQSIEQHGILQPLVVRKSIKGYEIVVGERRYRAAKAAKLDSVPAIVRELTDDEMMELALIENLQREDLNPLEEAKAYKKLMEHLSLTQDQLSVKLGKSRPHIANYLRLLQAPQIVQQYLQEEKISTGHARALLGLKEDKKLSPLLQKTIKEQWSVRHLESVIHDMNENVSRETSKGKPALDVYLKDREAFLKSYFGTNVTIKPGKKKSKIEIDFFDDDDLQRILRLMSA

SEQ ID NO: 93 - protein, 282 aa, Artificial
  Substituion in SEQ ID NO 86
MAKRGLGRGLDALIPQLNVSDEDQIVQIDIRDLRPNPYQPRRTFNEEKLQELCNSIREHGILQPLIVRRSQVKGFDIVAGERRYRAAKMAGLQVVPAVVRDLSDVLLMEIALIENLQREDLNPIEIADAYAKLIEKCHLTQDELAKRVGQSRSHITNMLRLLQLPAQIQDMVSRGTLTMGHARALLSVEDAEEQLRLAEQTVKEAWSVRKLEMVIYQPKKVSRETDKPALPTEYRRYQEQVQAYLGTSVRINPGKKRGKIEIDYYSEDDLRRIMDLMLAHAP

SEQ ID NO: 94 - protein, 282 aa, Artificial
  Substituion in SEQ ID NO 86
MAKRGLGRGLDALIPQLNVSDEDQIVQIDIRDLRPNPYQPRRTFNEEKLQELCNSIREHGILQPLIVRRSQVKGFDIVAGERRYRAAKMAGLQVVPAVVRDLSDVLLMEIALIENLQREDLNPIEIADAYAKLIEKCHLTQDELAKRVGQSRSHITNMLRLLQLPAQIQDMVSRGTLTMGHARALLSVEDAEEQLRLAEQTVKEAWSVRKLEMVIYNPKKVSRETDKPALPTEYRRYQEQVQAYLGTSVRIQPGKKRGKIEIDYYSEDDLRRIMDLMLAHAP

SEQ ID NO: 95 - protein, 282 aa, Artificial
  Substituion in SEQ ID NO 86
MAKRGLGRGLDALIPQLNVSDEDQIVQIDIRDLRPNPYQPRRTFNEEKLQELCNSIREHGILQPLIVRRSQVKGFDIVAGERRYRAAKMAGLQVVPAVVRDLSDVLLMEIALIENLQREDLNPIEIADAYAKLIEKCHLTQDELAKRVGQSRSHITNMLRLLQLPAQIQDMVSRGTLTMGHARALLSVEDAEEQLRLAEQTVREAWSVRKLEMVIYQPKKVSRETDKPALPTEYRRYQEQVQAYLGTSVRIQPGKKRGKIEIDYYSEDDLRRIMDLMLAHAP

SEQ ID NO: 96 - protein, 282 aa, Artificial
  Substituion in SEQ ID NO 86
MAKRGLGRGLDALIPQLNVSDEDQIVQIDIRDLRPNPYQPRRTFNEERLQELCNSIREHGILQPLIVRRSQVKGFDIVAGERRYRAAKMAGLQVVPAVVRDLSDVLLMEIALIENLQREDLNPIEIADAYAKLIEKCHLTQDELAKRVGQSRSHITNMLRLLQLPAQIQDMVSRGTLTMGHARALLSVEDAEEQLRLAEQTVKEAWSVRKLEMVIYQPKKVSRETDKPALPTEYRRYQEQVQAYLGTSVRIQPGKKRGKIEIDYYSEDDLRRIMDLMLAHAP

SEQ ID NO: 97 - protein, 282 aa, Artificial
  Substituion in SEQ ID NO 86
MAKRGLGRGLDALIPQLNVSDEDQIVQIDIRDLRPNPYQPRRTFNEEKLQELCNSIREHGILQPLIVRRSQVKGFDIVAGERRYRAAKMAGLQVVPAVVRDLSDVLLMEIALIENLQREDLNPIEIADAYAKLLEKCHLTQDELAKRVGQSRSHITNMLRLLQLPAQIQDMVSRGTLTMGHARALLSVEDAEEQLRLAEQTVKEAWSVRKLEMVIYQPKKVSRETDKPALPTEYRRYQEQVQAYLGTSVRIQPGKKRGKIEIDYYSEDDLRRIMDLMLAHAP

SEQ ID NO: 98 - DNA, 849 bp, Artificial
  Substituion in SEQ ID NO 87
gtggctaaacgtggtctggggcgcggtttggatgccttgatcccgcagctcaacgtgtcggacgaggatcagattgtccagattgacattcgggatcttcggccgaatccgtaccagccgcggcgaacgtttaatgaagaaaaactgcaggagttgtgcaattccattcgagaacatgggattcttcagccgctcattgttcgcaggagccaggtcaaagggttcgatattgtcgctggcgagcggcgatatcgcgccgcgaaaatggcagggctgcaggtggtgcccgcggtcgttcgcgacctgagtgatgtcctactgatggaaatcgccctcattgagaacttacagcgcgaagatctgaatcccatcgagatcgccgatgcgtacgccaagctcatcgagaaatgccacttgacgcaggatgagctggcgaagcgggtggggcagagtcggagtcacatcacgaacatgttgcggttgctgcagcttcccgctcaaattcaggacatggtttcacgtggaacattgacgatgggccacgcgcgagcgctgctctccgtggaggatgcggaggagcagcttcgactggccgagcagaccgtgaaagaggcatggagcgtgcgaaagctggaaatggtcatctaccagcccaagaaggtttcacgtgaaaccgacaagcctgcgcttccgaccgaataccggcgctatcaggaacaggttcaagcctatctgggcacatcggtccgcattaatccgggcaaaaaacgggggaagatcgagatcgattattattcggaggacgatctccggcgcatcatggacctcatgttggcgcacgctccatga

SEQ ID NO: 99 - DNA, 849 bp, Artificial
  Substituion in SEQ ID NO 87
gtggctaaacgtggtctggggcgcggtttggatgccttgatcccgcagctcaacgtgtcggacgaggatcagattgtccagattgacattcgggatcttcggccgaatccgtaccagccgcggcgaacgtttaatgaagaaaaactgcaggagttgtgcaattccattcgagaacatgggattcttcagccgctcattgttcgcaggagccaggtcaaagggttcgatattgtcgctggcgagcggcgatatcgcgccgcgaaaatggcagggctgcaggtggtgcccgcggtcgttcgcgacctgagtgatgtcctactgatggaaatcgccctcattgagaacttacagcgcgaagatctgaatcccatcgagatcgccgatgcgtacgccaagctcatcgagaaatgccacttgacgcaggatgagctggcgaagcgggtggggcagagtcggagtcacatcacgaacatgttgcggttgctgcagcttcccgctcaaattcaggacatggtttcacgtggaacattgacgatgggccacgcgcgagcgctgctctccgtggaggatgcggaggagcagcttcgactggccgagcagaccgtgaaagaggcatggagcgtgcgaaagctggaaatggtcatctacaatcccaagaaggtttcacgtgaaaccgacaagcctgcgcttccgaccgaataccggcgctatcaggaacaggttcaagcctatctgggcacatcggtccgcattcagccgggcaaaaaacgggggaagatcgagatcgattattattcggaggacgatctccggcgcatcatggacctcatgttggcgcacgctccatga

SEQ ID NO: 100 - DNA, 849 bp, Artificial
  Substituion in SEQ ID NO 87
gtggctaaacgtggtctggggcgcggtttggatgccttgatcccgcagctcaacgtgtcggacgaggatcagattgtccagattgacattcgggatcttcggccgaatccgtaccagccgcggcgaacgtttaatgaagaaaaactgcaggagttgtgcaattccattcgagaacatgggattcttcagccgctcattgttcgcaggagccaggtcaaagggttcgatattgtcgctggcgagcggcgatatcgcgccgcgaaaatggcagggctgcaggtggtgcccgcggtcgttcgcgacctgagtgatgtcctactgatggaaatcgccctcattgagaacttacagcgcgaagatctgaatcccatcgagatcgccgatgcgtacgccaagctcatcgagaaatgccacttgacgcaggatgagctggcgaagcgggtggggcagagtcggagtcacatcacgaacatgttgcggttgctgcagcttcccgctcaaattcaggacatggtttcacgtggaacattgacgatgggccacgcgcgagcgctgctctccgtggaggatgcggaggagcagcttcgactggccgagcagaccgtgcgtgaggcatggagcgtgcgaaagctggaaatggtcatctaccagcccaagaaggtttcacgtgaaaccgacaagcctgcgcttccgaccgaataccggcgctatcaggaacaggttcaagcctatctgggcacatcggtccgcattcagccgggcaaaaaacgggggaagatcgagatcgattattattcggaggacgatctccggcgcatcatggacctcatgttggcgcacgctccatga

SEQ ID NO: 101 - DNA, 849 bp, Artificial
  Substituion in SEQ ID NO 87
gtggctaaacgtggtctggggcgcggtttggatgccttgatcccgcagctcaacgtgtcggacgaggatcagattgtccagattgacattcgggatcttcggccgaatccgtaccagccgcggcgaacgtttaatgaagaacgtctgcaggagttgtgcaattccattcgagaacatgggattcttcagccgctcattgttcgcaggagccaggtcaaagggttcgatattgtcgctggcgagcggcgatatcgcgccgcgaaaatggcagggctgcaggtggtgcccgcggtcgttcgcgacctgagtgatgtcctactgatggaaatcgccctcattgagaacttacagcgcgaagatctgaatcccatcgagatcgccgatgcgtacgccaagctcatcgagaaatgccacttgacgcaggatgagctggcgaagcgggtggggcagagtcggagtcacatcacgaacatgttgcggttgctgcagcttcccgctcaaattcaggacatggtttcacgtggaacattgacgatgggccacgcgcgagcgctgctctccgtggaggatgcggaggagcagcttcgactggccgagcagaccgtgaaagaggcatggagcgtgcgaaagctggaaatggtcatctaccagcccaagaaggtttcacgtgaaaccgacaagcctgcgcttccgaccgaataccggcgctatcaggaacaggttcaagcctatctgggcacatcggtccgcattcagccgggcaaaaaacgggggaagatcgagatcgattattattcggaggacgatctccggcgcatcatggacctcatgttggcgcacgctccatga

SEQ ID NO: 102 - DNA, 849 bp, Artificial
  Substituion in SEQ ID NO 87
gtggctaaacgtggtctggggcgcggtttggatgccttgatcccgcagctcaacgtgtcggacgaggatcagattgtccagattgacattcgggatcttcggccgaatccgtaccagccgcggcgaacgtttaatgaagaaaaactgcaggagttgtgcaattccattcgagaacatgggattcttcagccgctcattgttcgcaggagccaggtcaaagggttcgatattgtcgctggcgagcggcgatatcgcgccgcgaaaatggcagggctgcaggtggtgcccgcggtcgttcgcgacctgagtgatgtcctactgatggaaatcgccctcattgagaacttacagcgcgaagatctgaatcccatcgagatcgccgatgcgtacgccaagctcttagagaaatgccacttgacgcaggatgagctggcgaagcgggtggggcagagtcggagtcacatcacgaacatgttgcggttgctgcagcttcccgctcaaattcaggacatggtttcacgtggaacattgacgatgggccacgcgcgagcgctgctctccgtggaggatgcggaggagcagcttcgactggccgagcagaccgtgaaagaggcatggagcgtgcgaaagctggaaatggtcatctaccagcccaagaaggtttcacgtgaaaccgacaagcctgcgcttccgaccgaataccggcgctatcaggaacaggttcaagcctatctgggcacatcggtccgcattcagccgggcaaaaaacgggggaagatcgagatcgattattattcggaggacgatctccggcgcatcatggacctcatgttggcgcacgctccatga

SEQ ID NO: 103 - protein, 255 aa, Alicyclobacillus acidocaldarius
MSSARVIAIANQKGGVGKTTTAVNLGACLATLGKRVLLIDIDPQGNTTSGVGINKADVKYCVYDVIINDVNIADAIMPSGLDNLDVLPATIQLAGAEIELVPTISREVRLRRAIQGMRSRYDYIVIDCPPSLGLLTVNALTAADSVMIPIQCEYYALEGLSQLLNTVRLVQKHLNTSLEVEGVVLTMLDARTNLGLQVIEDVKKFFRDKVYKTIIPRNVRLSEAPSHGRPIIHYDPKSRGAESYMELAKEVIARG

SEQ ID NO: 104 - DNA, 768 bp, Alicyclobacillus acidocaldarius
gtgtccagcgcccgcgtgatcgccatcgccaatcaaaaaggtggcgtggggaagacgacaaccgcggtgaatctcggggcttgtctggcgacgttgggcaaacgcgtcctgctgatcgatatcgatccgcagggaaacaccacgtcaggcgtcgggatcaacaaggccgacgtgaagtactgcgtgtacgacgtgatcatcaacgacgtgaatatcgcggatgccattatgccgtcaggcctcgacaatttggacgtgcttccagccacgatccaattggcgggtgccgagatcgagttggttccgaccatctcgcgagaagtgaggctgcgaagagccattcagggtatgcggagtcgatacgactacatcgtcatcgattgtccgccctccctgggcctgttgaccgtgaacgccttgacggcggccgattcggtcatgattcccatccagtgcgagtattacgcgctcgaaggcctgagtcagttgttgaacaccgtgcggctcgtacagaagcacctgaacacgtcgctcgaggtggagggagtggtgctgaccatgttggacgcgcgcaccaacctgggcttgcaggtcatcgaggacgtgaaaaagttctttcgagacaaggtgtacaagaccattattccgcgcaatgttcgcttgagcgaggcgccgagccacggcaggcccatcattcactatgatccgaaatcgcgcggcgccgagtcatacatggaactcgcgaaggaagtgatcgcgcgtggctaa

SEQ ID NO: 105 - protein, 251 aa, Bacillus amyloliquefaciens FZB42
KIIAITNQKGGVGKTTTSVNLGACLAYIGKRVLLVDIDPQGNATSGLGIEKADVDHCVYDILVDDADVTDIIKPTSVENLDVIPATIQLAGAEIELVPTISREVRLKRALESVKQNYDYMIIDCPPSLGLLTINALTASDSVVIPVQCEYYALEGLSQLLNTVRLVQKHLNTDLMIEGVLLTMLDARTNLGIQVIEEVKKYFRDKVYQTIIPRNVRLSEAPSHGKPIILYDPRSRGAEVYLDLAKEVAANG

SEQ ID NO: 106 - protein, 251 aa, Bacillus subtilis subsp. subtilis str. 168
KIIAITNQKGGVGKTTTSVNLGACLAYIGKRVLLVDIDPQGNATSGLGIEKADVEQCVYDILVDDADVIDIIKATTVENLDVIPATIQLAGAEIELVPTISREVRLKRALEAVKQNYDYIIIDCPPSLGLLTINALTASDSVVIPVQCEYYALEGLSQLLNTVRLVQKHLNTDLMIEGVLLTMLDARTNLGIQVIEEVKKYFRDKVYKTVIPRNVRLSEAPSHGKPIILYDPRSRGAEVYLDLAKEVAANG

SEQ ID NO: 107 - protein, 251 aa, Bacillus pumilus SAFR-032
KIIAITNQKGGVGKTTTSVNLSACLAYIGKRVLLVDIDPQGNATSGIGIEKADVEKCVYDILVDDADVLDVIKTTEVENLDVIPATIQLAGAEIELVPTISREVRLKRALESVKQNYDYMIIDCPPSLGLLTINALTASDSVLIPVQCEYYALEGLSQLLNTVRLVQKHLNTDLAIEGVLLTMLDARTNLGIQVIEEVKKYFRDKVYQTVIPRNVRLSEAPSHGKPIILYDPRSRGADVYLDLAKEVDANG

SEQ ID NO: 108 - protein, 249 aa, Bacillus licheniformis ATCC 14580
KIIAITNQKGGVGKTTTSVNLGACLAYIGKRVLLVDIDPQGNATSGIGVEKADVDQCVYDILVDDADVKDVIKTTSVENLDVIPATIQLAGAEIELVPTISREVRLKRALESVKQNYDFMIIDCPPSLGLLTINALTASDSVVIPVQCEYYALEGLSQLLNSVRLVQKHLNTDLMIDGVLLTMLDARTNLGIQVIEEVKKYFRDKVYKTVIPRNVRLSEAPSHGKPIILYDPRSRGAEVYLELAKEVAA

SEQ ID NO: 109 - protein, 249 aa, Bacillus licheniformis ATCC 14580; identical to SEQ ID NO: 108

SEQ ID NO: 110 - protein, 255 aa, Artificial
  Substituion in SEQ ID NO 103
MSSARVIAIANQKGGVGKTTTAVNLGACLATLGKRVLLIDIDPQGNTTSGVGINKADVKYCVYDVIINDVNIADAIMPSGLDNLDVLPATIQLAGAEIELVPTISREVRLRRAIQGMRSRYDYIVIDCPPSLGLLTVNALTAADSVMIPIQCEYYALEGLSQLLNTVRLVQKHLNTSLEVEGVVLTMLDARTNLGLQVIEEVKKFFRDKVYKTIIPRNVRLSEAPSHGRPIIHYDPKSRGAESYMELAKEVIARG

SEQ ID NO: 111 - protein, 255 aa, Artificial
  Substituion in SEQ ID NO 103
MSSARVIAIANQKGGVGKTTTAVNLGACLATLGKRVLLIDIDPQGNTTSGVGINKADVKYCVYDVIINDVNIADAIMPSGLDNLDVLPATIQLAGAEIELVPTISREVRLRRALQGMRSRYDYIVIDCPPSLGLLTVNALTAADSVMIPIQCEYYALEGLSQLLNTVRLVQKHLNTSLEVEGVVLTMLDARTNLGLQVIEDVKKFFRDKVYKTIIPRNVRLSEAPSHGRPIIHYDPKSRGAESYMELAKEVIARG

SEQ ID NO: 112 - protein, 255 aa, Artificial
  Substituion in SEQ ID NO 103
MSSARVIAIANQKGGVGKTTTAVNLGACLATLGKRVLLIDIDPQGNTTSGVGINKADVKYCVYDVIINDVNIADAIMPSGLDNLDVLPATIQLAGAEIELVPTISREVRLRRAIQGMRSRYDYIVIDCPPSLGLLTVNALTAADSVMIPIQCEYYALEGLSQLLNTVRLVQKHLNTSLEVEGVVLTMLDARTNLGIQVIEDVKKFFRDKVYKTIIPRNVRLSEAPSHGRPIIHYDPKSRGAESYMELAKEVIARG

SEQ ID NO: 113 - protein, 255 aa, Artificial
  Substituion in SEQ ID NO 103
MSSARVIAIANQKGGVGKTTTAVNLGACLATLGKRVLLIDIDPQGNTTSGVGINKADVKYCVYDVIINDVNIADAIMPSGLDNLDVLPATIQLAGAEIELVPTISREVRLRRAIQGMRSRYDYLVIDCPPSLGLLTVNALTAADSVMIPIQCEYYALEGLSQLLNTVRLVQKHLNTSLEVEGVVLTMLDARTNLGLQVIEDVKKFFRDKVYKTIIPRNVRLSEAPSHGRPIIHYDPKSRGAESYMELAKEVIARG

SEQ ID NO: 114 - protein, 255 aa, Artificial
  Substituion in SEQ ID NO 103
MSSARVIAIANQKGGVGKTTTAVNLGACLATLGKRVLLIDIDPQGNTTSGVGINKADVKYCVYDVIINDVNIADAIMPSGLDNLDVLPATIQLAGAEIELVPTISREVRLRRAIQGMRSRYDYIVIDCPPSLGLLTINALTAADSVMIPIQCEYYALEGLSQLLNTVRLVQKHLNTSLEVEGVVLTMLDARTNLGLQVIEDVKKFFRDKVYKTIIPRNVRLSEAPSHGRPIIHYDPKSRGAESYMELAKEVIARG

SEQ ID NO: 115 - DNA, 768 bp, Artificial
  Substituion in SEQ ID NO 104
gtgtccagcgcccgcgtgatcgccatcgccaatcaaaaaggtggcgtggggaagacgacaaccgcggtgaatctcggggcttgtctggcgacgttgggcaaacgcgtcctgctgatcgatatcgatccgcagggaaacaccacgtcaggcgtcgggatcaacaaggccgacgtgaagtactgcgtgtacgacgtgatcatcaacgacgtgaatatcgcggatgccattatgccgtcaggcctcgacaatttggacgtgcttccagccacgatccaattggcgggtgccgagatcgagttggttccgaccatctcgcgagaagtgaggctgcgaagagccattcagggtatgcggagtcgatacgactacatcgtcatcgattgtccgccctccctgggcctgttgaccgtgaacgccttgacggcggccgattcggtcatgattcccatccagtgcgagtattacgcgctcgaaggcctgagtcagttgttgaacaccgtgcggctcgtacagaagcacctgaacacgtcgctcgaggtggagggagtggtgctgaccatgttggacgcgcgcaccaacctgggcttgcaggtcatcgaggaagtgaaaaagttctttcgagacaaggtgtacaagaccattattccgcgcaatgttcgcttgagcgaggcgccgagccacggcaggcccatcattcactatgatccgaaatcgcgcggcgccgagtcatacatggaactcgcgaaggaagtgatcgcgcgtggctaa

SEQ ID NO: 116 - DNA, 768 bp, Artificial
  Substituion in SEQ ID NO 104
gtgtccagcgcccgcgtgatcgccatcgccaatcaaaaaggtggcgtggggaagacgacaaccgcggtgaatctcggggcttgtctggcgacgttgggcaaacgcgtcctgctgatcgatatcgatccgcagggaaacaccacgtcaggcgtcgggatcaacaaggccgacgtgaagtactgcgtgtacgacgtgatcatcaacgacgtgaatatcgcggatgccattatgccgtcaggcctcgacaatttggacgtgcttccagccacgatccaattggcgggtgccgagatcgagttggttccgaccatctcgcgagaagtgaggctgcgaagagccttacagggtatgcggagtcgatacgactacatcgtcatcgattgtccgccctccctgggcctgttgaccgtgaacgccttgacggcggccgattcggtcatgattcccatccagtgcgagtattacgcgctcgaaggcctgagtcagttgttgaacaccgtgcggctcgtacagaagcacctgaacacgtcgctcgaggtggagggagtggtgctgaccatgttggacgcgcgcaccaacctgggcttgcaggtcatcgaggacgtgaaaaagttctttcgagacaaggtgtacaagaccattattccgcgcaatgttcgcttgagcgaggcgccgagccacggcaggcccatcattcactatgatccgaaatcgcgcggcgccgagtcatacatggaactcgcgaaggaagtgatcgcgcgtggctaa

SEQ ID NO: 117 - DNA, 768 bp, Artificial
  Substituion in SEQ ID NO 104
gtgtccagcgcccgcgtgatcgccatcgccaatcaaaaaggtggcgtggggaagacgacaaccgcggtgaatctcggggcttgtctggcgacgttgggcaaacgcgtcctgctgatcgatatcgatccgcagggaaacaccacgtcaggcgtcgggatcaacaaggccgacgtgaagtactgcgtgtacgacgtgatcatcaacgacgtgaatatcgcggatgccattatgccgtcaggcctcgacaatttggacgtgcttccagccacgatccaattggcgggtgccgagatcgagttggttccgaccatctcgcgagaagtgaggctgcgaagagccattcagggtatgcggagtcgatacgactacatcgtcatcgattgtccgccctccctgggcctgttgaccgtgaacgccttgacggcggccgattcggtcatgattcccatccagtgcgagtattacgcgctcgaaggcctgagtcagttgttgaacaccgtgcggctcgtacagaagcacctgaacacgtcgctcgaggtggagggagtggtgctgaccatgttggacgcgcgcaccaacctgggcattcaggtcatcgaggacgtgaaaaagttctttcgagacaaggtgtacaagaccattattccgcgcaatgttcgcttgagcgaggcgccgagccacggcaggcccatcattcactatgatccgaaatcgcgcggcgccgagtcatacatggaactcgcgaaggaagtgatcgcgcgtggctaa

SEQ ID NO: 118 - DNA, 768 bp, Artificial
  Substituion in SEQ ID NO 104
gtgtccagcgcccgcgtgatcgccatcgccaatcaaaaaggtggcgtggggaagacgacaaccgcggtgaatctcggggcttgtctggcgacgttgggcaaacgcgtcctgctgatcgatatcgatccgcagggaaacaccacgtcaggcgtcgggatcaacaaggccgacgtgaagtactgcgtgtacgacgtgatcatcaacgacgtgaatatcgcggatgccattatgccgtcaggcctcgacaatttggacgtgcttccagccacgatccaattggcgggtgccgagatcgagttggttccgaccatctcgcgagaagtgaggctgcgaagagccattcagggtatgcggagtcgatacgactacttagtcatcgattgtccgccctccctgggcctgttgaccgtgaacgccttgacggcggccgattcggtcatgattcccatccagtgcgagtattacgcgctcgaaggcctgagtcagttgttgaacaccgtgcggctcgtacagaagcacctgaacacgtcgctcgaggtggagggagtggtgctgaccatgttggacgcgcgcaccaacctgggcttgcaggtcatcgaggacgtgaaaaagttctttcgagacaaggtgtacaagaccattattccgcgcaatgttcgcttgagcgaggcgccgagccacggcaggcccatcattcactatgatccgaaatcgcgcggcgccgagtcatacatggaactcgcgaaggaagtgatcgcgcgtggctaa

SEQ ID NO: 119 - DNA, 768 bp, Artificial
  Substituion in SEQ ID NO 104
gtgtccagcgcccgcgtgatcgccatcgccaatcaaaaaggtggcgtggggaagacgacaaccgcggtgaatctcggggcttgtctggcgacgttgggcaaacgcgtcctgctgatcgatatcgatccgcagggaaacaccacgtcaggcgtcgggatcaacaaggccgacgtgaagtactgcgtgtacgacgtgatcatcaacgacgtgaatatcgcggatgccattatgccgtcaggcctcgacaatttggacgtgcttccagccacgatccaattggcgggtgccgagatcgagttggttccgaccatctcgcgagaagtgaggctgcgaagagccattcagggtatgcggagtcgatacgactacatcgtcatcgattgtccgccctccctgggcctgttgaccattaacgccttgacggcggccgattcggtcatgattcccatccagtgcgagtattacgcgctcgaaggcctgagtcagttgttgaacaccgtgcggctcgtacagaagcacctgaacacgtcgctcgaggtggagggagtggtgctgaccatgttggacgcgcgcaccaacctgggcttgcaggtcatcgaggacgtgaaaaagttctttcgagacaaggtgtacaagaccattattccgcgcaatgttcgcttgagcgaggcgccgagccacggcaggcccatcattcactatgatccgaaatcgcgcggcgccgagtcatacatggaactcgcgaaggaagtgatcgcgcgtggctaa

SEQ ID NO: 120 - protein, 225 aa, Alicyclobacillus acidocaldarius
MRRVGGLGEMRKVVATGKTIEEAVMSALVRLGVPRSQAQVRVIREPARGFLGWLSGREAEVEVTVIETPLDAAKEFLRTAISKMGLGQAVIVADDVDEEGHVKLSISADEDALPILIGRRGATLDALQYLVNIVANRDASEKMRFTLDAAGYRDRRLESLRRLADEAADKAVRLGRPVALDPMPRKDRKWVHAHLQSRGDVVTVSEGQEPYRRVKIIPKRHDWIE

SEQ ID NO: 121 - DNA, 678 bp, Alicyclobacillus acidocaldarius
gtgagaagggtcggaggcttaggcgagatgcgaaaagtggtggcgacgggcaagaccatcgaagaagcggtgatgtcggcgctggtgaggctcggtgtgccgagatcgcaggcgcaggtgcgtgtcatccgggaaccggctcggggatttctcggatggctgagcggccgggaggcggaggtcgaggtgacggtcatcgagacgcccctcgacgccgcgaaggagtttttgcggaccgccatctcgaaaatggggcttggccaggccgtgatcgtcgcggacgatgtcgacgaggaaggtcatgtgaaactgtcgatctcggcggacgaggacgccctgcccatcctcatcggccggcgcggtgcaacgctggacgcgctgcaatatctggtgaacatcgtggcgaatcgggatgcgtcggagaaaatgcgattcacgctcgacgcggcgggctatcgggatcgtcggttggagtcgctcaggcggctggcggacgaggcggcggacaaggcggtgcggctggggagaccggtggcgctcgatccaatgccgcgaaaggatcgcaagtgggtgcacgcccacctgcagtcgagaggcgacgtcgtgacggtcagcgaaggccaggagccgtatcgccgtgtgaagatcattccgaagcgccacgattggatcgaatga

SEQ ID NO: 122 - protein, 204 aa, Bacillus selenitireducens MLS10
MKKVTVSGKTVEEAVQNGLDRLEVTAEQVDYTVLEEPEKGFLGFLGNKPALVEVRLKPDPLKEALVFLRDTIDKMGITASVEAEERKEGMYLTISGAEIGVLIGKRGQTLDSLQYLVNLVANRQSDNYMKFYLDAEGYRDRRREALETLAKRLSEKAVRTGREVKLEPMNAHERKIIHTALQHIHTVSTYSEGREPHRRIVVVP

SEQ ID NO: 123 - protein, 201 aa, Halothermothrix orenii H 168
GKTVEDAVEQALQKLNITRDEAEIKVIDEGSKGIFGLIGGKNAVVEVKPKVNPASIALDFLEDVLEKIPVATRVEVIEEKTDYDQVYLNISGDNLGIIIGYRGETLDALQYLTSLVVNRELKKYTRVLLDAEGYRERRKKTLERLANKLARKAIRVGRKVVLEPMPPHERRIIHMTLKDSEQVYTYSEGQEPYRRVLIAPR

SEQ ID NO: 124 - protein, 207 aa, Bacillus halodurans C-125
MTKRRVSGKTVEEAVEQAIIELGTTRERITYTVVEEPKSGLFGILGSKPAVIEVVVKPDPVDRAKAFLEELLQEMDMEVEVTIEKDPATVLFNISGEQDLGTLIGKRGQTLDSLQYLVNLVANKEEGEFIRIKLDAENYRARRKEALVQLAERLASKALRTKRPVSLEPMSAHERKIIHTALQELGDVETYSEGQGIGRHVVIAPKR

SEQ ID NO: 125 - protein, 206 aa, Pelotomaculum thermopropionicum SI
MKAIEKSGKTVEEAVELALKDLGVTRKDVEVEVIEEPSKGIFGILGVKPARVRVLLREGPLQKAEKFLKSVFEAMNIQVEMSLQENEREVVINLRGPEMGVLIGRRGETMEALQYLVNLSANKNQEVRKKIIIDIEGYRSRREETLQKLALKLADKAKQRGRNVVLEPMNSQERRIIHTALQGRDDIYTFSEGEEPYRKIVISPKK

SEQ ID NO: 126 - protein, 206 aa, Carboxydothermus hydrogenoformans Z-2901
MREIEVTGKTVEEAVSLGLEQLGVDRSLVEIEILEQPSKGILGLFGQKPAKVKLTIKSKVMEKARKFLDDVISAMGVNVGYEVLERDDHLLINLYGSDVGILIGYRGETLDALQYITNLAANKNEITPRRIILDAQGYRERREKTLIRLAEKVAEKVRQKGRPFALEPMTPQERRIIHTALQNFEGVYTYSEGEDPNRKVIIAPKR

SEQ ID NO: 127 - protein, 225 aa, Artificial
  Substituion in SEQ ID NO 120
MRRVGGLGEMRKVVATGKTIEEAVMSALVRLGVPRSQAQVRVIREPARGFLGWLSGREAEVEVTVIETPLDAAKEFLRTAISKMGLGQAVIVADDVDEEGHVKLSISADEDALPILIGRRGATLDALQYLVNLVANRDASEKMRFTLDAAGYRDRRLESLRRLADEAADKAVRLGRPVALDPMPRKDRKWVHAHLQSRGDVVTVSEGQEPYRRVKIIPKRHDWIE

SEQ ID NO: 128 - protein, 225 aa, Artificial
  Substituion in SEQ ID NO 120
MRRVGGLGEMRKVVATGKTIEEAVMSALVRLGVPRSQAQVRVIREPARGFLGWLSGREAEVEVTVIETPLDAAKEFLRTAISKMGLGQAVIVADDVDEEGHVKLSISADEDALPILIGRRGATLDALQYLVNIVANRDASEKMRFTIDAAGYRDRRLESLRRLADEAADKAVRLGRPVALDPMPRKDRKWVHAHLQSRGDVVTVSEGQEPYRRVKIIPKRHDWIE

SEQ ID NO: 129 - protein, 225 aa, Artificial
  Substituion in SEQ ID NO 120
MRRVGGLGEMRKVVATGKTIEEAVMSALVRLGVPRSQAQVRVIREPARGFLGWLSGREAEVEVTVIETPLDAAKEFLRTAISKMGLGQAVIVADDVDEEGHVKLSISADEDALPILIGRRGATLDALQYLVNIVANRDASEKMRFTLDAAGYRDRRLESLRRLADEAADKAVRIGRPVALDPMPRKDRKWVHAHLQSRGDVVTVSEGQEPYRRVKIIPKRHDWIE

SEQ ID NO: 130 - protein, 225 aa, Artificial
  Substituion in SEQ ID NO 120
MRRVGGLGEMRKVVATGKTIEEAVMSALVRLGVPRSQAQVRVIREPARGFLGWLSGREAEVEVTVIETPLDAAKDFLRTAISKMGLGQAVIVADDVDEEGHVKLSISADEDALPILIGRRGATLDALQYLVNIVANRDASEKMRFTLDAAGYRDRRLESLRRLADEAADKAVRLGRPVALDPMPRKDRKWVHAHLQSRGDVVTVSEGQEPYRRVKIIPKRHDWIE

SEQ ID NO: 131 - protein, 225 aa, Artificial
  Substituion in SEQ ID NO 120
MRRVGGLGEMRKVVATGKTIEEAVMSALVRLGVPRSQAQVRVIREPARGFLGWLSGREAEVEVTVIETPLDAAKEFLRTAISKMGLGQAVIVADDVDEEGHVKLSISADEDALPILIGRRGATLDALQYLINIVANRDASEKMRFTLDAAGYRDRRLESLRRLADEAADKAVRLGRPVALDPMPRKDRKWVHAHLQSRGDVVTVSEGQEPYRRVKIIPKRHDWIE

SEQ ID NO: 132 - DNA, 678 bp, Artificial
  Substituion in SEQ ID NO 121
gtgagaagggtcggaggcttaggcgagatgcgaaaagtggtggcgacgggcaagaccatcgaagaagcggtgatgtcggcgctggtgaggctcggtgtgccgagatcgcaggcgcaggtgcgtgtcatccgggaaccggctcggggatttctcggatggctgagcggccgggaggcggaggtcgaggtgacggtcatcgagacgcccctcgacgccgcgaaggagtttttgcggaccgccatctcgaaaatggggcttggccaggccgtgatcgtcgcggacgatgtcgacgaggaaggtcatgtgaaactgtcgatctcggcggacgaggacgccctgcccatcctcatcggccggcgcggtgcaacgctggacgcgctgcaatatctggtgaacttagtggcgaatcgggatgcgtcggagaaaatgcgattcacgctcgacgcggcgggctatcgggatcgtcggttggagtcgctcaggcggctggcggacgaggcggcggacaaggcggtgcggctggggagaccggtggcgctcgatccaatgccgcgaaaggatcgcaagtgggtgcacgcccacctgcagtcgagaggcgacgtcgtgacggtcagcgaaggccaggagccgtatcgccgtgtgaagatcattccgaagcgccacgattggatcgaatga

SEQ ID NO: 133 - DNA, 678 bp, Artificial
  Substituion in SEQ ID NO 121
gtgagaagggtcggaggcttaggcgagatgcgaaaagtggtggcgacgggcaagaccatcgaagaagcggtgatgtcggcgctggtgaggctcggtgtgccgagatcgcaggcgcaggtgcgtgtcatccgggaaccggctcggggatttctcggatggctgagcggccgggaggcggaggtcgaggtgacggtcatcgagacgcccctcgacgccgcgaaggagtttttgcggaccgccatctcgaaaatggggcttggccaggccgtgatcgtcgcggacgatgtcgacgaggaaggtcatgtgaaactgtcgatctcggcggacgaggacgccctgcccatcctcatcggccggcgcggtgcaacgctggacgcgctgcaatatctggtgaacatcgtggcgaatcgggatgcgtcggagaaaatgcgattcacgattgacgcggcgggctatcgggatcgtcggttggagtcgctcaggcggctggcggacgaggcggcggacaaggcggtgcggctggggagaccggtggcgctcgatccaatgccgcgaaaggatcgcaagtgggtgcacgcccacctgcagtcgagaggcgacgtcgtgacggtcagcgaaggccaggagccgtatcgccgtgtgaagatcattccgaagcgccacgattggatcgaatga

SEQ ID NO: 134 - DNA, 678 bp, Artificial
  Substituion in SEQ ID NO 121
gtgagaagggtcggaggcttaggcgagatgcgaaaagtggtggcgacgggcaagaccatcgaagaagcggtgatgtcggcgctggtgaggctcggtgtgccgagatcgcaggcgcaggtgcgtgtcatccgggaaccggctcggggatttctcggatggctgagcggccgggaggcggaggtcgaggtgacggtcatcgagacgcccctcgacgccgcgaaggagtttttgcggaccgccatctcgaaaatggggcttggccaggccgtgatcgtcgcggacgatgtcgacgaggaaggtcatgtgaaactgtcgatctcggcggacgaggacgccctgcccatcctcatcggccggcgcggtgcaacgctggacgcgctgcaatatctggtgaacatcgtggcgaatcgggatgcgtcggagaaaatgcgattcacgctcgacgcggcgggctatcgggatcgtcggttggagtcgctcaggcggctggcggacgaggcggcggacaaggcggtgcggattgggagaccggtggcgctcgatccaatgccgcgaaaggatcgcaagtgggtgcacgcccacctgcagtcgagaggcgacgtcgtgacggtcagcgaaggccaggagccgtatcgccgtgtgaagatcattccgaagcgccacgattggatcgaatga

SEQ ID NO: 135 - DNA, 678 bp, Artificial
  Substituion in SEQ ID NO 121
gtgagaagggtcggaggcttaggcgagatgcgaaaagtggtggcgacgggcaagaccatcgaagaagcggtgatgtcggcgctggtgaggctcggtgtgccgagatcgcaggcgcaggtgcgtgtcatccgggaaccggctcggggatttctcggatggctgagcggccgggaggcggaggtcgaggtgacggtcatcgagacgcccctcgacgccgcgaaggattttttgcggaccgccatctcgaaaatggggcttggccaggccgtgatcgtcgcggacgatgtcgacgaggaaggtcatgtgaaactgtcgatctcggcggacgaggacgccctgcccatcctcatcggccggcgcggtgcaacgctggacgcgctgcaatatctggtgaacatcgtggcgaatcgggatgcgtcggagaaaatgcgattcacgctcgacgcggcgggctatcgggatcgtcggttggagtcgctcaggcggctggcggacgaggcggcggacaaggcggtgcggctggggagaccggtggcgctcgatccaatgccgcgaaaggatcgcaagtgggtgcacgcccacctgcagtcgagaggcgacgtcgtgacggtcagcgaaggccaggagccgtatcgccgtgtgaagatcattccgaagcgccacgattggatcgaatga

SEQ ID NO: 136 - DNA, 678 bp, Artificial
  Substituion in SEQ ID NO 121
gtgagaagggtcggaggcttaggcgagatgcgaaaagtggtggcgacgggcaagaccatcgaagaagcggtgatgtcggcgctggtgaggctcggtgtgccgagatcgcaggcgcaggtgcgtgtcatccgggaaccggctcggggatttctcggatggctgagcggccgggaggcggaggtcgaggtgacggtcatcgagacgcccctcgacgccgcgaaggagtttttgcggaccgccatctcgaaaatggggcttggccaggccgtgatcgtcgcggacgatgtcgacgaggaaggtcatgtgaaactgtcgatctcggcggacgaggacgccctgcccatcctcatcggccggcgcggtgcaacgctggacgcgctgcaatatctgattaacatcgtggcgaatcgggatgcgtcggagaaaatgcgattcacgctcgacgcggcgggctatcgggatcgtcggttggagtcgctcaggcggctggcggacgaggcggcggacaaggcggtgcggctggggagaccggtggcgctcgatccaatgccgcgaaaggatcgcaagtgggtgcacgcccacctgcagtcgagaggcgacgtcgtgacggtcagcgaaggccaggagccgtatcgccgtgtgaagatcattccgaagcgccacgattggatcgaatga

SEQ ID NO: 137 - protein, 137 aa, Alicyclobacillus acidocaldarius
MTLDPPWQPPAWELDPSQPLYEQIAHRLRVEIAASRLPGGARLPSVRDLAAHLRVTPNTVMRAYAELEQDGLLETFRGQGTFVARGSGVEARARARIARQAFEHVRRVAADLGMRVEDLLRLGAEAEGGAEDDASSH

SEQ ID NO: 138 - DNA, 414 bp, Alicyclobacillus acidocaldarius
atgacgttggatccgccttggcaacctcccgcgtgggagctcgatccgtcgcagccgctgtatgagcagattgcgcaccgcctccgggtcgaaattgccgcctcgcgcctgccgggcggggcgcgcctgccctccgtgcgcgatctcgccgcgcatctgcgcgtgacgccaaacaccgtcatgcgcgcgtacgccgagctggaacaggacgggttgctcgagacgtttcgcggccagggcacgttcgtggcgcgcgggtctggcgtcgaggcgcgggcccgagcgcgcattgcgcggcaggcgtttgaacacgtgcggcgcgtcgcggccgatctcggcatgcgcgtggaagatttgcttcggctgggcgccgaagcggagggaggagcggaagacgatgcaagcagccattga

SEQ ID NO: 139 - protein, 102 aa, Paenibacillus larvae subsp. larvae BRL-230010
FNLDLSKPLYEQVLSQIRSSIAKGEIALGEKIPSVREMAQALKITPNTVMRAYQELERDQLTVTRRGQGTFITSNAETVEQIKYNLAEIATGEYVRKMTDIG

SEQ ID NO: 140 - protein, 102 aa, Bacillus amyloliquefaciens FZB42
EFQSSKPIYLQIADRVYYRLIRSELSPGDKLPSVREMAVQMKVNPNTIQRTYSEMERLGIVETRRGQGTFIAERSDLKAELKDRLTKDVFKRFIQEMAELGL

SEQ ID NO: 141 - protein, 77 aa, Moorella thermoacetica ATCC 39073
EFDNSRPIYLQIIAAIKKQLARGELQPGQKLPSQREMAEELQVNPNTVQRAYREMEAMGLLETLRGQGTFISNRPGL

SEQ ID NO: 142 - protein, 71 aa, Clostridium bolteae ATCC BAA-613
SRPLYEQVAERLRELMFKGALPQDAQLPSVRSLATELSINPNTIQRAYTELERQGYIYSIKGKGSFVADNS

SEQ ID NO: 143 - protein, 90 aa, Ruminococcus obeum ATCC 29174
RPIYEQITEKFRTLIYQGALPAGCRLPSVRQLAMELSINPNTIQRAYMTLEQEGLIYPVKGKGNFVAETRQIQEKSKEDFRKEFLELVRR

SEQ ID NO: 144 - protein, 137 aa, Artificial
  Substituion in SEQ ID NO 137
MTLDPPWQPPAWELDPSQPLYEQIAHRLRVEIAASRLPGGARLPSVRDLAAHLRVTPNTVMRAYAELEQDGLLETFRGQGTFVARGSGVEARARARIARQAFEHVRRVAADLGMRVEDLLRLGAEAEGGAEDEASSH

SEQ ID NO: 145 - protein, 137 aa, Artificial
  Substituion in SEQ ID NO 137
MTLDPPWQPPAWELDPSQPLYEQIAHRLRVEIAASRLPGGARLPSVRDLAAHLRVTPNTVMRAYAELEQDGLLETFRGQGTFVARGSGIEARARARIARQAFEHVRRVAADLGMRVEDLLRLGAEAEGGAEDDASSH

SEQ ID NO: 146 - protein, 137 aa, Artificial
  Substituion in SEQ ID NO 137
MTLDPPWQPPAWELDPSQPLYEQIAHRLRVEIAASRLPGGARLPSVRDLAAHLRVTPNTVMRAYAELEQDGLLETFRGQGTFVARGSGVEARARARIARQAFEHVRRVAADLGMRVEDLLKLGAEAEGGAEDDASSH

SEQ ID NO: 147 - protein, 137 aa, Artificial
  Substituion in SEQ ID NO 137
MTLDPPWQPPAWELDPSQPLYEQIAHRLRVEIAASRLPGGAKLPSVRDLAAHLRVTPNTVMRAYAELEQDGLLETFRGQGTFVARGSGVEARARARIARQAFEHVRRVAADLGMRVEDLLRLGAEAEGGAEDDASSH

SEQ ID NO: 148 - protein, 137 aa, Artificial
  Substituion in SEQ ID NO 137
MTLDPPWQPPAWELDPSQPLYEQIAHRLRVEIAASRLPGGARLPSVRDLAAHLRVTPNTVMRAYAELEQDGLLETFRGQGTFVARGSGVEARARARIARQAFEHVRRVAADLGMRVEDLLRIGAEAEGGAEDDASSH

SEQ ID NO: 149 - DNA, 414 bp, Artificial
  Substituion in SEQ ID NO 138
atgacgttggatccgccttggcaacctcccgcgtgggagctcgatccgtcgcagccgctgtatgagcagattgcgcaccgcctccgggtcgaaattgccgcctcgcgcctgccgggcggggcgcgcctgccctccgtgcgcgatctcgccgcgcatctgcgcgtgacgccaaacaccgtcatgcgcgcgtacgccgagctggaacaggacgggttgctcgagacgtttcgcggccagggcacgttcgtggcgcgcgggtctggcgtcgaggcgcgggcccgagcgcgcattgcgcggcaggcgtttgaacacgtgcggcgcgtcgcggccgatctcggcatgcgcgtggaagatttgcttcggctgggcgccgaagcggagggaggagcggaagacgaagcaagcagccattga

SEQ ID NO: 150 - DNA, 414 bp, Artificial
  Substituion in SEQ ID NO 138
atgacgttggatccgccttggcaacctcccgcgtgggagctcgatccgtcgcagccgctgtatgagcagattgcgcaccgcctccgggtcgaaattgccgcctcgcgcctgccgggcggggcgcgcctgccctccgtgcgcgatctcgccgcgcatctgcgcgtgacgccaaacaccgtcatgcgcgcgtacgccgagctggaacaggacgggttgctcgagacgtttcgcggccagggcacgttcgtggcgcgcgggtctggcattgaggcgcgggcccgagcgcgcattgcgcggcaggcgtttgaacacgtgcggcgcgtcgcggccgatctcggcatgcgcgtggaagatttgcttcggctgggcgccgaagcggagggaggagcggaagacgatgcaagcagccattga

SEQ ID NO: 151 - DNA, 414 bp, Artificial
  Substituion in SEQ ID NO 138
atgacgttggatccgccttggcaacctcccgcgtgggagctcgatccgtcgcagccgctgtatgagcagattgcgcaccgcctccgggtcgaaattgccgcctcgcgcctgccgggcggggcgcgcctgccctccgtgcgcgatctcgccgcgcatctgcgcgtgacgccaaacaccgtcatgcgcgcgtacgccgagctggaacaggacgggttgctcgagacgtttcgcggccagggcacgttcgtggcgcgcgggtctggcgtcgaggcgcgggcccgagcgcgcattgcgcggcaggcgtttgaacacgtgcggcgcgtcgcggccgatctcggcatgcgcgtggaagatttgcttaaactgggcgccgaagcggagggaggagcggaagacgatgcaagcagccattga

SEQ ID NO: 152 - DNA, 414 bp, Artificial
  Substituion in SEQ ID NO 138
atgacgttggatccgccttggcaacctcccgcgtgggagctcgatccgtcgcagccgctgtatgagcagattgcgcaccgcctccgggtcgaaattgccgcctcgcgcctgccgggcggggcgaaactgccctccgtgcgcgatctcgccgcgcatctgcgcgtgacgccaaacaccgtcatgcgcgcgtacgccgagctggaacaggacgggttgctcgagacgtttcgcggccagggcacgttcgtggcgcgcgggtctggcgtcgaggcgcgggcccgagcgcgcattgcgcggcaggcgtttgaacacgtgcggcgcgtcgcggccgatctcggcatgcgcgtggaagatttgcttcggctgggcgccgaagcggagggaggagcggaagacgatgcaagcagccattga

SEQ ID NO: 153 - DNA, 414 bp, Artificial
  Substituion in SEQ ID NO 138
atgacgttggatccgccttggcaacctcccgcgtgggagctcgatccgtcgcagccgctgtatgagcagattgcgcaccgcctccgggtcgaaattgccgcctcgcgcctgccgggcggggcgcgcctgccctccgtgcgcgatctcgccgcgcatctgcgcgtgacgccaaacaccgtcatgcgcgcgtacgccgagctggaacaggacgggttgctcgagacgtttcgcggccagggcacgttcgtggcgcgcgggtctggcgtcgaggcgcgggcccgagcgcgcattgcgcggcaggcgtttgaacacgtgcggcgcgtcgcggccgatctcggcatgcgcgtggaagatttgcttcggattggcgccgaagcggagggaggagcggaagacgatgcaagcagccattga

SEQ ID NO: 154 - protein, 217 aa, Alicyclobacillus acidocaldarius
MKRETRSGGNTMSNVHLTILYYSATGTNYRMAQIAAEAARELGAEVRVRKVAELAPREVIETSPAWKAHVEATAHVPVATPDDVAWADAVIFSVPSRFGNIPSQMKQFLDTLGPLWAKGLTANKVVSAMSSAQNPHGGQEATILSLYTSMYHWGAIIAAPGFTDASAYASGGNPYGTSVTLSENGEIDPGAQDAIRHQARRTVTIASWVKQGQAVTV

SEQ ID NO: 155 - DNA, 654 bp, Alicyclobacillus acidocaldarius
gtgaaacgagagacacggagtggagggaacacgatgtccaacgtccatttgactatcctttactatagtgcaacggggaccaactatcgaatggcgcaaatcgcagcggaagccgcgcgcgagctgggcgcggaggtgcgggtgcgcaaagtcgcggaactcgcccctcgcgaagtgattgagacgtccccggcgtggaaggcgcatgtggaggccacggcgcacgtccccgtggccacgcccgacgatgtcgcgtgggcggacgccgtcatcttcagcgtcccgagccggttcggcaatatcccatcgcagatgaagcaattcctggacacgctcggcccgctgtgggccaagggattgaccgcgaacaaggtcgtgagtgccatgtccagcgcgcagaacccgcacggcggccaagaagcgaccattctctcgctctacacttcgatgtatcactggggcgccatcatcgccgcacccggcttcaccgacgcatccgcgtacgcctcgggcggaaatccctatgggacgagcgtgaccttgtcggaaaacggcgagatcgacccaggcgcacaggacgcaattcggcatcaggcgcgccggacggtgaccatcgcatcttgggtcaaacaagggcaggccgtgacggtgtga

SEQ ID NO: 156 - protein, 202 aa, Bacillus pumilus SAFR-032
MENVKLAVIYYSSTGTNYQMAKWAEAGAKEAGAEVKVLKVAELAPEAVVASNPAWKAHLDETKDIPEVQLSDLEWADAIIFSMPTRFGNLPAQMKQFLDTTGGLWFQGKLANKAVSAMTSAQNPNGGQEQTILSLYTTMFHWGAIIAAPGYTDDSLYGAGGNPYGVSVTVDQNGKIQEDAEAAAKHQAKRTVNVAEWIKKGQ

SEQ ID NO: 157 - protein, 201 aa, Bacillus licheniformis ATCC 14580
MSNVKLAVVFYSMGGTNYQLAKWAAEGAKEAGADVKVLKVQELAPQSVIEGNEVWKATVDATKDIPVVTSEDIEWADAIIFSTPTRFGNMASQMKQFLDTQGGLWANGKTVNKVVSAMSSAQNPHGGQEATILSLYTSMMHWGAIIASPGYTDPVLFGAGGNPYGTSVTVDQDGKMIEDVEAAVKHQAKRTVTVAEWVKKG

SEQ ID NO: 158 - protein, 196 aa, Bacillus halodurans C-125
LAIIYYSSTGTNYQLAQWAEEAAKEAGAEVKVLKVAETAPDAAIDSNPAWRAHVDATKDVPAVTLDDLVWADAIMFSIPTRFGNVPSQVKAFLDTTGGLWFEGKLANKVVSAMASASNAHGGQEATVLSLYTTMYHWGAIVAAPGYTAPETFAAGGNPYGTSVTVDQEGNMKEDVKAAVAHQAKRTIQVAEWVKQG

SEQ ID NO: 159 - protein, 201 aa, Bacillus clausii KSM-K16
MANVKTAVIYYSSTGTNYQLAKWAKESAEKEGAEVRLLKFPELAPDAAIDSNPAWRAHVEATKDVPEVTPDDMEWADSYIFSVPSRFGVLPAQAKQFFDTLGGLWAQGKLANKVVSAMSSASNPHGGQEATILSVYTTMYHWGAIVVAPGYTDQSAFTSGGNPYGTSVTIDQDGNQIEDVEQAVKQQAKRTVTVAKAIVTG

SEQ ID NO: 160 - protein, 204 aa, Bacillus sp. NRRL B-14911
LMTVKLAIVYYSSTGTNYQMAQWAAEGAKEAGAEATIYKVQELAPESVIEGVPAWKAHLEETKDVPVVTPDDIAEADAIIFSTPTRFGNMAAQMKQFLDTTGGIWGAGKTVNKVVSGMTSAQNPHGGQEATILSLYTTMYHWGAIVVTPGYSDQSLFPAGGNPYGASVTVDQSNEIVGDKDAYKGAIKYQAKRVIGIAESVKNG

SEQ ID NO: 161 - protein, 217 aa, Artificial
  Substituion in SEQ ID NO 154
MKRETRSGGNTMSNVHLTILYYSATGTNYRMAQIAAEAARELGAEVRVRKVAELAPREVIETSPAWKAHVEATAHVPVATPDDVAWADAVIFSVPSRFGNIPSQMKQFLDTLGPLWAKGLTANKVVSAMSSAQNPHGGQEATILSLYTSMYHWGAIIAAPGFTDASAYASGGNPYGTSVTLSENGEIDPGAQDAIRHQARRTVTIASWIKQGQAVTV

SEQ ID NO: 162 - protein, 217 aa, Artificial
  Substituion in SEQ ID NO 154
MKRETRSGGNTMSNVHLTILYYSATGTNYRMAQIAAEAARELGAEVKVRKVAELAPREVIETSPAWKAHVEATAHVPVATPDDVAWADAVIFSVPSRFGNIPSQMKQFLDTLGPLWAKGLTANKVVSAMSSAQNPHGGQEATILSLYTSMYHWGAIIAAPGFTDASAYASGGNPYGTSVTLSENGEIDPGAQDAIRHQARRTVTIASWVKQGQAVTV

SEQ ID NO: 163 - protein, 217 aa, Artificial
  Substituion in SEQ ID NO 154
MKRETRSGGNTMSNVHLTILYYSATGTNYRMAQIAAEAARELGAEVRVRKVAELAPREVIETSPAWKAHVEATAHVPIATPDDVAWADAVIFSVPSRFGNIPSQMKQFLDTLGPLWAKGLTANKVVSAMSSAQNPHGGQEATILSLYTSMYHWGAIIAAPGFTDASAYASGGNPYGTSVTLSENGEIDPGAQDAIRHQARRTVTIASWVKQGQAVTV

SEQ ID NO: 164 - protein, 217 aa, Artificial
  Substituion in SEQ ID NO 154
MKRETRSGGNTMSNVHLTILYYSATGTNYRMAQIAAEAARELGAEVRVRKVAELAPREVIETSPAWKAHVEATAHVPVATPDDVAWADAVIFSVPSRFGNLPSQMKQFLDTLGPLWAKGLTANKVVSAMSSAQNPHGGQEATILSLYTSMYHWGAIIAAPGFTDASAYASGGNPYGTSVTLSENGEIDPGAQDAIRHQARRTVTIASWVKQGQAVTV

SEQ ID NO: 165 - protein, 217 aa, Artificial
  Substituion in SEQ ID NO 154
MKRETRSGGNTMSNVHLTILYYSATGTNYRMAQIAAEAARELGAEVRVRKVAELAPREVIETSPAWKAHVEATAHVPVATPDDVAWADAVIFSVPSRFGNIPSQMKQFLDTLGPLWAKGLTANKVVSAMSSAQNPHGGQEATILSLYTSMYHWGAIIAAPGFTDASAYASGGNPYGTSVTLSENGEIDPGAQDALRHQARRTVTIASWVKQGQAVTV

SEQ ID NO: 166 - DNA, 654 bp, Artificial
  Substituion in SEQ ID NO 155
gtgaaacgagagacacggagtggagggaacacgatgtccaacgtccatttgactatcctttactatagtgcaacggggaccaactatcgaatggcgcaaatcgcagcggaagccgcgcgcgagctgggcgcggaggtgcgggtgcgcaaagtcgcggaactcgcccctcgcgaagtgattgagacgtccccggcgtggaaggcgcatgtggaggccacggcgcacgtccccgtggccacgcccgacgatgtcgcgtgggcggacgccgtcatcttcagcgtcccgagccggttcggcaatatcccatcgcagatgaagcaattcctggacacgctcggcccgctgtgggccaagggattgaccgcgaacaaggtcgtgagtgccatgtccagcgcgcagaacccgcacggcggccaagaagcgaccattctctcgctctacacttcgatgtatcactggggcgccatcatcgccgcacccggcttcaccgacgcatccgcgtacgcctcgggcggaaatccctatgggacgagcgtgaccttgtcggaaaacggcgagatcgacccaggcgcacaggacgcaattcggcatcaggcgcgccggacggtgaccatcgcatcttggattaaacaagggcaggccgtgacggtgtga

SEQ ID NO: 167 - DNA, 654 bp, Artificial
  Substituion in SEQ ID NO 155
gtgaaacgagagacacggagtggagggaacacgatgtccaacgtccatttgactatcctttactatagtgcaacggggaccaactatcgaatggcgcaaatcgcagcggaagccgcgcgcgagctgggcgcggaggtgaaagtgcgcaaagtcgcggaactcgcccctcgcgaagtgattgagacgtccccggcgtggaaggcgcatgtggaggccacggcgcacgtccccgtggccacgcccgacgatgtcgcgtgggcggacgccgtcatcttcagcgtcccgagccggttcggcaatatcccatcgcagatgaagcaattcctggacacgctcggcccgctgtgggccaagggattgaccgcgaacaaggtcgtgagtgccatgtccagcgcgcagaacccgcacggcggccaagaagcgaccattctctcgctctacacttcgatgtatcactggggcgccatcatcgccgcacccggcttcaccgacgcatccgcgtacgcctcgggcggaaatccctatgggacgagcgtgaccttgtcggaaaacggcgagatcgacccaggcgcacaggacgcaattcggcatcaggcgcgccggacggtgaccatcgcatcttgggtcaaacaagggcaggccgtgacggtgtga

SEQ ID NO: 168 - DNA, 654 bp, Artificial
  Substituion in SEQ ID NO 155
gtgaaacgagagacacggagtggagggaacacgatgtccaacgtccatttgactatcctttactatagtgcaacggggaccaactatcgaatggcgcaaatcgcagcggaagccgcgcgcgagctgggcgcggaggtgcgggtgcgcaaagtcgcggaactcgcccctcgcgaagtgattgagacgtccccggcgtggaaggcgcatgtggaggccacggcgcacgtccccattgccacgcccgacgatgtcgcgtgggcggacgccgtcatcttcagcgtcccgagccggttcggcaatatcccatcgcagatgaagcaattcctggacacgctcggcccgctgtgggccaagggattgaccgcgaacaaggtcgtgagtgccatgtccagcgcgcagaacccgcacggcggccaagaagcgaccattctctcgctctacacttcgatgtatcactggggcgccatcatcgccgcacccggcttcaccgacgcatccgcgtacgcctcgggcggaaatccctatgggacgagcgtgaccttgtcggaaaacggcgagatcgacccaggcgcacaggacgcaattcggcatcaggcgcgccggacggtgaccatcgcatcttgggtcaaacaagggcaggccgtgacggtgtga

SEQ ID NO: 169 - DNA, 654 bp, Artificial
  Substituion in SEQ ID NO 155
gtgaaacgagagacacggagtggagggaacacgatgtccaacgtccatttgactatcctttactatagtgcaacggggaccaactatcgaatggcgcaaatcgcagcggaagccgcgcgcgagctgggcgcggaggtgcgggtgcgcaaagtcgcggaactcgcccctcgcgaagtgattgagacgtccccggcgtggaaggcgcatgtggaggccacggcgcacgtccccgtggccacgcccgacgatgtcgcgtgggcggacgccgtcatcttcagcgtcccgagccggttcggcaatttaccatcgcagatgaagcaattcctggacacgctcggcccgctgtgggccaagggattgaccgcgaacaaggtcgtgagtgccatgtccagcgcgcagaacccgcacggcggccaagaagcgaccattctctcgctctacacttcgatgtatcactggggcgccatcatcgccgcacccggcttcaccgacgcatccgcgtacgcctcgggcggaaatccctatgggacgagcgtgaccttgtcggaaaacggcgagatcgacccaggcgcacaggacgcaattcggcatcaggcgcgccggacggtgaccatcgcatcttgggtcaaacaagggcaggccgtgacggtgtga

SEQ ID NO: 170 - DNA, 654 bp, Artificial
  Substituion in SEQ ID NO 155
gtgaaacgagagacacggagtggagggaacacgatgtccaacgtccatttgactatcctttactatagtgcaacggggaccaactatcgaatggcgcaaatcgcagcggaagccgcgcgcgagctgggcgcggaggtgcgggtgcgcaaagtcgcggaactcgcccctcgcgaagtgattgagacgtccccggcgtggaaggcgcatgtggaggccacggcgcacgtccccgtggccacgcccgacgatgtcgcgtgggcggacgccgtcatcttcagcgtcccgagccggttcggcaatatcccatcgcagatgaagcaattcctggacacgctcggcccgctgtgggccaagggattgaccgcgaacaaggtcgtgagtgccatgtccagcgcgcagaacccgcacggcggccaagaagcgaccattctctcgctctacacttcgatgtatcactggggcgccatcatcgccgcacccggcttcaccgacgcatccgcgtacgcctcgggcggaaatccctatgggacgagcgtgaccttgtcggaaaacggcgagatcgacccaggcgcacaggacgcattacggcatcaggcgcgccggacggtgaccatcgcatcttgggtcaaacaagggcaggccgtgacggtgtga

SEQ ID NO: 171 - protein, 232 aa, Alicyclobacillus acidocaldarius
MRRNAGGERRLGDVIADVLRREIVWGEWPSGHVFSENALARRFGTSRSPVREALRQLAHEGLISLGRNGARVVGLDLGDALELYDVRSLIEQFTASRVCERPRAERESLAHTLSTLVLAMEEAASRRDWQSFSDLDLAYHDAIVRAANHRRVLRMWDEMRSLVQLTLALVMRKRMQRGDADMRGALAQHRSLAEAILAGDAAWVRRVMQSHVEETRRLLEGGLRGHPAGDER

SEQ ID NO: 172 - DNA, 699 bp, Alicyclobacillus acidocaldarius
gtgaggcggaacgccggaggggaaaggaggctcggagacgtcattgcggacgtgcttcggagggagattgtgtggggcgagtggcccagtggacatgtgttcagtgaaaacgcgttggcgcgccgattcggtaccagccgctcgccggtacgcgaggctctgaggcagttggcacacgagggcctgatttcgctcggccggaacggggcgcgggtcgtggggctggaccttggggacgcgttggaactgtatgacgtcaggagtctcattgagcagttcaccgcgtcgcgcgtgtgtgaacggccgcgcgccgagcgggaatcgctcgcccataccctttcgaccctcgtgttggccatggaagaggcggcttcccggagggactggcagtccttttccgatctcgacctcgcctatcacgatgccattgtacgcgcggcaaaccatcgccgcgtcctgcgaatgtgggacgagatgcgaagccttgtacagctcacgctcgcgctcgtcatgcgcaagcggatgcagcgcggagacgctgacatgcgaggcgcgctcgcgcagcatcgaagtctcgcggaggccatcctcgccggcgacgcggcgtgggtgagacgggtgatgcagtcccacgtggaggagacgcgcaggttgctcgagggcggattgcgcgggcaccctgcgggcgacgagcgctga

SEQ ID NO: 173 - protein, 207 aa, Bacillus coagulans 36D1
LGEQIANELRLLILTNEIKPGDIISENQIARKYGTSRSPVRDALKALANDGLIQLERMGARVLGMGLTDIHELYDVREMIEIFAQQRVSAAPQEQLIQFLNETIDKMKIAAKYENHSDFAYYDFSFHDRIIRHAGHKRILNLWNGMKSLIMAVLLVTTEHVFAHGPDHLAWVIEKHRKIVNSLLTGNEENVEQSVSAYFKDSKRTLD

SEQ ID NO: 174 - protein, 210 aa, Paenibacillus larvae subsp. larvae BRL-230010
LGESIACELRLQIINGTIKPGEVISENRVAADFGTSRSPVREALKTLSNEGLIRLERMGAVVLGLSSKDVEELYDVRFLIESFVQERLASINQEPLMTKLNQIIDKMELAVKYNDIADFAYQDFSFHETTVAAAGHNRIFYLWTSIRHIVMTVMLITTEEVFSMGERKKQSVIEKHRTIIRGLESKNGEIILKTVRTYFADSRQTLHNSL

SEQ ID NO: 175 - protein, 186 aa, Exiguobacterium sibiricum 255-15
GDRVAHELRMRIISGKIESGTVLSENKLAADFSVSRSPVRDALKVLASERIIRLERMGAVVVGLSKKDIQEIYDVRLLIETFVFERIVKMDRQDLVRELSKVLEMMKIAIKYKDADEFSYQDVLFHETIIRSIDHGYVSMMWQNLKPVMESFILLSMRQRLDEDIEDFERILENHALYIEAIETGD

SEQ ID NO: 176 - protein, 206 aa, Oceanobacillus iheyensis HTE831
GEQVVAELRMRIISQAIEPETVLSENQLAKEFQVSRSPIREALKVLSSENIVRPERMGAVVIGISEKDIEEIYDVRLMMESFTFQRLLDMDNASLINDLEKVVEMMKIAIKYKDVDQFSFLDMEFHETIIRSINHHYIAMLWTNLKPVMECLVLLSMRYRMQEDENDFERIIENHRLIVESIKNKDANLVNNAFYKNFNDVQNRVE

SEQ ID NO: 177 - protein, 206 aa, Bacillus thuringiensis serovar konkukian str. 97-27
GDRVASELRMRIIAGAIESGTILSENKIAADFSVSRSPVREALKLLASENIIRLERMGAVVIGLTEKEIEEIYDVRLLIETFIFERLGKMDTNDLVRELNKIMEMMKIAIKYHDSDEFSYQDLLFHETIIRTIEHSYILMIWNNLKPVMESLILLSMRTRFKEKYEDFERIIKNHELYIKAIESKDRALMIEALHQNFDDVQGKVE

SEQ ID NO: 178 - protein, 232 aa, Artificial
  Substituion in SEQ ID NO 171
MRRNAGGERRLGDVIADVLRREIVWGEWPSGHVFSENALARRFGTSRSPVREALRQLAHEGLISLGRNGARVVGLDLGDALELYDVRSLIEQFTASRVCERPRAERESLAHTLSTLVLAMEEAASRRDWQSFSDLDLAYHDAIVRAANHRRVLRMWDEMRSLVQLTLALIMRKRMQRGDADMRGALAQHRSLAEAILAGDAAWVRRVMQSHVEETRRLLEGGLRGHPAGDER

SEQ ID NO: 179 - protein, 232 aa, Artificial
  Substituion in SEQ ID NO 171
MRRNAGGERRLGDVIADVLRREIVWGEWPSGHVFSENALARRFGTSRSPVREALRQLAHEGLISLGRNGARVVGLDLGDALELYDVRSLIEQFTASRVCERPRAERESLAHTLSTLVLAMEEAASRRDWQSFSDLDLAYHDAIVRAANHRRVLRMWDEMRSLVQLTLALVMRKRMQRGDADMRGALAQHRSLAEAILAGDAAWVRRVMQSHVEETRRLLEGGIRGHPAGDER

SEQ ID NO: 180 - protein, 232 aa, Artificial
  Substituion in SEQ ID NO 171
MRRNAGGERRLGDVIADVLRREIVWGEWPSGHVFSENALARRFGTSRSPVREALRQLAHEGLISLGRNGARVVGLDLGDALELYDVRSLIEQFTASRVCERPRAERESLAHTLSTLVLAMEEAASRRDWQSFSDLDLAYHDAIVRAANHRRVLRMWDEMRSLVQLTLALVMRKRMQRGDADMRGALAQHRSLAEAILAGDAAWIRRVMQSHVEETRRLLEGGLRGHPAGDER

SEQ ID NO: 181 - protein, 232 aa, Artificial
  Substituion in SEQ ID NO 171
MRRNAGGERRLGDVIADVLRREIVWGEWPSGHVFSENALARRFGTSRSPVREALRQLAHEGLISLGRNGARVVGLDLGDALELYDVRSLIEQFTASRVCERPRAERESLAHTLSTLVLAMEEAASRRDWQSFSDLDLAYHDAIVRAANHRRVLRMWDEMRSLVQLTLALVMRKRMQRGDADMRGALAQHRSLAEAILAGDAAWVRRVMQSHVEETRRILEGGLRGHPAGDER

SEQ ID NO: 182 - protein, 232 aa, Artificial
  Substituion in SEQ ID NO 171
MRRNAGGERRLGDVIADVLRREIVWGEWPSGHVFSENALARRFGTSRSPVREALRQLAHEGLISLGRNGARVVGLDLGDALELYDVRSLIEQFTASRVCERPRAERESLAHTLSTLVLAMEEAASRRDWQSFSDIDLAYHDAIVRAANHRRVLRMWDEMRSLVQLTLALVMRKRMQRGDADMRGALAQHRSLAEAILAGDAAWVRRVMQSHVEETRRLLEGGLRGHPAGDER

SEQ ID NO: 183 - DNA, 699 bp, Artificial
  Substituion in SEQ ID NO 172
gtgaggcggaacgccggaggggaaaggaggctcggagacgtcattgcggacgtgcttcggagggagattgtgtggggcgagtggcccagtggacatgtgttcagtgaaaacgcgttggcgcgccgattcggtaccagccgctcgccggtacgcgaggctctgaggcagttggcacacgagggcctgatttcgctcggccggaacggggcgcgggtcgtggggctggaccttggggacgcgttggaactgtatgacgtcaggagtctcattgagcagttcaccgcgtcgcgcgtgtgtgaacggccgcgcgccgagcgggaatcgctcgcccataccctttcgaccctcgtgttggccatggaagaggcggcttcccggagggactggcagtccttttccgatctcgacctcgcctatcacgatgccattgtacgcgcggcaaaccatcgccgcgtcctgcgaatgtgggacgagatgcgaagccttgtacagctcacgctcgcgctcattatgcgcaagcggatgcagcgcggagacgctgacatgcgaggcgcgctcgcgcagcatcgaagtctcgcggaggccatcctcgccggcgacgcggcgtgggtgagacgggtgatgcagtcccacgtggaggagacgcgcaggttgctcgagggcggattgcgcgggcaccctgcgggcgacgagcgctga

SEQ ID NO: 184 - DNA, 699 bp, Artificial
  Substituion in SEQ ID NO 172
gtgaggcggaacgccggaggggaaaggaggctcggagacgtcattgcggacgtgcttcggagggagattgtgtggggcgagtggcccagtggacatgtgttcagtgaaaacgcgttggcgcgccgattcggtaccagccgctcgccggtacgcgaggctctgaggcagttggcacacgagggcctgatttcgctcggccggaacggggcgcgggtcgtggggctggaccttggggacgcgttggaactgtatgacgtcaggagtctcattgagcagttcaccgcgtcgcgcgtgtgtgaacggccgcgcgccgagcgggaatcgctcgcccataccctttcgaccctcgtgttggccatggaagaggcggcttcccggagggactggcagtccttttccgatctcgacctcgcctatcacgatgccattgtacgcgcggcaaaccatcgccgcgtcctgcgaatgtgggacgagatgcgaagccttgtacagctcacgctcgcgctcgtcatgcgcaagcggatgcagcgcggagacgctgacatgcgaggcgcgctcgcgcagcatcgaagtctcgcggaggccatcctcgccggcgacgcggcgtgggtgagacgggtgatgcagtcccacgtggaggagacgcgcaggttgctcgagggcggaattcgcgggcaccctgcgggcgacgagcgctga

SEQ ID NO: 185 - DNA, 699 bp, Artificial
  Substituion in SEQ ID NO 172
gtgaggcggaacgccggaggggaaaggaggctcggagacgtcattgcggacgtgcttcggagggagattgtgtggggcgagtggcccagtggacatgtgttcagtgaaaacgcgttggcgcgccgattcggtaccagccgctcgccggtacgcgaggctctgaggcagttggcacacgagggcctgatttcgctcggccggaacggggcgcgggtcgtggggctggaccttggggacgcgttggaactgtatgacgtcaggagtctcattgagcagttcaccgcgtcgcgcgtgtgtgaacggccgcgcgccgagcgggaatcgctcgcccataccctttcgaccctcgtgttggccatggaagaggcggcttcccggagggactggcagtccttttccgatctcgacctcgcctatcacgatgccattgtacgcgcggcaaaccatcgccgcgtcctgcgaatgtgggacgagatgcgaagccttgtacagctcacgctcgcgctcgtcatgcgcaagcggatgcagcgcggagacgctgacatgcgaggcgcgctcgcgcagcatcgaagtctcgcggaggccatcctcgccggcgacgcggcgtggattagacgggtgatgcagtcccacgtggaggagacgcgcaggttgctcgagggcggattgcgcgggcaccctgcgggcgacgagcgctga

SEQ ID NO: 186 - DNA, 699 bp, Artificial
  Substituion in SEQ ID NO 172
gtgaggcggaacgccggaggggaaaggaggctcggagacgtcattgcggacgtgcttcggagggagattgtgtggggcgagtggcccagtggacatgtgttcagtgaaaacgcgttggcgcgccgattcggtaccagccgctcgccggtacgcgaggctctgaggcagttggcacacgagggcctgatttcgctcggccggaacggggcgcgggtcgtggggctggaccttggggacgcgttggaactgtatgacgtcaggagtctcattgagcagttcaccgcgtcgcgcgtgtgtgaacggccgcgcgccgagcgggaatcgctcgcccataccctttcgaccctcgtgttggccatggaagaggcggcttcccggagggactggcagtccttttccgatctcgacctcgcctatcacgatgccattgtacgcgcggcaaaccatcgccgcgtcctgcgaatgtgggacgagatgcgaagccttgtacagctcacgctcgcgctcgtcatgcgcaagcggatgcagcgcggagacgctgacatgcgaggcgcgctcgcgcagcatcgaagtctcgcggaggccatcctcgccggcgacgcggcgtgggtgagacgggtgatgcagtcccacgtggaggagacgcgcaggattctcgagggcggattgcgcgggcaccctgcgggcgacgagcgctga

SEQ ID NO: 187 - DNA, 699 bp, Artificial
  Substituion in SEQ ID NO 172
gtgaggcggaacgccggaggggaaaggaggctcggagacgtcattgcggacgtgcttcggagggagattgtgtggggcgagtggcccagtggacatgtgttcagtgaaaacgcgttggcgcgccgattcggtaccagccgctcgccggtacgcgaggctctgaggcagttggcacacgagggcctgatttcgctcggccggaacggggcgcgggtcgtggggctggaccttggggacgcgttggaactgtatgacgtcaggagtctcattgagcagttcaccgcgtcgcgcgtgtgtgaacggccgcgcgccgagcgggaatcgctcgcccataccctttcgaccctcgtgttggccatggaagaggcggcttcccggagggactggcagtccttttccgatattgacctcgcctatcacgatgccattgtacgcgcggcaaaccatcgccgcgtcctgcgaatgtgggacgagatgcgaagccttgtacagctcacgctcgcgctcgtcatgcgcaagcggatgcagcgcggagacgctgacatgcgaggcgcgctcgcgcagcatcgaagtctcgcggaggccatcctcgccggcgacgcggcgtgggtgagacgggtgatgcagtcccacgtggaggagacgcgcaggttgctcgagggcggattgcgcgggcaccctgcgggcgacgagcgctga

SEQ ID NO: 188 - protein, 221 aa, Alicyclobacillus acidocaldarius
MSETRQKDRAMRQDAWTTEDDEILAEIVLKHIKQGSTQLAGFNEAARRLGRTAAACGFRWNACVRKQQRYRIELAKEERKKNKSQRVQAQLEGGDADHPTATLMTWAQVLRFLRQEKNTAQEWASRWRSTERQLNEWKAKYEALEADYKRVCEELRELKSTHDAITRDYKALLEIMERARKAALLDDDLIGPKFAEGFMYRIDEYGNLERITTGERMEQAE

SEQ ID NO: 189 - DNA, 666 bp, Alicyclobacillus acidocaldarius
atgagcgagacgagacagaaggacagggcgatgcgccaagacgcgtggacaaccgaggacgacgagattctagcggagatcgtcctgaaacacatcaaacaaggtagcacacagctggccgggttcaacgaagcggcgaggcggctcggcagaacggcggccgcgtgcggcttccgctggaacgcctgtgtgcgaaagcaacagcgttaccgcattgagctcgccaaagaggagcgcaagaaaaacaagtcgcagcgcgtgcaggcgcagctcgaaggtggcgacgctgatcacccgaccgcgacactcatgacgtgggcgcaggtgctccggttcttgcgccaggagaagaacaccgcgcaggagtgggcgtcgcgatggcgcagcacggaacgccagctgaatgagtggaaggcgaagtacgaggcgctcgaggcggactacaagcgcgtttgcgaagaattgcgcgaactgaagtccacgcacgacgccatcacccgcgattacaaggcgcttttggaaatcatggagcgggcgcgcaaagcggccctcctggacgatgatctgattggtccgaagtttgccgaagggtttatgtaccgaattgatgagtatggcaacctggagcggatcacgaccggtgagcgcatggagcaggctgagtag

SEQ ID NO: 190 - protein, 168 aa, Bacillus coagulans 36D1
AVRQDAWTQEEDLLLSDIVLRHIREGSTQLRAFEEAGKRMNRTAAACGFRWNSYVRKQYASEIEAAKKERKEKKQLVRDSGRAPAEEGQQTEATLFDAIRILQQLAEKSRHESGQLSASRRGTEEWKSKYEALLQKYLEEKEKHEQLQKEYSALLSIMEKARQLSEQD

SEQ ID NO: 191 - protein, 169 aa, Geobacillus kaustophilus HTA426
VRQDAWTKEEDELLANVVLQYIREGGTQLEAFAEVGRRLSRTAAACGFRWNSCVRKQYKEEIEQAKQERKMRKKETPSTKESEGQEKVEAAVKSHLSWAEVLAFLQAEEQKARDARRTADENRALKNDMEQLQQMVTKLQMEKESLQKQLAAIQEEYKTLLSIMERARK

SEQ ID NO: 192 - protein, 199 aa, Bacillus halodurans C-125
VRQDAWSHEDDVFLAETVLKHIEEGSTQLRAFDEVGDVLNRTSAACGFRWNAVVRQRYVKQIAEAKKERKRRKRAASYAYQLYPTASQQPVVLTGEATSLTLPMVIEFLQQLATHQVADGQTRKEQEELMKQNEQLQERNKELEKELQKIKQEHSIIEEDYQSMIQIMNRARRMAILQDDEPASTQAFKMDKNGNLEKI

SEQ ID NO: 193 - protein, 169 aa, Geobacillus thermodenitrificans NG80-2
VRQDAWTKEEDELLANVVLEYIRTGGTQLEAFAEVGRRLSRTAAACGFRWNSYVRKQYKEEIEQAKQERKTRKKETASEKDGRGQPEMEAAVESKLSWAEVLAFLQAEGQKAREIRRTADENRALKNDMEQLQQMVTKLQMEKEALQKQLAAVQEEYKTLLTIMERARK

SEQ ID NO: 194 - protein, 203 aa, Bacillus sp. SG-1
RQDAWSQDEDLLLAEVVLRHIREGGTQLQAFEEVGRKLSRTAAACGFRWNSFVRKQYKSGIELAKRQRKESKKQPVPSPAREVKQPDVKHEVASADKKVEPQSSKVTLNGVIEFLEGLKDNLNQDKELESAYKKLEEYVGKIEQQLEKLKEENSVYKEKLELLEEDHQSLLSIFEKARKMALLQESDDKVKFQMDKNGNLQRL

SEQ ID NO: 195 - protein, 221 aa, Artificial
  Substituion in SEQ ID NO 188
MSETRQKDRAMRQDAWTTEDDEILAEIVLKHIKQGSTQLAGFNEAARRLGRTAAACGFRWNACVRKQQRYRIELAKEERKKNKSQRVQAQLEGGDADHPTATLMTWAQVLRFLRQEKNTAQEWASRWRSTERQLNEWKAKYEALDADYKRVCEELRELKSTHDAITRDYKALLEIMERARKAALLDDDLIGPKFAEGFMYRIDEYGNLERITTGERMEQAE

SEQ ID NO: 196 - protein, 221 aa, Artificial
  Substituion in SEQ ID NO 188
MSETRQKDRAMRQDAWTTEDDEILAEIVLKHIKQGSTQLAGFNEAARRLGRTAAACGFRWNACVRKQQRYRIELAKEERKKNKSQRVQAQLEGGDADHPTATLMTWAQVLRFLRQEKNTAQEWASRWRSTDRQLNEWKAKYEALEADYKRVCEELRELKSTHDAITRDYKALLEIMERARKAALLDDDLIGPKFAEGFMYRIDEYGNLERITTGERMEQAE

SEQ ID NO: 197 - protein, 221 aa, Artificial
  Substituion in SEQ ID NO 188
MSETRQKDRAMRQDAWTTEDDEILAEIVLKHIKQGSTQLAGFNEAARRLGRTAAACGFRWNACVRKQQRYRIELAKEERKKNKSQRVQAQLEGGDADHPTATLMTWAQVLRFLRQEKNTAQEWASRWRSTERQLNEWKAKYEALEADYKRVCEELRDLKSTHDAITRDYKALLEIMERARKAALLDDDLIGPKFAEGFMYRIDEYGNLERITTGERMEQAE

SEQ ID NO: 198 - protein, 221 aa, Artificial
  Substituion in SEQ ID NO 188
MSETRQKDRAMRQDAWTTEDDEILAEIVLKHIKQGSTQLAGFNEAARRLGRTAAACGFRWNACVRKQQRYRIELAKEERKKNKSQRVQAQLEGGDADHPTATLMTWAQVLRFLRQEKNTAQEWASRWRSTERQLNEWKAKYEALEADYKRVCEELRELKSTHDAITRDYKALLEIMERARKAALLDDDLIGPKFAEGFMYRIDEYGNLERITTGERMENAE

SEQ ID NO: 199 - protein, 221 aa, Artificial
  Substituion in SEQ ID NO 188
MSETRQKDRAMRQDAWTTEDDEILAEIVLKHIKQGSTQLAGFNEAARRLGRTAAACGFRWNACVRKQQRYRIELAKEERKKNKSQRVQAQLEGGDADHPTATLMTWAQVLRFLRQEKNTAQEWASRWRSTERQLNEWKAKYEALEADYKRVCEELRELKSTHDAITRDYKALLEIMERARKAALLDDDLIGPKFAEGFMYRIDEYGNLERITTGDRMEQAE

SEQ ID NO: 200 - DNA, 666 bp, Artificial
  Substituion in SEQ ID NO 189
atgagcgagacgagacagaaggacagggcgatgcgccaagacgcgtggacaaccgaggacgacgagattctagcggagatcgtcctgaaacacatcaaacaaggtagcacacagctggccgggttcaacgaagcggcgaggcggctcggcagaacggcggccgcgtgcggcttccgctggaacgcctgtgtgcgaaagcaacagcgttaccgcattgagctcgccaaagaggagcgcaagaaaaacaagtcgcagcgcgtgcaggcgcagctcgaaggtggcgacgctgatcacccgaccgcgacactcatgacgtgggcgcaggtgctccggttcttgcgccaggagaagaacaccgcgcaggagtgggcgtcgcgatggcgcagcacggaacgccagctgaatgagtggaaggcgaagtacgaggcgctcgatgcggactacaagcgcgtttgcgaagaattgcgcgaactgaagtccacgcacgacgccatcacccgcgattacaaggcgcttttggaaatcatggagcgggcgcgcaaagcggccctcctggacgatgatctgattggtccgaagtttgccgaagggtttatgtaccgaattgatgagtatggcaacctggagcggatcacgaccggtgagcgcatggagcaggctgagtag

SEQ ID NO: 201 - DNA, 666 bp, Artificial
  Substituion in SEQ ID NO 189
atgagcgagacgagacagaaggacagggcgatgcgccaagacgcgtggacaaccgaggacgacgagattctagcggagatcgtcctgaaacacatcaaacaaggtagcacacagctggccgggttcaacgaagcggcgaggcggctcggcagaacggcggccgcgtgcggcttccgctggaacgcctgtgtgcgaaagcaacagcgttaccgcattgagctcgccaaagaggagcgcaagaaaaacaagtcgcagcgcgtgcaggcgcagctcgaaggtggcgacgctgatcacccgaccgcgacactcatgacgtgggcgcaggtgctccggttcttgcgccaggagaagaacaccgcgcaggagtgggcgtcgcgatggcgcagcacggatcgccagctgaatgagtggaaggcgaagtacgaggcgctcgaggcggactacaagcgcgtttgcgaagaattgcgcgaactgaagtccacgcacgacgccatcacccgcgattacaaggcgcttttggaaatcatggagcgggcgcgcaaagcggccctcctggacgatgatctgattggtccgaagtttgccgaagggtttatgtaccgaattgatgagtatggcaacctggagcggatcacgaccggtgagcgcatggagcaggctgagtag

SEQ ID NO: 202 - DNA, 666 bp, Artificial
  Substituion in SEQ ID NO 189
atgagcgagacgagacagaaggacagggcgatgcgccaagacgcgtggacaaccgaggacgacgagattctagcggagatcgtcctgaaacacatcaaacaaggtagcacacagctggccgggttcaacgaagcggcgaggcggctcggcagaacggcggccgcgtgcggcttccgctggaacgcctgtgtgcgaaagcaacagcgttaccgcattgagctcgccaaagaggagcgcaagaaaaacaagtcgcagcgcgtgcaggcgcagctcgaaggtggcgacgctgatcacccgaccgcgacactcatgacgtgggcgcaggtgctccggttcttgcgccaggagaagaacaccgcgcaggagtgggcgtcgcgatggcgcagcacggaacgccagctgaatgagtggaaggcgaagtacgaggcgctcgaggcggactacaagcgcgtttgcgaagaattgcgcgatctgaagtccacgcacgacgccatcacccgcgattacaaggcgcttttggaaatcatggagcgggcgcgcaaagcggccctcctggacgatgatctgattggtccgaagtttgccgaagggtttatgtaccgaattgatgagtatggcaacctggagcggatcacgaccggtgagcgcatggagcaggctgagtag

SEQ ID NO: 203 - DNA, 666 bp, Artificial
  Substituion in SEQ ID NO 189
atgagcgagacgagacagaaggacagggcgatgcgccaagacgcgtggacaaccgaggacgacgagattctagcggagatcgtcctgaaacacatcaaacaaggtagcacacagctggccgggttcaacgaagcggcgaggcggctcggcagaacggcggccgcgtgcggcttccgctggaacgcctgtgtgcgaaagcaacagcgttaccgcattgagctcgccaaagaggagcgcaagaaaaacaagtcgcagcgcgtgcaggcgcagctcgaaggtggcgacgctgatcacccgaccgcgacactcatgacgtgggcgcaggtgctccggttcttgcgccaggagaagaacaccgcgcaggagtgggcgtcgcgatggcgcagcacggaacgccagctgaatgagtggaaggcgaagtacgaggcgctcgaggcggactacaagcgcgtttgcgaagaattgcgcgaactgaagtccacgcacgacgccatcacccgcgattacaaggcgcttttggaaatcatggagcgggcgcgcaaagcggccctcctggacgatgatctgattggtccgaagtttgccgaagggtttatgtaccgaattgatgagtatggcaacctggagcggatcacgaccggtgagcgcatggagaatgctgagtag

SEQ ID NO: 204 - DNA, 666 bp, Artificial
  Substituion in SEQ ID NO 189
atgagcgagacgagacagaaggacagggcgatgcgccaagacgcgtggacaaccgaggacgacgagattctagcggagatcgtcctgaaacacatcaaacaaggtagcacacagctggccgggttcaacgaagcggcgaggcggctcggcagaacggcggccgcgtgcggcttccgctggaacgcctgtgtgcgaaagcaacagcgttaccgcattgagctcgccaaagaggagcgcaagaaaaacaagtcgcagcgcgtgcaggcgcagctcgaaggtggcgacgctgatcacccgaccgcgacactcatgacgtgggcgcaggtgctccggttcttgcgccaggagaagaacaccgcgcaggagtgggcgtcgcgatggcgcagcacggaacgccagctgaatgagtggaaggcgaagtacgaggcgctcgaggcggactacaagcgcgtttgcgaagaattgcgcgaactgaagtccacgcacgacgccatcacccgcgattacaaggcgcttttggaaatcatggagcgggcgcgcaaagcggccctcctggacgatgatctgattggtccgaagtttgccgaagggtttatgtaccgaattgatgagtatggcaacctggagcggatcacgaccggtgatcgcatggagcaggctgagtag

SEQ ID NO: 205 - protein, 289 aa, Alicyclobacillus acidocaldarius
MNRGRTGGERRESMPRQETAEERERRKARNRRIVVSFFAFIGLVAVLESPLARVRHIEVSGNTTIPMAQIVACSGVVYGESLWEVNRKRAASEIVAKLPMVDRAAISVSWPSGTVSIHVHERDVVAVYADPNGFYELMSNGYVYQKIPSAAGLPYPIVTGQDSELSVHQMASAAVSSVCRQLASVPASELTGVSEIHVNGDGTVTIYLDNDFEVLADVANLRGSVAAIQPTIRYFEGKGYRPGVIDLTGSPPYRYTPFSSLPSSNAKTSSASGRGGPVEGTSSKTASHP

SEQ ID NO: 206 - DNA, 870 bp, Alicyclobacillus acidocaldarius
gtgaacagggggcgcacaggcggcgaaaggcgtgaaagcatgccacgacaggaaacggcagaagagcgcgagcgtcggaaggcgagaaatcggcggattgtcgtgagcttcttcgcgttcatcgggcttgtggcggtgctggagtcgccgctcgcccgcgtgcgccacattgaggtgagcggcaacacgacaattccgatggcgcagatcgtcgcgtgtagcggcgtcgtgtacggcgagagcctgtgggaagtgaaccggaagcgggccgcttcggagatcgtcgcgaagttgcccatggtcgatcgcgccgccatctccgtctcgtggccatctggaaccgtgtcgatccacgtccacgagcgggacgtggtcgctgtgtacgcagatccaaacgggttctacgagctcatgtcaaacggctacgtgtatcaaaagatcccctcggcggcggggctcccgtatcccatcgtgacaggccaagactcggagctctccgtgcaccagatggcctcggccgcagtctcttcggtctgtcgccaactcgcttcggttcccgcgagcgagttgaccggggtgtccgaaattcacgtgaacggagatggcacggtcaccatctatctcgacaacgacttcgaagtgctggcggacgtggcgaatctgcgaggttcggtggccgccatccagccgaccatccgctattttgaggggaagggctaccgtccgggcgtgatcgacctgaccggatcgccgccctatcgatacaccccgttttcgtcgctgcccagttcgaacgcaaagacctcgtcggcttctggccgaggcgggcctgtcgaggggacaagctcgaaaaccgcctcgcatccctga

SEQ ID NO: 207 - protein, 203 aa, Bacillus coagulans 36D1
FFMLVMLIIYLESPLSRVHRIQIEGNEAVSKPYILKKSGIATGENIWNIRKDAVRKRIASIPEVDSVKVGISLPNTLYIKVKEHQKIGYLQQKGGFLPVLDNGSVVKRTVKEIPAASLIFTGFKQDTHLHEMIRQMQKLPDSITNAISEVRYTPSNVDRDLVTLYMNNGFEVRASIPSFAEKMAHYPSIISQLDPKKKGVIDL

SEQ ID NO: 208 - protein, 179 aa, Geobacillus thermodenitrificans NG80-2
FFLFILCVLYFQSPLSAVRHVEVSGNRHLPAERIISLSGITKRTSFWKVNEQNVEAKIARHPEIKEATVKKRLPNTIVIDVREWRRVAYVYNRQTFFPLLENGQLLKQEAVKTAPSDAPVLVGWKSGEAIAEMTGQLAELPAAVLGAISEIHYKPTGEYKDRVVVYMNDGYEVSATIHN

SEQ ID NO: 209 - protein, 177 aa, Geobacillus thermoleovorans
FFLFILCVLYFQSPLGAVGHVEVSGNRHLTAERIISLSGITKRTSFWKVNEQNVEKKLTRHPEIKEATVEKQLPNTIAIHVREWRRIAYVYDRQTFFPLLENGRLLKQEGTKTAPSDAPVLVGWKDGDAIAEMTGQLAELPAAVLGAMSEIHYKPTREYEDRVIVYMNDGYEVSATI

SEQ ID NO: 210 - protein, 177 aa, Geobacillus kaustophilus HTA426; identical to SEQ ID NO: 209

SEQ ID NO: 211 - protein, 208 aa, Bacillus sp. NRRL B-14911
LLLLFFSMIVFVIYFQSPLSRVKEISISGNQTYTTKELIAVSGLSKKTNIWKVDKGAIEGRLKELPEISGAEIKTRLPNTVDIKVAEHNRIAYIAKEKSFLPVLENGMILSKQEITDIPVNAPLLLGFKEGDVLLEMIDSLESLPKEVLNAISEIHYSPKETDEYHITLYMNDGFEVSATLRSFSEKMAHYPSIISQLDPGVSGVIDL

SEQ ID NO: 212 - protein, 289 aa, Artificial
  Substituion in SEQ ID NO 205
MNRGRTGGERRESMPRQETAEERERRKARNRRIVVSFFAFIGLVAVLESPLARVRHIEVSGNTTIPMAQIVACSGVVYGESLWEVNRKRAASEIVAKLPMVDRAAISVSWPSGTVSIHVHERDVVAVYADPNGFYELMSNGYVYQKIPSAAGLPYPIVTGQDSELSVHQMASAAVSSVCRQLASVPASELTGVSEIHVNGDGTVTIYLDNDFEVLADVANLRGSVAALQPTIRYFEGKGYRPGVIDLTGSPPYRYTPFSSLPSSNAKTSSASGRGGPVEGTSSKTASHP

SEQ ID NO: 213 - protein, 289 aa, Artificial
  Substituion in SEQ ID NO 205
MNRGRTGGERRESMPRQETAEERERRKARNRRIVVSFFAFIGLVAVLESPLARVRHIEVSGNTTIPMAQIVACSGVVYGESLWEVNRKRAASEIVAKLPMVDRAAISVSWPSGTVSIHVHERDVVAVYADPNGFYELMSNGYVYQKIPSAAGLPYPIVTGQDSELSVHQMASAAVSSVCRQLASVPASELTGVSEIHVNGDGTVTIYLDNDFEVLADVANLRGSVAAINPTIRYFEGKGYRPGVIDLTGSPPYRYTPFSSLPSSNAKTSSASGRGGPVEGTSSKTASHP

SEQ ID NO: 214 - protein, 289 aa, Artificial
  Substituion in SEQ ID NO 205
MNRGRTGGERRESMPRQETAEERERRKARNRRIVVSFFAFIGLVAVLESPLARVRHIEVSGNTTIPMAQIVACSGVVYGESLWEVNRKRAASEIVAKLPMVDRAAISVSWPSGTVSIHVHERDVVAVYADPNGFYELMSNGYVYQKIPSAAGLPYPIVTGQDSELSVHQMASAAVSSVCRQLASVPASELTGVSEIHVNGDGTVTIYLENDFEVLADVANLRGSVAAIQPTIRYFEGKGYRPGVIDLTGSPPYRYTPFSSLPSSNAKTSSASGRGGPVEGTSSKTASHP

SEQ ID NO: 215 - protein, 289 aa, Artificial
  Substituion in SEQ ID NO 205
MNRGRTGGERRESMPRQETAEERERRKARNRRIVISFFAFIGLVAVLESPLARVRHIEVSGNTTIPMAQIVACSGVVYGESLWEVNRKRAASEIVAKLPMVDRAAISVSWPSGTVSIHVHERDVVAVYADPNGFYELMSNGYVYQKIPSAAGLPYPIVTGQDSELSVHQMASAAVSSVCRQLASVPASELTGVSEIHVNGDGTVTIYLDNDFEVLADVANLRGSVAAIQPTIRYFEGKGYRPGVIDLTGSPPYRYTPFSSLPSSNAKTSSASGRGGPVEGTSSKTASHP

SEQ ID NO: 216 - protein, 289 aa, Artificial
  Substituion in SEQ ID NO 205
MNRGRTGGERRESMPRQETAEERERRKARNRRIVVSFFAFIGLVAVLESPLARVRHIEVSGNTTIPMAQIVACSGVVYGESLWEVNRKRAASEIVAKLPMVDRAAISVSWPSGTVSIHVHERDVVAVYADPNGFYELMSNGYVYQKIPSAAGLPYPIVTGQDSELSVHQMASAAVSSICRQLASVPASELTGVSEIHVNGDGTVTIYLDNDFEVLADVANLRGSVAAIQPTIRYFEGKGYRPGVIDLTGSPPYRYTPFSSLPSSNAKTSSASGRGGPVEGTSSKTASHP

SEQ ID NO: 217 - DNA, 870 bp, Artificial
  Substituion in SEQ ID NO 206
gtgaacagggggcgcacaggcggcgaaaggcgtgaaagcatgccacgacaggaaacggcagaagagcgcgagcgtcggaaggcgagaaatcggcggattgtcgtgagcttcttcgcgttcatcgggcttgtggcggtgctggagtcgccgctcgcccgcgtgcgccacattgaggtgagcggcaacacgacaattccgatggcgcagatcgtcgcgtgtagcggcgtcgtgtacggcgagagcctgtgggaagtgaaccggaagcgggccgcttcggagatcgtcgcgaagttgcccatggtcgatcgcgccgccatctccgtctcgtggccatctggaaccgtgtcgatccacgtccacgagcgggacgtggtcgctgtgtacgcagatccaaacgggttctacgagctcatgtcaaacggctacgtgtatcaaaagatcccctcggcggcggggctcccgtatcccatcgtgacaggccaagactcggagctctccgtgcaccagatggcctcggccgcagtctcttcggtctgtcgccaactcgcttcggttcccgcgagcgagttgaccggggtgtccgaaattcacgtgaacggagatggcacggtcaccatctatctcgacaacgacttcgaagtgctggcggacgtggcgaatctgcgaggttcggtggccgccttacagccgaccatccgctattttgaggggaagggctaccgtccgggcgtgatcgacctgaccggatcgccgccctatcgatacaccccgttttcgtcgctgcccagttcgaacgcaaagacctcgtcggcttctggccgaggcgggcctgtcgaggggacaagctcgaaaaccgcctcgcatccctga

SEQ ID NO: 218 - DNA, 870 bp, Artificial
  Substituion in SEQ ID NO 206
gtgaacagggggcgcacaggcggcgaaaggcgtgaaagcatgccacgacaggaaacggcagaagagcgcgagcgtcggaaggcgagaaatcggcggattgtcgtgagcttcttcgcgttcatcgggcttgtggcggtgctggagtcgccgctcgcccgcgtgcgccacattgaggtgagcggcaacacgacaattccgatggcgcagatcgtcgcgtgtagcggcgtcgtgtacggcgagagcctgtgggaagtgaaccggaagcgggccgcttcggagatcgtcgcgaagttgcccatggtcgatcgcgccgccatctccgtctcgtggccatctggaaccgtgtcgatccacgtccacgagcgggacgtggtcgctgtgtacgcagatccaaacgggttctacgagctcatgtcaaacggctacgtgtatcaaaagatcccctcggcggcggggctcccgtatcccatcgtgacaggccaagactcggagctctccgtgcaccagatggcctcggccgcagtctcttcggtctgtcgccaactcgcttcggttcccgcgagcgagttgaccggggtgtccgaaattcacgtgaacggagatggcacggtcaccatctatctcgacaacgacttcgaagtgctggcggacgtggcgaatctgcgaggttcggtggccgccatcaatccgaccatccgctattttgaggggaagggctaccgtccgggcgtgatcgacctgaccggatcgccgccctatcgatacaccccgttttcgtcgctgcccagttcgaacgcaaagacctcgtcggcttctggccgaggcgggcctgtcgaggggacaagctcgaaaaccgcctcgcatccctga

SEQ ID NO: 219 - DNA, 870 bp, Artificial
  Substituion in SEQ ID NO 206
gtgaacagggggcgcacaggcggcgaaaggcgtgaaagcatgccacgacaggaaacggcagaagagcgcgagcgtcggaaggcgagaaatcggcggattgtcgtgagcttcttcgcgttcatcgggcttgtggcggtgctggagtcgccgctcgcccgcgtgcgccacattgaggtgagcggcaacacgacaattccgatggcgcagatcgtcgcgtgtagcggcgtcgtgtacggcgagagcctgtgggaagtgaaccggaagcgggccgcttcggagatcgtcgcgaagttgcccatggtcgatcgcgccgccatctccgtctcgtggccatctggaaccgtgtcgatccacgtccacgagcgggacgtggtcgctgtgtacgcagatccaaacgggttctacgagctcatgtcaaacggctacgtgtatcaaaagatcccctcggcggcggggctcccgtatcccatcgtgacaggccaagactcggagctctccgtgcaccagatggcctcggccgcagtctcttcggtctgtcgccaactcgcttcggttcccgcgagcgagttgaccggggtgtccgaaattcacgtgaacggagatggcacggtcaccatctatctcgaaaacgacttcgaagtgctggcggacgtggcgaatctgcgaggttcggtggccgccatccagccgaccatccgctattttgaggggaagggctaccgtccgggcgtgatcgacctgaccggatcgccgccctatcgatacaccccgttttcgtcgctgcccagttcgaacgcaaagacctcgtcggcttctggccgaggcgggcctgtcgaggggacaagctcgaaaaccgcctcgcatccctga

SEQ ID NO: 220 - DNA, 870 bp, Artificial
  Substituion in SEQ ID NO 206
gtgaacagggggcgcacaggcggcgaaaggcgtgaaagcatgccacgacaggaaacggcagaagagcgcgagcgtcggaaggcgagaaatcggcggattgtcattagcttcttcgcgttcatcgggcttgtggcggtgctggagtcgccgctcgcccgcgtgcgccacattgaggtgagcggcaacacgacaattccgatggcgcagatcgtcgcgtgtagcggcgtcgtgtacggcgagagcctgtgggaagtgaaccggaagcgggccgcttcggagatcgtcgcgaagttgcccatggtcgatcgcgccgccatctccgtctcgtggccatctggaaccgtgtcgatccacgtccacgagcgggacgtggtcgctgtgtacgcagatccaaacgggttctacgagctcatgtcaaacggctacgtgtatcaaaagatcccctcggcggcggggctcccgtatcccatcgtgacaggccaagactcggagctctccgtgcaccagatggcctcggccgcagtctcttcggtctgtcgccaactcgcttcggttcccgcgagcgagttgaccggggtgtccgaaattcacgtgaacggagatggcacggtcaccatctatctcgacaacgacttcgaagtgctggcggacgtggcgaatctgcgaggttcggtggccgccatccagccgaccatccgctattttgaggggaagggctaccgtccgggcgtgatcgacctgaccggatcgccgccctatcgatacaccccgttttcgtcgctgcccagttcgaacgcaaagacctcgtcggcttctggccgaggcgggcctgtcgaggggacaagctcgaaaaccgcctcgcatccctga

SEQ ID NO: 221 - DNA, 870 bp, Artificial
  Substituion in SEQ ID NO 206
gtgaacagggggcgcacaggcggcgaaaggcgtgaaagcatgccacgacaggaaacggcagaagagcgcgagcgtcggaaggcgagaaatcggcggattgtcgtgagcttcttcgcgttcatcgggcttgtggcggtgctggagtcgccgctcgcccgcgtgcgccacattgaggtgagcggcaacacgacaattccgatggcgcagatcgtcgcgtgtagcggcgtcgtgtacggcgagagcctgtgggaagtgaaccggaagcgggccgcttcggagatcgtcgcgaagttgcccatggtcgatcgcgccgccatctccgtctcgtggccatctggaaccgtgtcgatccacgtccacgagcgggacgtggtcgctgtgtacgcagatccaaacgggttctacgagctcatgtcaaacggctacgtgtatcaaaagatcccctcggcggcggggctcccgtatcccatcgtgacaggccaagactcggagctctccgtgcaccagatggcctcggccgcagtctcttcgatttgtcgccaactcgcttcggttcccgcgagcgagttgaccggggtgtccgaaattcacgtgaacggagatggcacggtcaccatctatctcgacaacgacttcgaagtgctggcggacgtggcgaatctgcgaggttcggtggccgccatccagccgaccatccgctattttgaggggaagggctaccgtccgggcgtgatcgacctgaccggatcgccgccctatcgatacaccccgttttcgtcgctgcccagttcgaacgcaaagacctcgtcggcttctggccgaggcgggcctgtcgaggggacaagctcgaaaaccgcctcgcatccctga

SEQ ID NO: 222 - protein, 411 aa, Alicyclobacillus acidocaldarius
MAKEDYIVSLDIGTSKVRVIIGESTGNNLNIIGVGSASSQGLRHGAIVDIDKTVDSIREAVDHAERMVGIRIPSAYVGISGEHIQLHSSHGVVAVSSADREITDEDIERVLQQARVVALPPEREVIDVVAKEFVVDGLRGIMDPRGMLGVRLEVDAYLITGSRTAIHNIVRCVERAGLEVANLVLAPMAASQIALTQDERKLGVALVDVGAGVTSVSVFANGVLMGTSIIPIGGDYVTQDIAIGLRTNTVAAEQVKLRHACAMVEQASEHETFRVPRMGSNKEAEFTQYDLATIIEPRMQEIFGLVRKEVEKMGYADELPAGYVFHGGVMSTPSAAELAGEELQAPVRIAVPEFLGVRDPSFVNGVGMIVYAARTGLRPSSADYNAGARQVRSSNHVGVFARIKDWLRDFV

SEQ ID NO: 223 - DNA, 1236 bp, Alicyclobacillus acidocaldarius
ttggccaaggaggactacatcgtcagtctcgacatcggcacttcgaaggtgcgagtcatcatcggagagtcgaccggaaacaacttgaacatcattggagtgggctccgcctcgagtcaaggactgcgccacggtgcgattgtcgatattgacaaaacggttgattcaatccgcgaagcggtcgatcacgccgagcgcatggtgggcattcgcatcccatccgcgtacgtgggcatttcgggggagcacattcaactgcacagctctcacggggtggtcgcggtgtcttcggcggaccgcgagatcacggatgaagatattgaacgcgttttgcagcaagcgcgagtcgtggcgctgcctccggaacgcgaggtcattgacgtggttgccaaggagtttgtcgtcgacggcctgcgcgggatcatggatccgcgcgggatgctcggcgtgcggctggaggtggatgcgtacctcatcaccggaagccgcaccgccattcacaacattgtccgatgtgtggagcgcgcgggactggaagtggcgaatctcgtgctcgcgcccatggccgcgagccaaatcgcgctcacccaggacgaacgcaagttgggcgtcgccttggtggacgtgggcgcgggcgtgacgtcggtcagcgtgttcgccaacggcgttctgatggggacgagcatcatccccattggcggcgactacgtgacgcaggacatcgccatcgggttgcgcaccaacacggtcgcggctgaacaagtgaaactccgtcacgcctgcgcgatggtggagcaggcgtccgagcacgagacctttcgggtaccccgaatggggagcaacaaggaggccgagttcacgcagtacgatctcgccaccatcatcgagcctcgcatgcaggagatattcggcttagtgcgaaaagaagtagaaaagatgggctatgccgacgagctgcccgcgggttacgtgtttcacggcggcgtcatgtcgacgccttccgcggccgagttggcgggagaagaactgcaggcgcctgtgcgcatcgccgttccagagttcctcggggtgcgcgatccgtcattcgtcaacggggtcggcatgattgtgtatgccgcgcgcacggggcttcgaccaagctcggcggattacaacgctggcgctcgtcaggttcgttcgtccaatcacgtcggcgtatttgcacgaatcaaagattggctgcgcgatttcgtgtga

SEQ ID NO: 224 - protein, 417 aa, Paenibacillus larvae subsp. larvae BRL-230010
MSSSDIIVSLDIGTSKVRAIIGEVNNGTINIIGVGSADSEGIRKGAIVDIDQTVSSIRAAVDHAERMVGLQISEVYVGITGNHIALQTSHGVVAVSNEDREIGEEDIERVNQAARVIALPPEREIIGIVPKQYIVDGQEGIQDPRGMIGVRLEVEATIITGAKTGIHNLLRVVEKSGLKVSGLILMSLAAGQLALSKDEKQIGTVLVDVGAGTTTISVFDQGSLVATSTLPIGGDFITTDISIGLRTQMDIAEKIKLKFGCASIADSAPDQMFKVNRIGSNVDKEFSQVDLANIVEPRVQEIFQLIRGEVHRMGYSDLAGGYVLTGGTVNLPATLVIAQEELAATVRIATPDYIGVRDPAYTSGVGIIQFVIKYIRNRPASLNKKQPIKAAASKSGSQEKEGEGFFDRVKNFLKEFI

SEQ ID NO: 225 - protein, 373 aa, Geobacillus thermoleovorans
MSSNEIVVSLDVGTSSVKVIIGEMLGSSINIIGVGNVKAEGLKKGAIVDIDKTVQSIRRAVEQAERMVGLSIRRVIVGVAGSHIQLHDCHGIVAVASENREISDEDVARVIDAAQVVSIPPDREIIGVVPRQFIVDGLDGIHDPRGMLGVRLEMEGTMVTGAKTVLHNLLRCVERAGLEISDICLQPLAAGSLVLSDDERHLGAALVDLGGGSTTVAVFEQGTLQAVSSLPVGGEHITKDLAIGLRTTTDDAEKIKLKHGHAFYDYASEEEVFSVPIMGTDQHQQFSQLEIADIIEARLEEILQMVQQEVRRLGFRDLPGGYVLTGGVANMPGLLELAHVVLGTSVRIAMPDYIGVRDPQYTIGVGLLKFAYR

SEQ ID NO: 226 - protein, 373 aa, Geobacillus kaustophilus HTA426; identical to SEQ ID NO: 225

SEQ ID NO: 227 - protein, 373 aa, Geobacillus thermodenitrificans NG80-2
MSSNEIVVSLDVGTSSIKVIIGEMLGSSINIIGVGNVKSEGLKKGAIVDIDKTVHSIKRAVEQAERMVGLSIRRVIVGVAGSHVQLQDCHGIVAVASENREISDEDVARVIDAAQVVSIPPDREIIGIVPRQFIVDGLDGIHDPRGMLGVRLEMEGTMITGAKTILHNLLRCVERAGLEISDICLQPLAAGSLALSDDERHLGVALVDLGGGSTTVAVFEQGGLQAVSSLPVGGEHITKDLAIGLRTTTEDAEKIKLKHGHAFYDYASEEEVFTVPIMGTDQHQQFSQLEIADIIEARLEEILQMVQHEVRRLGFRDLPGGYVLTGGVANMPGVLELAHVVLGTSVRVALPDYIGVRDPQYTIGVGLLKFAYR

SEQ ID NO: 228 - protein, 424 aa, Bacillus halodurans C-125
MNNNEIYVSLDIGTSNVRIIIGEITDGSINIIGVGNAPSEGIKKGSIVDIDETVRSIRRAVEQAERMVGLSIRQVIVGVNGNHVQLQPCHGVVAVSSPDREIGDEDIARVIDAAQVVSIPPEREIIDVIPKQFIVDGLDEINDPRGMIGVRLEMEGTIITGSKTLLHNLLRCVERAGLEVADICLQALAAGSVAISKDEKSLGVCLIDIGGGSMTISCFEQGSLVDTSVIPVGGDHVTNDIAVGLRISTEEAIKIKHTHGHAYIDEASEEDRFEVKAIGSTEPEAFSQFELAHIIEPRMEEMFELINRELRRLGQHDFPGGFVLTGGSVMMPGVLELAKETLGRNVRVAIPDYIGVREPQYTTGVGLIQFAYKNVKIQGKEVAAAVAEAGVEQEQRPKKEKERSRTNEGPGVKSKVKNWFKVFL

SEQ ID NO: 229 - protein, 411 aa, Artificial
  Substituion in SEQ ID NO 222
MAKEDYIVSLDIGTSKVRVIIGESTGNNLNIIGVGSASSQGLRHGAIVDIDKTVDSIREAVDHAERMVGIRIPSAYVGISGEHIQLHSSHGVVAVSSADREITDEDIERVLQQARVVALPPEREVIDVVAKEFVVDGLRGIMDPRGMLGVRLEVDAYLITGSRTAIHNIVRCVERAGLEVANLVLAPMAASQIALTQDERKLGVALVDVGAGVTSVSVFANGVLMGTSIIPIGGDYVTQDIAIGLRTNTVAAEQVKLRHACAMVEQASEHETFRVPRMGSNKEAEFTQYDLATIIEPRMQEIFGLVRKEVEKMGYADELPAGYVFHGGVMSTPSAAELAGEELQAPVRIAVPEFLGVRDPSFVNGVGMIIYAARTGLRPSSADYNAGARQVRSSNHVGVFARIKDWLRDFV

SEQ ID NO: 230 - protein, 411 aa, Artificial
  Substituion in SEQ ID NO 222
MAKEDYIVSLDIGTSKVRVIIGESTGNNLNIIGVGSASSQGLRHGAIVDIDKTVDSIREAVDHAERMVGIRIPSAYVGISGEHIQLHSSHGVVAVSSADREITDEDIERVLQQARVVALPPEREVIDVVAKEFVVDGLRGIMDPRGMLGVRLEVDAYLITGSRTAIHNIVRCVERAGLEVANLVLAPMAASQIALTQDERKLGVALVDVGAGVTSVSVFANGVLMGTSIIPIGGDYVTQDIAIGLRTNTVAAEQVKLRHACAMVEQASEHETFRVPRMGSNKEAEFTQYDLATIIEPRMQEIFGLVRKEVEKMGYADELPAGYVFHGGVMSTPSAAELAGEELQAPVRIAVPEFLGVRDPSFVNGVGMIVYAARTGLRPSSADYNAGARQVRSSQHVGVFARIKDWLRDFV

SEQ ID NO: 231 - protein, 411 aa, Artificial
  Substituion in SEQ ID NO 222
MAKEDYIVSLDIGTSKVRVIIGESTGNNLNIIGVGSASSQGLRHGAIVDIDKTVDSIREAVDHAERMVGIRIPSAYVGISGEHIQLHSSHGVVAVSSADREITDEDIERVLQQARVVALPPEREVIDIVAKEFVVDGLRGIMDPRGMLGVRLEVDAYLITGSRTAIHNIVRCVERAGLEVANLVLAPMAASQIALTQDERKLGVALVDVGAGVTSVSVFANGVLMGTSIIPIGGDYVTQDIAIGLRTNTVAAEQVKLRHACAMVEQASEHETFRVPRMGSNKEAEFTQYDLATIIEPRMQEIFGLVRKEVEKMGYADELPAGYVFHGGVMSTPSAAELAGEELQAPVRIAVPEFLGVRDPSFVNGVGMIVYAARTGLRPSSADYNAGARQVRSSNHVGVFARIKDWLRDFV

SEQ ID NO: 232 - protein, 411 aa, Artificial
  Substituion in SEQ ID NO 222
MAKEDYIVSLDIGTSKVRVIIGESTGNQLNIIGVGSASSQGLRHGAIVDIDKTVDSIREAVDHAERMVGIRIPSAYVGISGEHIQLHSSHGVVAVSSADREITDEDIERVLQQARVVALPPEREVIDVVAKEFVVDGLRGIMDPRGMLGVRLEVDAYLITGSRTAIHNIVRCVERAGLEVANLVLAPMAASQIALTQDERKLGVALVDVGAGVTSVSVFANGVLMGTSIIPIGGDYVTQDIAIGLRTNTVAAEQVKLRHACAMVEQASEHETFRVPRMGSNKEAEFTQYDLATIIEPRMQEIFGLVRKEVEKMGYADELPAGYVFHGGVMSTPSAAELAGEELQAPVRIAVPEFLGVRDPSFVNGVGMIVYAARTGLRPSSADYNAGARQVRSSNHVGVFARIKDWLRDFV

SEQ ID NO: 233 - protein, 411 aa, Artificial
  Substituion in SEQ ID NO 222
MAKEDYIVSLDIGTSKVRVIIGESTGNNLNIIGVGSASSQGLRHGAIVDIDRTVDSIREAVDHAERMVGIRIPSAYVGISGEHIQLHSSHGVVAVSSADREITDEDIERVLQQARVVALPPEREVIDVVAKEFVVDGLRGIMDPRGMLGVRLEVDAYLITGSRTAIHNIVRCVERAGLEVANLVLAPMAASQIALTQDERKLGVALVDVGAGVTSVSVFANGVLMGTSIIPIGGDYVTQDIAIGLRTNTVAAEQVKLRHACAMVEQASEHETFRVPRMGSNKEAEFTQYDLATIIEPRMQEIFGLVRKEVEKMGYADELPAGYVFHGGVMSTPSAAELAGEELQAPVRIAVPEFLGVRDPSFVNGVGMIVYAARTGLRPSSADYNAGARQVRSSNHVGVFARIKDWLRDFV

SEQ ID NO: 234 - DNA, 1236 bp, Artificial
  Substituion in SEQ ID NO 223
ttggccaaggaggactacatcgtcagtctcgacatcggcacttcgaaggtgcgagtcatcatcggagagtcgaccggaaacaacttgaacatcattggagtgggctccgcctcgagtcaaggactgcgccacggtgcgattgtcgatattgacaaaacggttgattcaatccgcgaagcggtcgatcacgccgagcgcatggtgggcattcgcatcccatccgcgtacgtgggcatttcgggggagcacattcaactgcacagctctcacggggtggtcgcggtgtcttcggcggaccgcgagatcacggatgaagatattgaacgcgttttgcagcaagcgcgagtcgtggcgctgcctccggaacgcgaggtcattgacgtggttgccaaggagtttgtcgtcgacggcctgcgcgggatcatggatccgcgcgggatgctcggcgtgcggctggaggtggatgcgtacctcatcaccggaagccgcaccgccattcacaacattgtccgatgtgtggagcgcgcgggactggaagtggcgaatctcgtgctcgcgcccatggccgcgagccaaatcgcgctcacccaggacgaacgcaagttgggcgtcgccttggtggacgtgggcgcgggcgtgacgtcggtcagcgtgttcgccaacggcgttctgatggggacgagcatcatccccattggcggcgactacgtgacgcaggacatcgccatcgggttgcgcaccaacacggtcgcggctgaacaagtgaaactccgtcacgcctgcgcgatggtggagcaggcgtccgagcacgagacctttcgggtaccccgaatggggagcaacaaggaggccgagttcacgcagtacgatctcgccaccatcatcgagcctcgcatgcaggagatattcggcttagtgcgaaaagaagtagaaaagatgggctatgccgacgagctgcccgcgggttacgtgtttcacggcggcgtcatgtcgacgccttccgcggccgagttggcgggagaagaactgcaggcgcctgtgcgcatcgccgttccagagttcctcggggtgcgcgatccgtcattcgtcaacggggtcggcatgattatttatgccgcgcgcacggggcttcgaccaagctcggcggattacaacgctggcgctcgtcaggttcgttcgtccaatcacgtcggcgtatttgcacgaatcaaagattggctgcgcgatttcgtgtga

SEQ ID NO: 235 - DNA, 1236 bp, Artificial
  Substituion in SEQ ID NO 223
ttggccaaggaggactacatcgtcagtctcgacatcggcacttcgaaggtgcgagtcatcatcggagagtcgaccggaaacaacttgaacatcattggagtgggctccgcctcgagtcaaggactgcgccacggtgcgattgtcgatattgacaaaacggttgattcaatccgcgaagcggtcgatcacgccgagcgcatggtgggcattcgcatcccatccgcgtacgtgggcatttcgggggagcacattcaactgcacagctctcacggggtggtcgcggtgtcttcggcggaccgcgagatcacggatgaagatattgaacgcgttttgcagcaagcgcgagtcgtggcgctgcctccggaacgcgaggtcattgacgtggttgccaaggagtttgtcgtcgacggcctgcgcgggatcatggatccgcgcgggatgctcggcgtgcggctggaggtggatgcgtacctcatcaccggaagccgcaccgccattcacaacattgtccgatgtgtggagcgcgcgggactggaagtggcgaatctcgtgctcgcgcccatggccgcgagccaaatcgcgctcacccaggacgaacgcaagttgggcgtcgccttggtggacgtgggcgcgggcgtgacgtcggtcagcgtgttcgccaacggcgttctgatggggacgagcatcatccccattggcggcgactacgtgacgcaggacatcgccatcgggttgcgcaccaacacggtcgcggctgaacaagtgaaactccgtcacgcctgcgcgatggtggagcaggcgtccgagcacgagacctttcgggtaccccgaatggggagcaacaaggaggccgagttcacgcagtacgatctcgccaccatcatcgagcctcgcatgcaggagatattcggcttagtgcgaaaagaagtagaaaagatgggctatgccgacgagctgcccgcgggttacgtgtttcacggcggcgtcatgtcgacgccttccgcggccgagttggcgggagaagaactgcaggcgcctgtgcgcatcgccgttccagagttcctcggggtgcgcgatccgtcattcgtcaacggggtcggcatgattgtgtatgccgcgcgcacggggcttcgaccaagctcggcggattacaacgctggcgctcgtcaggttcgttcgtcccaacacgtcggcgtatttgcacgaatcaaagattggctgcgcgatttcgtgtga

SEQ ID NO: 236 - DNA, 1236 bp, Artificial
  Substituion in SEQ ID NO 223
ttggccaaggaggactacatcgtcagtctcgacatcggcacttcgaaggtgcgagtcatcatcggagagtcgaccggaaacaacttgaacatcattggagtgggctccgcctcgagtcaaggactgcgccacggtgcgattgtcgatattgacaaaacggttgattcaatccgcgaagcggtcgatcacgccgagcgcatggtgggcattcgcatcccatccgcgtacgtgggcatttcgggggagcacattcaactgcacagctctcacggggtggtcgcggtgtcttcggcggaccgcgagatcacggatgaagatattgaacgcgttttgcagcaagcgcgagtcgtggcgctgcctccggaacgcgaggtcattgacattgttgccaaggagtttgtcgtcgacggcctgcgcgggatcatggatccgcgcgggatgctcggcgtgcggctggaggtggatgcgtacctcatcaccggaagccgcaccgccattcacaacattgtccgatgtgtggagcgcgcgggactggaagtggcgaatctcgtgctcgcgcccatggccgcgagccaaatcgcgctcacccaggacgaacgcaagttgggcgtcgccttggtggacgtgggcgcgggcgtgacgtcggtcagcgtgttcgccaacggcgttctgatggggacgagcatcatccccattggcggcgactacgtgacgcaggacatcgccatcgggttgcgcaccaacacggtcgcggctgaacaagtgaaactccgtcacgcctgcgcgatggtggagcaggcgtccgagcacgagacctttcgggtaccccgaatggggagcaacaaggaggccgagttcacgcagtacgatctcgccaccatcatcgagcctcgcatgcaggagatattcggcttagtgcgaaaagaagtagaaaagatgggctatgccgacgagctgcccgcgggttacgtgtttcacggcggcgtcatgtcgacgccttccgcggccgagttggcgggagaagaactgcaggcgcctgtgcgcatcgccgttccagagttcctcggggtgcgcgatccgtcattcgtcaacggggtcggcatgattgtgtatgccgcgcgcacggggcttcgaccaagctcggcggattacaacgctggcgctcgtcaggttcgttcgtccaatcacgtcggcgtatttgcacgaatcaaagattggctgcgcgatttcgtgtga

SEQ ID NO: 237 - DNA, 1236 bp, Artificial
  Substituion in SEQ ID NO 223
ttggccaaggaggactacatcgtcagtctcgacatcggcacttcgaaggtgcgagtcatcatcggagagtcgaccggaaaccaattgaacatcattggagtgggctccgcctcgagtcaaggactgcgccacggtgcgattgtcgatattgacaaaacggttgattcaatccgcgaagcggtcgatcacgccgagcgcatggtgggcattcgcatcccatccgcgtacgtgggcatttcgggggagcacattcaactgcacagctctcacggggtggtcgcggtgtcttcggcggaccgcgagatcacggatgaagatattgaacgcgttttgcagcaagcgcgagtcgtggcgctgcctccggaacgcgaggtcattgacgtggttgccaaggagtttgtcgtcgacggcctgcgcgggatcatggatccgcgcgggatgctcggcgtgcggctggaggtggatgcgtacctcatcaccggaagccgcaccgccattcacaacattgtccgatgtgtggagcgcgcgggactggaagtggcgaatctcgtgctcgcgcccatggccgcgagccaaatcgcgctcacccaggacgaacgcaagttgggcgtcgccttggtggacgtgggcgcgggcgtgacgtcggtcagcgtgttcgccaacggcgttctgatggggacgagcatcatccccattggcggcgactacgtgacgcaggacatcgccatcgggttgcgcaccaacacggtcgcggctgaacaagtgaaactccgtcacgcctgcgcgatggtggagcaggcgtccgagcacgagacctttcgggtaccccgaatggggagcaacaaggaggccgagttcacgcagtacgatctcgccaccatcatcgagcctcgcatgcaggagatattcggcttagtgcgaaaagaagtagaaaagatgggctatgccgacgagctgcccgcgggttacgtgtttcacggcggcgtcatgtcgacgccttccgcggccgagttggcgggagaagaactgcaggcgcctgtgcgcatcgccgttccagagttcctcggggtgcgcgatccgtcattcgtcaacggggtcggcatgattgtgtatgccgcgcgcacggggcttcgaccaagctcggcggattacaacgctggcgctcgtcaggttcgttcgtccaatcacgtcggcgtatttgcacgaatcaaagattggctgcgcgatttcgtgtga

SEQ ID NO: 238 - DNA, 1236 bp, Artificial
  Substituion in SEQ ID NO 223
ttggccaaggaggactacatcgtcagtctcgacatcggcacttcgaaggtgcgagtcatcatcggagagtcgaccggaaacaacttgaacatcattggagtgggctccgcctcgagtcaaggactgcgccacggtgcgattgtcgatattgaccgtacggttgattcaatccgcgaagcggtcgatcacgccgagcgcatggtgggcattcgcatcccatccgcgtacgtgggcatttcgggggagcacattcaactgcacagctctcacggggtggtcgcggtgtcttcggcggaccgcgagatcacggatgaagatattgaacgcgttttgcagcaagcgcgagtcgtggcgctgcctccggaacgcgaggtcattgacgtggttgccaaggagtttgtcgtcgacggcctgcgcgggatcatggatccgcgcgggatgctcggcgtgcggctggaggtggatgcgtacctcatcaccggaagccgcaccgccattcacaacattgtccgatgtgtggagcgcgcgggactggaagtggcgaatctcgtgctcgcgcccatggccgcgagccaaatcgcgctcacccaggacgaacgcaagttgggcgtcgccttggtggacgtgggcgcgggcgtgacgtcggtcagcgtgttcgccaacggcgttctgatggggacgagcatcatccccattggcggcgactacgtgacgcaggacatcgccatcgggttgcgcaccaacacggtcgcggctgaacaagtgaaactccgtcacgcctgcgcgatggtggagcaggcgtccgagcacgagacctttcgggtaccccgaatggggagcaacaaggaggccgagttcacgcagtacgatctcgccaccatcatcgagcctcgcatgcaggagatattcggcttagtgcgaaaagaagtagaaaagatgggctatgccgacgagctgcccgcgggttacgtgtttcacggcggcgtcatgtcgacgccttccgcggccgagttggcgggagaagaactgcaggcgcctgtgcgcatcgccgttccagagttcctcggggtgcgcgatccgtcattcgtcaacggggtcggcatgattgtgtatgccgcgcgcacggggcttcgaccaagctcggcggattacaacgctggcgctcgtcaggttcgttcgtccaatcacgtcggcgtatttgcacgaatcaaagattggctgcgcgatttcgtgtga

SEQ ID NO: 239 - protein, 405 aa, Alicyclobacillus acidocaldarius
MCARTCALTPYCRRGSAEPNRLGGPTVLEFDFETDSLANIKVIGVGGGGCNAVNRMIESGVKGVEFIVVNTDAQALKLSKAETKLQIGEKLTRGLGAGANPEIGKKAAEESREMLANALKGADMVFVTAGMGGGTGTGAAPVIAEIAKELGALTVGVVTKPFRFEQRRRMIQAEQGVNELKQKVDTLIVIPNDRLLEIVDRNTPVLEAFREADNVLRQGVSGISDLIATPALINVDFADVKAIMTERGSALMGIGIASGENRAAEAAKKAISSPLLETSIDGARGILMHVAGGTNLSLWEVNEAADIVSMTADPDVNMIFGAAIDPNLEDEIVVTVIATGFDGSNQQQQARQNHLHHEPHDNVVRGTVQRHPSAQDPVINVPNTGNPWEIPAFMRRQNSRFGRDR

SEQ ID NO: 240 - DNA, 1218 bp, Alicyclobacillus acidocaldarius
gtgtgtgcgcgcacgtgcgcgctgacaccatactgtcgcaggggaagtgcggagccaaatagattaggaggacccacagtgctggaattcgattttgaaactgattcccttgccaatattaaggtgatcggcgtcggcggcggcgggtgcaatgcggtgaaccggatgatcgaatcgggcgtcaagggcgtggagtttattgtcgtgaacacggatgcccaggcgctcaagctgtcgaaggccgagacgaagcttcagattggcgaaaagttgacccgcggcttgggcgcgggcgcgaatcccgagattggcaagaaggcggcggaagagagccgtgaaatgctggccaacgcgctcaaaggcgccgacatggtgtttgtcacggctgggatgggcggcggcacggggacgggcgccgcgccggtcatcgccgagatcgcgaaggaactcggcgcgctcacggtgggcgtcgtcacgaagccgttccgctttgagcagcgccgccgcatgattcaggccgagcaaggcgtcaacgagctgaagcagaaggtcgacacgctgatcgtgatcccgaacgaccggcttctcgagatcgtggaccgcaacacgcctgtcctggaggcgttccgagaggcggacaacgtcctgcggcagggcgtgtcgggcatttcggatctcatcgcgacgcccgccctcatcaacgtggacttcgcggacgtcaaggctatcatgacggagcgcggctccgccctcatgggcatcggcatcgcctctggcgaaaaccgggccgcggaggccgcgaagaaggccatctcgtctccgctcctggaaacgtccatcgacggcgctcgcggcatcctcatgcacgtcgcgggcgggacgaatctcagcctctgggaggtcaacgaggccgcggatatcgtctcgatgaccgcggatccggatgtcaacatgatcttcggtgcggccatcgatccgaatctggaagacgagattgtcgtcaccgtgattgcgacgggattcgatggttccaatcaacagcagcaggcgcggcagaatcacctgcaccacgagccgcacgacaacgtggtgcgagggaccgtgcagcgccatccgtcggcgcaggacccggtcatcaatgtgccgaacacggggaatccgtgggagattccggcgttcatgcgccgccagaacagcaggtttgggcgcgaccgctga

SEQ ID NO: 241 - protein, 377 aa, Bacillus licheniformis ATCC 14580
MLEFETNIDGLASIKVIGVGGGGNNAVNRMIENDVQGVEFIAVNTDAQALNLSKAETKMQIGAKLTRGLGAGANPEVGKKAAEESKEQIEEALKGADMVFVTAGMGGGTGTGAAPVIAQIAKDLGALTVGVVTRPFTFEGRKRQLQAAGGISAMKEAVDTLIVIPNDRLLEIVDKNTPMLEAFREADNVLRQGVQGISDLIATPGLINLDFADVKTIMSNKGSALMGIGVATGENRAAEAAKKAVSSPLLETAIDGAQGVLMNITGGTNLSLYEVQEAADIVAAASDQDVNMIFGSVINENLKDEIVVTVIATGFIEQDQDSSKPQRPLNQGLKQHHQPAPKREPKREEPSMPHRSPSQPAEDTLDIPTFLRNRNKR

SEQ ID NO: 242 - protein, 384 aa, Bacillus cereus subsp. cytotoxis NVH 391-98
MLEFDTTQDQLANIKVIGVGGGGNNAVNRMIEHGVQGVDFIAVNTDAQALNLSKAETKMQIGEKLTRGLGAGANPEVGKKAAEESKEQIQEALRGADMVFVTAGMGGGTGTGAAPVVAQVAKELGALTVGVVTRPFTFEGRKRATQAASGIAAFKENVDTLIVIPNDRLLEIVDKNTPMLEAFREADNVLRQGVQGISDLIATPGLINLDFADVKTIMSNRGSALMGIGSGNGENRAAEAAKKAISSPLLETSIDGAQGVIMNITGGANLSLYEVQEAADIVASASDPEVNMIFGSVINEGLKDDIVVTVIATGFDDSIVAQQQKTLVRPKINSSHVQQQAAVQPPKHREVKREVKREEPVIHDRNTDADDIDIPAFLRNRRRR

SEQ ID NO: 243 - protein, 374 aa, Bacillus selenitireducens MLS10
MLEFEMDTDQLATIKVIGVGGGGSNAVNRMIENGLQGVEFIAVNTDAQALQLSKAEHKLQLGGKLTRGLGAGANPDIGKKAAEESRDQLEEYLTGADMVFITAGMGGGTGTGAAPVIAEIAKEAGALTVGVVTKPFTFEGRRRMNQAQTGISDLKEKVDTLIVIPNDRLMEIVDKNTPMIEAFREADNVLRQGVQGISDLIAVPGLINLDFADVKTIMSEKGSALMGIGIATGESRAAEAAKKAISSPLLETSVDGAQGVLMNITGGTNLSLFEVHEAAEIVSSASDEEVNMIFGSVINDNLKDEIIVTVIATGFDEASQQKAQPKRSKPNAQKSGRQEQKDQPQQKAAEVEETSQEEIDTLDIPTFLRNRRQR

SEQ ID NO: 244 - protein, 384 aa, Bacillus weihenstephanensis KBAB4
MLEFDTTQDQLANIKVIGVGGGGNNAVNRMIEHGVQGVDFIAVNTDAQALNLSKAETKMQIGGKLTRGLGAGANPEVGKKAAEESKEQIQEALRGADMVFVTAGMGGGTGTGAAPVVAQVAKELGALTVGVVTRPFTFEGRKRATQAASGIASFKENVDTLIVIPNDRLLEIVDKNTPMLEAFREADNVLRQGVQGISDLIATPGLINLDFADVKTIMSNRGSALMGIGSGNGENRAAEAAKKAISSPLLETSIDGAQGVIMNITGGANLSLYEVQEAADIVASASDPEVNMIFGSVINEGLKDDIVVTVIATGFDDSASTQPPKPIIRPTANHTQQQQQPVAQPSKQREVKREMKREEPVVHDRHTDSDDIDIPAFLRNRRRR

SEQ ID NO: 245 - protein, 384 aa, Bacillus mycoides
MLEFDTTQDQLANIKVIGVGGGGNNAVNRMIEHGVQGVDFIAVNTDAQALNLSKAETKMQIGGKLTRGLGAGANPEVGKKAAEESKEQIQEALRGADMVFVTAGMGGGTGTGAAPVVAQVAKELGALTVGVVTRPFTFEGRKRATQAASGIAAFKENVDTLIVIPNDRLLEIVDKNTPMLEAFREADNVLRQGVQGISDLIATPGLINLDFADVKTIMSNRGSALMGIGSGNGENRAAEAAKKAISSPLLETSIDGAQGVIMNITGGANLSLYEVQEAADIVASASDPEVNMIFGSVINEGLKDDIVVTVIATGFDDSAATQPPKPIIRPTANHTQQQQQPVAQPTKQREVKREMKREEPVVHDRHTDSDDIDIPAFLRNRRRR

SEQ ID NO: 246 - protein, 405 aa, Artificial
  Substituion in SEQ ID NO 239
MCARTCALTPYCRRGSAEPNRLGGPTVLEFDFETDSLANIKVIGVGGGGCNAVNRMIESGVKGVEFIVVNTDAQALKLSKAETKLQIGEKLTRGLGAGANPEIGKKAAEESREMLANALKGADMVFVTAGMGGGTGTGAAPVIAEIAKELGALTVGVVTKPFRFEQRRRMIQAEQGVNELKQKVDTLIVIPNDRLLEIVDRNTPVLEAFREADNVLRQGVSGISDLIATPALINVDFADVKAIMTERGSALMGIGIASGENRAAEAAKKAISSPLLETSIDGARGILMHVAGGTNLSLWEVNEAADIVSMTADPDVNMIFGAAIDPNLEDEIVVTVIATGFDGSNQQQQARQNHLHHEPHDNVVRGTVQRHPSAQDPVINVPNTGNPWEIPAFMRRQNSRFGRER

SEQ ID NO: 247 - protein, 405 aa, Artificial
  Substituion in SEQ ID NO 239
MCARTCALTPYCRRGSAEPNRLGGPTVLEFDFETDSLANIKVIGVGGGGCNAVNRMIESGVKGVEFIVVNTDAQALKLSKAETKLQIGEKLTRGLGAGANPEIGKKAAEESREMLANALKGADMVFVTAGMGGGTGTGAAPVIAEIAKELGALTVGVVTKPFRFEQRRRMIQAEQGVNELKNKVDTLIVIPNDRLLEIVDRNTPVLEAFREADNVLRQGVSGISDLIATPALINVDFADVKAIMTERGSALMGIGIASGENRAAEAAKKAISSPLLETSIDGARGILMHVAGGTNLSLWEVNEAADIVSMTADPDVNMIFGAAIDPNLEDEIVVTVIATGFDGSNQQQQARQNHLHHEPHDNVVRGTVQRHPSAQDPVINVPNTGNPWEIPAFMRRQNSRFGRDR

SEQ ID NO: 248 - protein, 405 aa, Artificial
  Substituion in SEQ ID NO 239
MCARTCALTPYCRRGSAEPNRLGGPTVLEFDFETDSLANIKVIGVGGGGCNAVNRMIESGVKGVEFIVVNTDAQALKLSKAETKLQIGEKLTRGLGAGANPEIGKKAAEESREMLANALKGADMVFVTAGMGGGTGTGAAPVIAEIAKELGALTVGVVTKPFRFEQRRRMIQAEQGVNELKQKVDTLIVIPNDRLLEIVDRNTPILEAFREADNVLRQGVSGISDLIATPALINVDFADVKAIMTERGSALMGIGIASGENRAAEAAKKAISSPLLETSIDGARGILMHVAGGTNLSLWEVNEAADIVSMTADPDVNMIFGAAIDPNLEDEIVVTVIATGFDGSNQQQQARQNHLHHEPHDNVVRGTVQRHPSAQDPVINVPNTGNPWEIPAFMRRQNSRFGRDR

SEQ ID NO: 249 - protein, 405 aa, Artificial
  Substituion in SEQ ID NO 239
MCARTCALTPYCRRGSAEPNRLGGPTVLEFDFETDSLANIKVIGVGGGGCNAVNRMIESGVKGVEFIVVNTDAQALKLSKAETKLQIGEKLTRGLGAGANPEIGKKAAEESREMLANALKGADMVFVTAGMGGGTGTGAAPVIAEIAKELGALTVGVVTKPFRFEQRRRMIQAEQGVQELKQKVDTLIVIPNDRLLEIVDRNTPVLEAFREADNVLRQGVSGISDLIATPALINVDFADVKAIMTERGSALMGIGIASGENRAAEAAKKAISSPLLETSIDGARGILMHVAGGTNLSLWEVNEAADIVSMTADPDVNMIFGAAIDPNLEDEIVVTVIATGFDGSNQQQQARQNHLHHEPHDNVVRGTVQRHPSAQDPVINVPNTGNPWEIPAFMRRQNSRFGRDR

SEQ ID NO: 250 - protein, 405 aa, Artificial
  Substituion in SEQ ID NO 239
MCARTCALTPYCRRGSAEPNRLGGPTVLEFDFETDSLANIKVIGVGGGGCNAVNRMIESGVKGVEFIVVNTDAQALKLSKAETKLQIGEKLTRGLGAGANPEIGKKAAEESREMLANALKGADMVFVTAGMGGGTGTGAAPVIAEIAKELGALTVGVVTKPFRFEQRRRMIQAEQGVNELKQKVDTLIVIPNDRLLEIVDRNTPVLEAFREADNVLRQGVSGISDLIATPALINVDFADVKAIMTERGSALMGIGIASGENRAAEAAKKAISSPLLETSIDGARGILMHVAGGTNLSLWEVNEAADIVSMTADPDVNMIFGAAIDPNLEDEIVVTVIATGFDGSNQQQQARQNHLHHEPHDNIVRGTVQRHPSAQDPVINVPNTGNPWEIPAFMRRQNSRFGRDR

SEQ ID NO: 251 - DNA, 1218 bp, Artificial
  Substituion in SEQ ID NO 240
gtgtgtgcgcgcacgtgcgcgctgacaccatactgtcgcaggggaagtgcggagccaaatagattaggaggacccacagtgctggaattcgattttgaaactgattcccttgccaatattaaggtgatcggcgtcggcggcggcgggtgcaatgcggtgaaccggatgatcgaatcgggcgtcaagggcgtggagtttattgtcgtgaacacggatgcccaggcgctcaagctgtcgaaggccgagacgaagcttcagattggcgaaaagttgacccgcggcttgggcgcgggcgcgaatcccgagattggcaagaaggcggcggaagagagccgtgaaatgctggccaacgcgctcaaaggcgccgacatggtgtttgtcacggctgggatgggcggcggcacggggacgggcgccgcgccggtcatcgccgagatcgcgaaggaactcggcgcgctcacggtgggcgtcgtcacgaagccgttccgctttgagcagcgccgccgcatgattcaggccgagcaaggcgtcaacgagctgaagcagaaggtcgacacgctgatcgtgatcccgaacgaccggcttctcgagatcgtggaccgcaacacgcctgtcctggaggcgttccgagaggcggacaacgtcctgcggcagggcgtgtcgggcatttcggatctcatcgcgacgcccgccctcatcaacgtggacttcgcggacgtcaaggctatcatgacggagcgcggctccgccctcatgggcatcggcatcgcctctggcgaaaaccgggccgcggaggccgcgaagaaggccatctcgtctccgctcctggaaacgtccatcgacggcgctcgcggcatcctcatgcacgtcgcgggcgggacgaatctcagcctctgggaggtcaacgaggccgcggatatcgtctcgatgaccgcggatccggatgtcaacatgatcttcggtgcggccatcgatccgaatctggaagacgagattgtcgtcaccgtgattgcgacgggattcgatggttccaatcaacagcagcaggcgcggcagaatcacctgcaccacgagccgcacgacaacgtggtgcgagggaccgtgcagcgccatccgtcggcgcaggacccggtcatcaatgtgccgaacacggggaatccgtgggagattccggcgttcatgcgccgccagaacagcaggtttgggcgcgaacgctga

SEQ ID NO: 252 - DNA, 1218 bp, Artificial
  Substituion in SEQ ID NO 240
gtgtgtgcgcgcacgtgcgcgctgacaccatactgtcgcaggggaagtgcggagccaaatagattaggaggacccacagtgctggaattcgattttgaaactgattcccttgccaatattaaggtgatcggcgtcggcggcggcgggtgcaatgcggtgaaccggatgatcgaatcgggcgtcaagggcgtggagtttattgtcgtgaacacggatgcccaggcgctcaagctgtcgaaggccgagacgaagcttcagattggcgaaaagttgacccgcggcttgggcgcgggcgcgaatcccgagattggcaagaaggcggcggaagagagccgtgaaatgctggccaacgcgctcaaaggcgccgacatggtgtttgtcacggctgggatgggcggcggcacggggacgggcgccgcgccggtcatcgccgagatcgcgaaggaactcggcgcgctcacggtgggcgtcgtcacgaagccgttccgctttgagcagcgccgccgcatgattcaggccgagcaaggcgtcaacgagctgaagaataaggtcgacacgctgatcgtgatcccgaacgaccggcttctcgagatcgtggaccgcaacacgcctgtcctggaggcgttccgagaggcggacaacgtcctgcggcagggcgtgtcgggcatttcggatctcatcgcgacgcccgccctcatcaacgtggacttcgcggacgtcaaggctatcatgacggagcgcggctccgccctcatgggcatcggcatcgcctctggcgaaaaccgggccgcggaggccgcgaagaaggccatctcgtctccgctcctggaaacgtccatcgacggcgctcgcggcatcctcatgcacgtcgcgggcgggacgaatctcagcctctgggaggtcaacgaggccgcggatatcgtctcgatgaccgcggatccggatgtcaacatgatcttcggtgcggccatcgatccgaatctggaagacgagattgtcgtcaccgtgattgcgacgggattcgatggttccaatcaacagcagcaggcgcggcagaatcacctgcaccacgagccgcacgacaacgtggtgcgagggaccgtgcagcgccatccgtcggcgcaggacccggtcatcaatgtgccgaacacggggaatccgtgggagattccggcgttcatgcgccgccagaacagcaggtttgggcgcgaccgctga

SEQ ID NO: 253 - DNA, 1218 bp, Artificial
  Substituion in SEQ ID NO 240
gtgtgtgcgcgcacgtgcgcgctgacaccatactgtcgcaggggaagtgcggagccaaatagattaggaggacccacagtgctggaattcgattttgaaactgattcccttgccaatattaaggtgatcggcgtcggcggcggcgggtgcaatgcggtgaaccggatgatcgaatcgggcgtcaagggcgtggagtttattgtcgtgaacacggatgcccaggcgctcaagctgtcgaaggccgagacgaagcttcagattggcgaaaagttgacccgcggcttgggcgcgggcgcgaatcccgagattggcaagaaggcggcggaagagagccgtgaaatgctggccaacgcgctcaaaggcgccgacatggtgtttgtcacggctgggatgggcggcggcacggggacgggcgccgcgccggtcatcgccgagatcgcgaaggaactcggcgcgctcacggtgggcgtcgtcacgaagccgttccgctttgagcagcgccgccgcatgattcaggccgagcaaggcgtcaacgagctgaagcagaaggtcgacacgctgatcgtgatcccgaacgaccggcttctcgagatcgtggaccgcaacacgcctattctggaggcgttccgagaggcggacaacgtcctgcggcagggcgtgtcgggcatttcggatctcatcgcgacgcccgccctcatcaacgtggacttcgcggacgtcaaggctatcatgacggagcgcggctccgccctcatgggcatcggcatcgcctctggcgaaaaccgggccgcggaggccgcgaagaaggccatctcgtctccgctcctggaaacgtccatcgacggcgctcgcggcatcctcatgcacgtcgcgggcgggacgaatctcagcctctgggaggtcaacgaggccgcggatatcgtctcgatgaccgcggatccggatgtcaacatgatcttcggtgcggccatcgatccgaatctggaagacgagattgtcgtcaccgtgattgcgacgggattcgatggttccaatcaacagcagcaggcgcggcagaatcacctgcaccacgagccgcacgacaacgtggtgcgagggaccgtgcagcgccatccgtcggcgcaggacccggtcatcaatgtgccgaacacggggaatccgtgggagattccggcgttcatgcgccgccagaacagcaggtttgggcgcgaccgctga

SEQ ID NO: 254 - DNA, 1218 bp, Artificial
  Substituion in SEQ ID NO 240
gtgtgtgcgcgcacgtgcgcgctgacaccatactgtcgcaggggaagtgcggagccaaatagattaggaggacccacagtgctggaattcgattttgaaactgattcccttgccaatattaaggtgatcggcgtcggcggcggcgggtgcaatgcggtgaaccggatgatcgaatcgggcgtcaagggcgtggagtttattgtcgtgaacacggatgcccaggcgctcaagctgtcgaaggccgagacgaagcttcagattggcgaaaagttgacccgcggcttgggcgcgggcgcgaatcccgagattggcaagaaggcggcggaagagagccgtgaaatgctggccaacgcgctcaaaggcgccgacatggtgtttgtcacggctgggatgggcggcggcacggggacgggcgccgcgccggtcatcgccgagatcgcgaaggaactcggcgcgctcacggtgggcgtcgtcacgaagccgttccgctttgagcagcgccgccgcatgattcaggccgagcaaggcgtccaagagctgaagcagaaggtcgacacgctgatcgtgatcccgaacgaccggcttctcgagatcgtggaccgcaacacgcctgtcctggaggcgttccgagaggcggacaacgtcctgcggcagggcgtgtcgggcatttcggatctcatcgcgacgcccgccctcatcaacgtggacttcgcggacgtcaaggctatcatgacggagcgcggctccgccctcatgggcatcggcatcgcctctggcgaaaaccgggccgcggaggccgcgaagaaggccatctcgtctccgctcctggaaacgtccatcgacggcgctcgcggcatcctcatgcacgtcgcgggcgggacgaatctcagcctctgggaggtcaacgaggccgcggatatcgtctcgatgaccgcggatccggatgtcaacatgatcttcggtgcggccatcgatccgaatctggaagacgagattgtcgtcaccgtgattgcgacgggattcgatggttccaatcaacagcagcaggcgcggcagaatcacctgcaccacgagccgcacgacaacgtggtgcgagggaccgtgcagcgccatccgtcggcgcaggacccggtcatcaatgtgccgaacacggggaatccgtgggagattccggcgttcatgcgccgccagaacagcaggtttgggcgcgaccgctga

SEQ ID NO: 255 - DNA, 1218 bp, Artificial
  Substituion in SEQ ID NO 240
gtgtgtgcgcgcacgtgcgcgctgacaccatactgtcgcaggggaagtgcggagccaaatagattaggaggacccacagtgctggaattcgattttgaaactgattcccttgccaatattaaggtgatcggcgtcggcggcggcgggtgcaatgcggtgaaccggatgatcgaatcgggcgtcaagggcgtggagtttattgtcgtgaacacggatgcccaggcgctcaagctgtcgaaggccgagacgaagcttcagattggcgaaaagttgacccgcggcttgggcgcgggcgcgaatcccgagattggcaagaaggcggcggaagagagccgtgaaatgctggccaacgcgctcaaaggcgccgacatggtgtttgtcacggctgggatgggcggcggcacggggacgggcgccgcgccggtcatcgccgagatcgcgaaggaactcggcgcgctcacggtgggcgtcgtcacgaagccgttccgctttgagcagcgccgccgcatgattcaggccgagcaaggcgtcaacgagctgaagcagaaggtcgacacgctgatcgtgatcccgaacgaccggcttctcgagatcgtggaccgcaacacgcctgtcctggaggcgttccgagaggcggacaacgtcctgcggcagggcgtgtcgggcatttcggatctcatcgcgacgcccgccctcatcaacgtggacttcgcggacgtcaaggctatcatgacggagcgcggctccgccctcatgggcatcggcatcgcctctggcgaaaaccgggccgcggaggccgcgaagaaggccatctcgtctccgctcctggaaacgtccatcgacggcgctcgcggcatcctcatgcacgtcgcgggcgggacgaatctcagcctctgggaggtcaacgaggccgcggatatcgtctcgatgaccgcggatccggatgtcaacatgatcttcggtgcggccatcgatccgaatctggaagacgagattgtcgtcaccgtgattgcgacgggattcgatggttccaatcaacagcagcaggcgcggcagaatcacctgcaccacgagccgcacgacaacattgtgcgagggaccgtgcagcgccatccgtcggcgcaggacccggtcatcaatgtgccgaacacggggaatccgtgggagattccggcgttcatgcgccgccagaacagcaggtttgggcgcgaccgctga

SEQ ID NO: 256 - protein, 249 aa, Alicyclobacillus acidocaldarius
MYAFQFLETKRRLALLRLRLLYIRLRIRLLGQPDEVYYVGGSEALPPPLTKEEEQYLLERLPSGDPSVRSMLIERNLRLVVYIARKFENTGVNIEDLVSIGTIGLIKAVNTFDPSKKIKLATYASRCIENEILMYLRRNNKLRAEVSLDEPLNVDWDGNELLLSDVLGTDSDTIYRNLEDEVDRELLYDALDKLSERERTIMELRFGLGTGQEMTQKDVADLLGISQSYISRLEKRILKRLQREFNKMM

SEQ ID NO: 257 - DNA, 750 bp, Alicyclobacillus acidocaldarius
atgtacgcgttccagtttctcgagaccaagcgccgcctcgcgctccttcggcttcgcctcctgtacatccgcctgcgaattcgcctcctgggtcagccggatgaggtttattacgtcggtggaagcgaggcgctcccgccgccgctcacgaaggaggaggagcaatatctccttgaacggcttccttcgggcgatccgtccgtgcggtcgatgctcattgagcgaaacctgcgcctcgtcgtgtacatcgcccgcaagttcgagaacacgggcgtgaacatcgaggacctggtgtccatcggcaccatcgggctcatcaaggccgtgaacacgttcgatccgtccaagaagatcaagctcgcgacgtacgcgtcccggtgcatcgagaatgagatactcatgtacctccgccgcaacaacaaacttcgcgccgaggtgtcgctggacgagccgctgaacgtggactgggatggaaacgagttgctcctgtcggacgtgctcggcacggattctgacaccatctaccggaacctcgaagatgaggtggatcgcgaactgctctacgacgccctcgacaagttgagcgaacgggagcgcaccatcatggagctgcgattcggcctggggaccggtcaggagatgacgcaaaaggacgtcgccgatcttctcgggatttcccaatcctacatatcgcgtttggagaagcgcattctgaagcggcttcagcgggagtttaacaagatgatgtga

SEQ ID NO: 258 - protein, 216 aa, Bacillus halodurans C-125
DEIYYIGGSEALPPPLSKEEEAHLLKKLPSGDKAVRSMLIERNLRLVVYIARKFENTGINIEDLISIGTIGLIKAVNTFNPEKKIKLATYASRCIENEILMYLRRNNKIRSEVSFDEPLNIDWDGNELLLSDVLGTDDDIITRGIEEKVDRKLLMKALHTLTDREKQIMELRFGLAGGEEKTQKDVADLLGISQSYISRLEKRIIKRLQKEFNKMV

SEQ ID NO: 259 - protein, 216 aa, Geobacillus kaustophilus HTA426
DEIYYIGGSEALPPPLTKEEEEQLIARLAAGDDTARSLLIERNLRLVVYIARKFENTGIHIEDLISIGTIGLIKAVNTFNPEKKIKLATYASRCIENEILMYLRRNNKVRAEVSFDEPLNIDWDGNELLLSDVLGTDDDVITKDLEADVDRRLLLNALRQLSDREKQIMELRFGLSGGEEKTQKDVADLLGISQSYISRLEKRIIKRLRKEFNKMM

SEQ ID NO: 260 - protein, 216 aa, Geobacillus thermodenitrificans NG80-2
DEIYYIGGSEALPPPLTKEEEERLIERLAVGDKTARSLLIERNLRLVVYIARKFENTGIHIEDLISIGTIGLIKAVNTFNPEKKIKLATYASRCIENEILMYLRRNNKVRAEVSFDEPLNIDWDGNELLLSDVLGTEDDVITKDLEADVDRRLLLNALRQLSDREKQIMELRFGLSGGEEKTQKDVADLLGISQSYISRLEKRIIKRLRKEFNKMM

SEQ ID NO: 261 - protein, 216 aa, Bacillus sp. SG-1
DEIYYIGGSEALPPPLSKEEEAVLLKKLPNGDKTARSLLIERNLRLVVYIARKFENTGINIEDLISIGTIGLIKAVNTFNPEKKIKLATYASRCIENEILMYLRRNNKIRSEVSFDEPLNIDWDGNELLLSDVLGTEEDIITKDLEATVDRKLLFNALTELSDREKQIMELRFGLMGGEEKTQKDVADMLGISQSYISRLEKRIIKRLKKEFNKMV

SEQ ID NO: 262 - protein, 216 aa, Bacillus sp. NRRL B-14911
DEIFYIGGSEALPPPLSKEEEEVLLIKLPKGDKAARSMLIERNLRLVVYIARKFENTGINIEDLISIGTIGLIKAVNTFNPEKKIKLATYASRCIENEILMYLRRNNKIRSEVSFDEPLNIDWDGNELLLSDVLGTEEDIITKDLEANVDKKLLLKALHQLTDREKQIMELRFGLGSGEEKTQKDVADMLGISQSYISRLEKRIIKRLKKEFNKMV

SEQ ID NO: 263 - protein, 249 aa, Artificial
  Substituion in SEQ ID NO 256
MYAFQFLETKRRLALLRLRLLYIRLRIRLLGQPDEVYYVGGSEALPPPLTKEEEQYLLERLPSGDPSVRSMLIERNLRLVVYIARKFENTGVNIEDLVSIGTIGLIKAVNTFDPSKKIKLATYASRCIENEILMYLRRNNKLRAEVSLDEPLNVDWDGNELLLSDVLGTDSDTIYRNLEDEVDKELLYDALDKLSERERTIMELRFGLGTGQEMTQKDVADLLGISQSYISRLEKRILKRLQREFNKMM

SEQ ID NO: 264 - protein, 249 aa, Artificial
  Substituion in SEQ ID NO 256
MYAFQFLETKRRLALLRLRLLYIRLRIRLLGQPDEVYYVGGSEALPPPLTKEEEQYLLERLPSGDPSVRSMLIERNLRLVVYIARKFENTGVNIEDLISIGTIGLIKAVNTFDPSKKIKLATYASRCIENEILMYLRRNNKLRAEVSLDEPLNVDWDGNELLLSDVLGTDSDTIYRNLEDEVDRELLYDALDKLSERERTIMELRFGLGTGQEMTQKDVADLLGISQSYISRLEKRILKRLQREFNKMM

SEQ ID NO: 265 - protein, 249 aa, Artificial
  Substituion in SEQ ID NO 256
MYAFQFLETKRRLALLRLRLLYIRLRIRLLGQPDEVYYVGGSEALPPPLTKEEEQYLLERLPSGDPSVRSMLIERNLRLVVYIARKFENTGVNIEDLVSIGTIGLIKAVNTFDPSKKIKLATYASRCIENEILMYLRRNNKLRAEVSLDEPLNVDWDGNELLLSDVLGTDSDTIYRNLEDEVDRELLYDALDKLSERERTIMELRFGLGTGQEMTQKDVADLLGISQSYISRLEKRILKRLNREFNKMM

SEQ ID NO: 266 - protein, 249 aa, Artificial
  Substituion in SEQ ID NO 256
MYAFQFLETKRRLALLRLRLLYIRLRIRLLGQPDEVYYVGGSEALPPPLTKEEEQYLLDRLPSGDPSVRSMLIERNLRLVVYIARKFENTGVNIEDLVSIGTIGLIKAVNTFDPSKKIKLATYASRCIENEILMYLRRNNKLRAEVSLDEPLNVDWDGNELLLSDVLGTDSDTIYRNLEDEVDRELLYDALDKLSERERTIMELRFGLGTGQEMTQKDVADLLGISQSYISRLEKRILKRLQREFNKMM

SEQ ID NO: 267 - protein, 249 aa, Artificial
  Substituion in SEQ ID NO 256
MYAFQFLETKRRLALLRIRLLYIRLRIRLLGQPDEVYYVGGSEALPPPLTKEEEQYLLERLPSGDPSVRSMLIERNLRLVVYIARKFENTGVNIEDLVSIGTIGLIKAVNTFDPSKKIKLATYASRCIENEILMYLRRNNKLRAEVSLDEPLNVDWDGNELLLSDVLGTDSDTIYRNLEDEVDRELLYDALDKLSERERTIMELRFGLGTGQEMTQKDVADLLGISQSYISRLEKRILKRLQREFNKMM

SEQ ID NO: 268 - DNA, 750 bp, Artificial
  Substituion in SEQ ID NO 257
atgtacgcgttccagtttctcgagaccaagcgccgcctcgcgctccttcggcttcgcctcctgtacatccgcctgcgaattcgcctcctgggtcagccggatgaggtttattacgtcggtggaagcgaggcgctcccgccgccgctcacgaaggaggaggagcaatatctccttgaacggcttccttcgggcgatccgtccgtgcggtcgatgctcattgagcgaaacctgcgcctcgtcgtgtacatcgcccgcaagttcgagaacacgggcgtgaacatcgaggacctggtgtccatcggcaccatcgggctcatcaaggccgtgaacacgttcgatccgtccaagaagatcaagctcgcgacgtacgcgtcccggtgcatcgagaatgagatactcatgtacctccgccgcaacaacaaacttcgcgccgaggtgtcgctggacgagccgctgaacgtggactgggatggaaacgagttgctcctgtcggacgtgctcggcacggattctgacaccatctaccggaacctcgaagatgaggtggataaagaactgctctacgacgccctcgacaagttgagcgaacgggagcgcaccatcatggagctgcgattcggcctggggaccggtcaggagatgacgcaaaaggacgtcgccgatcttctcgggatttcccaatcctacatatcgcgtttggagaagcgcattctgaagcggcttcagcgggagtttaacaagatgatgtga

SEQ ID NO: 269 - DNA, 750 bp, Artificial
  Substituion in SEQ ID NO 257
atgtacgcgttccagtttctcgagaccaagcgccgcctcgcgctccttcggcttcgcctcctgtacatccgcctgcgaattcgcctcctgggtcagccggatgaggtttattacgtcggtggaagcgaggcgctcccgccgccgctcacgaaggaggaggagcaatatctccttgaacggcttccttcgggcgatccgtccgtgcggtcgatgctcattgagcgaaacctgcgcctcgtcgtgtacatcgcccgcaagttcgagaacacgggcgtgaacatcgaggacctgatttccatcggcaccatcgggctcatcaaggccgtgaacacgttcgatccgtccaagaagatcaagctcgcgacgtacgcgtcccggtgcatcgagaatgagatactcatgtacctccgccgcaacaacaaacttcgcgccgaggtgtcgctggacgagccgctgaacgtggactgggatggaaacgagttgctcctgtcggacgtgctcggcacggattctgacaccatctaccggaacctcgaagatgaggtggatcgcgaactgctctacgacgccctcgacaagttgagcgaacgggagcgcaccatcatggagctgcgattcggcctggggaccggtcaggagatgacgcaaaaggacgtcgccgatcttctcgggatttcccaatcctacatatcgcgtttggagaagcgcattctgaagcggcttcagcgggagtttaacaagatgatgtga

SEQ ID NO: 270 - DNA, 750 bp, Artificial
  Substituion in SEQ ID NO 257
atgtacgcgttccagtttctcgagaccaagcgccgcctcgcgctccttcggcttcgcctcctgtacatccgcctgcgaattcgcctcctgggtcagccggatgaggtttattacgtcggtggaagcgaggcgctcccgccgccgctcacgaaggaggaggagcaatatctccttgaacggcttccttcgggcgatccgtccgtgcggtcgatgctcattgagcgaaacctgcgcctcgtcgtgtacatcgcccgcaagttcgagaacacgggcgtgaacatcgaggacctggtgtccatcggcaccatcgggctcatcaaggccgtgaacacgttcgatccgtccaagaagatcaagctcgcgacgtacgcgtcccggtgcatcgagaatgagatactcatgtacctccgccgcaacaacaaacttcgcgccgaggtgtcgctggacgagccgctgaacgtggactgggatggaaacgagttgctcctgtcggacgtgctcggcacggattctgacaccatctaccggaacctcgaagatgaggtggatcgcgaactgctctacgacgccctcgacaagttgagcgaacgggagcgcaccatcatggagctgcgattcggcctggggaccggtcaggagatgacgcaaaaggacgtcgccgatcttctcgggatttcccaatcctacatatcgcgtttggagaagcgcattctgaagcggcttaatcgggagtttaacaagatgatgtga

SEQ ID NO: 271 - DNA, 750 bp, Artificial
  Substituion in SEQ ID NO 257
atgtacgcgttccagtttctcgagaccaagcgccgcctcgcgctccttcggcttcgcctcctgtacatccgcctgcgaattcgcctcctgggtcagccggatgaggtttattacgtcggtggaagcgaggcgctcccgccgccgctcacgaaggaggaggagcaatatctccttgatcggcttccttcgggcgatccgtccgtgcggtcgatgctcattgagcgaaacctgcgcctcgtcgtgtacatcgcccgcaagttcgagaacacgggcgtgaacatcgaggacctggtgtccatcggcaccatcgggctcatcaaggccgtgaacacgttcgatccgtccaagaagatcaagctcgcgacgtacgcgtcccggtgcatcgagaatgagatactcatgtacctccgccgcaacaacaaacttcgcgccgaggtgtcgctggacgagccgctgaacgtggactgggatggaaacgagttgctcctgtcggacgtgctcggcacggattctgacaccatctaccggaacctcgaagatgaggtggatcgcgaactgctctacgacgccctcgacaagttgagcgaacgggagcgcaccatcatggagctgcgattcggcctggggaccggtcaggagatgacgcaaaaggacgtcgccgatcttctcgggatttcccaatcctacatatcgcgtttggagaagcgcattctgaagcggcttcagcgggagtttaacaagatgatgtga

SEQ ID NO: 272 - DNA, 750 bp, Artificial
  Substituion in SEQ ID NO 257
atgtacgcgttccagtttctcgagaccaagcgccgcctcgcgctccttcggattcgcctcctgtacatccgcctgcgaattcgcctcctgggtcagccggatgaggtttattacgtcggtggaagcgaggcgctcccgccgccgctcacgaaggaggaggagcaatatctccttgaacggcttccttcgggcgatccgtccgtgcggtcgatgctcattgagcgaaacctgcgcctcgtcgtgtacatcgcccgcaagttcgagaacacgggcgtgaacatcgaggacctggtgtccatcggcaccatcgggctcatcaaggccgtgaacacgttcgatccgtccaagaagatcaagctcgcgacgtacgcgtcccggtgcatcgagaatgagatactcatgtacctccgccgcaacaacaaacttcgcgccgaggtgtcgctggacgagccgctgaacgtggactgggatggaaacgagttgctcctgtcggacgtgctcggcacggattctgacaccatctaccggaacctcgaagatgaggtggatcgcgaactgctctacgacgccctcgacaagttgagcgaacgggagcgcaccatcatggagctgcgattcggcctggggaccggtcaggagatgacgcaaaaggacgtcgccgatcttctcgggatttcccaatcctacatatcgcgtttggagaagcgcattctgaagcggcttcagcgggagtttaacaagatgatgtga

SEQ ID NO: 273 - protein, 268 aa, Alicyclobacillus acidocaldarius
MTGRLGGTSLKRNKVEICGVNTSQLPVLTNAQMRELFEQLRAGDPSAREKLVNGNLRLVLSVIQRFNNRGEYVDDLFQVGCIGLMKAIDNFDLNQNVRFSTYAVPMIVGEIRRYLRDNNPIRVSRSLRDIAYKALQVRDMLASKNLREPSIVEIANEMNLPKEEVVFALDAIQDPVSMFEPIYHDGGDPIYVMDQIHDEREKDSAWVEGIALREAMRKLSDREKKILAKRFYEGKTQMEVADEIGISQAQVSRLEKAAIHRMYKHIQS

SEQ ID NO: 274 - DNA, 807 bp, Alicyclobacillus acidocaldarius
atgacgggcagacttggggggacttctttgaagcgcaacaaggtggagatctgcggcgtcaacacttctcagcttccggttctcaccaacgctcaaatgcgcgagctgttcgaacagcttcgggccggagacccctcggcgcgcgagaagctggtcaacggcaacctgcgcttggtcttatcggtcattcagcggtttaacaatcggggcgagtacgtggacgacctgttccaagtcggatgcatcggactgatgaaagccatagacaattttgacctcaatcaaaacgtgcgcttttccacctacgcggtccccatgatcgtcggcgaaattcgcaggtatctgcgggacaacaaccccatccgcgtcagccgttcccttcgcgacatcgcctacaaagcgctgcaggttcgcgacatgctggcgtccaaaaacctgcgcgagccttccatcgtcgagatcgccaacgagatgaacctgccgaaggaggaggtcgtgttcgcgctcgacgccattcaggaccccgtctccatgttcgagcccatctaccacgacgggggagatcccatctacgtgatggatcagatccacgacgagcgagaaaaggattcggcgtgggtggagggcattgcgctgcgggaggcgatgcggaagctgtcggaccgagagaagaagattctggcgaagcggttttacgagggcaagacccagatggaggtggcggacgagattggcatctcgcaggcgcaggtctcccgcctcgagaaggcagccattcaccgcatgtacaagcacatccagtcgtaa

SEQ ID NO: 275 - protein, 260 aa, Paenibacillus larvae subsp. larvae BRL-230010
MTRNKVEICGVDTAKLPVLTNTEMRELFALLQTKNERAAREKLVNGNLRLVLSVIQRFNNRGEFVDDLFQVGCIGLMKAIDNFDLSQNVKFSTYAVPMIIGEIRRYLRDNNPIRVSRSLRDIAYKALQVRDQLTNRNSREPTIYEISEVLNVPKEDVVFALDAIQDPVSLFEPIYHDGGDPIYVMDQISDERNKDLFWIEGIALREAMRKLGSREKMILSMRFFEGKTQMEVADEIGISQAQVSRLEKSAINQMQKHVKT

SEQ ID NO: 276 - protein, 254 aa, Pelotomaculum thermopropionicum SI
NKVEICGVNTSKLPVLTGSQMKALFEAMHKGDASARTKLINGNLRLVLSVIQRFTNRGEYVDDLFQVGCIGLMKAIDNFDLSQNVKFSTYAVPMIIGEIRRYLRDNNPIRVSRSLRDVAYKALQVRDALVNKYSREPSINEIACELKMPREEIVFALDAIQEPISLFEPIYHDGGDPIFVMDQISDEKNQDQNWLEGIAIRDALRKLSDREKLILTLRFYEGKTQMEVAEEIGISQAQVSRLEKAALNHMKKHI

SEQ ID NO: 277 - protein, 263 aa, Geobacillus thermodenitrificans NG80-2
MGGNNLTRNKVEICGVDTSKLPVLKNEEMRELFQRMHEGDLEAREKLVNGNLRLVLSVIQRFNNRGEFVDDLFQVGCIGLMKSIDNFDLNQNVKFSTYAVPMIIGEIRRYLRDNNPIRVSRSLRDIAYKALQVRERLMGETAKEPSTEEIAKELGVAHEEVVLALDAIQDPVSLFEPIYNDGGDPIYVMDQLSDERNRDSQWIEEIALKEGLRRLNEREKMIIRKRFFQGKTQMEVAEEIGISQAQVSRLEKAAIRQMNKNIQ

SEQ ID NO: 278 - protein, 261 aa, Bacillus halodurans C-125
MTRNKVEICGVDTSKLPVLKNQEMRELFARLQSGDTSARETLVNGNLRLVLSVIQRFNNRGEYVDDLFQVGCIGLMKSIDNFDLSQNVKFSTYAVPMIIGEIRRYLRDNNPIRVSRSLRDIAYKALQVRDQLMGEKQREKEPTVQEIAKELGVPKEDVVFALDAIQDPVSLFEPIYNDGGDPIYVMDQISDDRNKDVQWVDEIALKEAMVRLNDREKLILNMRFYQGKTQMEVAEEIGISQAQVSRLEKAAIQQMSKHAQS

SEQ ID NO: 279 - protein, 254 aa, Thermosinus carboxydivorans Nor1
NKVEICGVNTAKLPVLSANKMRELFEIMQQGNPEAREQLIYGNLRLVLSVIQRFNNRGEYVDDLFQVGCIGLMKAIDNFDLSQNVKFSTYAVPMIIGEIRRYLRDNNPIRVSRSMRDIAYKALQVRDALVSKFSREPSINEIADELKIPREEIIFALDAIQEPVSLFEPIYHDGGDPIFVMDQISDDKNQDMNWLEGVAIKEALRKLSDREKHILTLRFFEGKTQMEVADEIGISQAQVSRLEKAALGHMRKYI

SEQ ID NO: 280 - protein, 268 aa, Artificial
  Substituion in SEQ ID NO 273
MTGRLGGTSLKRNKVEICGVNTSQLPVLTNAQMRELFEQLRAGDPSAREKLVNGNLRLVLSVIQRFNNRGEYVDDLFQVGCIGLMKAIDNFDLNQNVRFSTYAVPMIVGEIRRYLRDNNPIRVSRSLRDIAYKALQVRDMLASKNLREPSIVEIANEMNLPKEEVVFALDAIQDPVSMFEPIYHDGGDPIYVMDQIHDEREKDSAWVEGIALREAMKKLSDREKKILAKRFYEGKTQMEVADEIGISQAQVSRLEKAAIHRMYKHIQS

SEQ ID NO: 281 - protein, 268 aa, Artificial
  Substituion in SEQ ID NO 273
MTGRLGGTSLKRNKVEICGVNTSQLPVLTNAQMRELFEQLRAGDPSAREKLVNGNLRLVLSVIQRFNNRGEYVDDLFQVGCIGLMKAIDNFDLNQNVRFSTYAVPMIVGEIRRYLRDNNPIRVSRSLRDLAYKALQVRDMLASKNLREPSIVEIANEMNLPKEEVVFALDAIQDPVSMFEPIYHDGGDPIYVMDQIHDEREKDSAWVEGIALREAMRKLSDREKKILAKRFYEGKTQMEVADEIGISQAQVSRLEKAAIHRMYKHIQS

SEQ ID NO: 282 - protein, 268 aa, Artificial
  Substituion in SEQ ID NO 273
MTGRLGGTSLKRNKVEICGVNTSQLPVLTNAQMRELFEQLRAGDPSAREKLVNGNLRLVLSVIQRFNNRGEYVDDLFQVGCIGLMKAIDNFDLNQNVRFSTYAVPMIVGEIRRYLRDNNPIRVSRSLRDIAYKALQVRDMLASKNLREPSIVEIANEMNLPKEEVVFALDAIQDPVSMFEPIYHDGGDPIYVMDQIHDEREKDSAWIEGIALREAMRKLSDREKKILAKRFYEGKTQMEVADEIGISQAQVSRLEKAAIHRMYKHIQS

SEQ ID NO: 283 - protein, 268 aa, Artificial
  Substituion in SEQ ID NO 273
MTGRLGGTSLKRNKVEICGVNTSQLPVLTNAQMRELFEQLRAGDPSAREKLVNGNLRLVLSVIQRFNNRGEYVDDLFQVGCIGLMKAIDNFDLNQNVRFSTYAVPMIVGEIRRYLRDNNPIRVSRSLRDIAYKALQVRDMLASKNLREPSIVEIANDMNLPKEEVVFALDAIQDPVSMFEPIYHDGGDPIYVMDQIHDEREKDSAWVEGIALREAMRKLSDREKKILAKRFYEGKTQMEVADEIGISQAQVSRLEKAAIHRMYKHIQS

SEQ ID NO: 284 - protein, 268 aa, Artificial
  Substituion in SEQ ID NO 273
MTGRLGGTSLKRNKVEICGVNTSQLPVLTNAQMKELFEQLRAGDPSAREKLVNGNLRLVLSVIQRFNNRGEYVDDLFQVGCIGLMKAIDNFDLNQNVRFSTYAVPMIVGEIRRYLRDNNPIRVSRSLRDIAYKALQVRDMLASKNLREPSIVEIANEMNLPKEEVVFALDAIQDPVSMFEPIYHDGGDPIYVMDQIHDEREKDSAWVEGIALREAMRKLSDREKKILAKRFYEGKTQMEVADEIGISQAQVSRLEKAAIHRMYKHIQS

SEQ ID NO: 285 - DNA, 807 bp, Artificial
  Substituion in SEQ ID NO 274
atgacgggcagacttggggggacttctttgaagcgcaacaaggtggagatctgcggcgtcaacacttctcagcttccggttctcaccaacgctcaaatgcgcgagctgttcgaacagcttcgggccggagacccctcggcgcgcgagaagctggtcaacggcaacctgcgcttggtcttatcggtcattcagcggtttaacaatcggggcgagtacgtggacgacctgttccaagtcggatgcatcggactgatgaaagccatagacaattttgacctcaatcaaaacgtgcgcttttccacctacgcggtccccatgatcgtcggcgaaattcgcaggtatctgcgggacaacaaccccatccgcgtcagccgttcccttcgcgacatcgcctacaaagcgctgcaggttcgcgacatgctggcgtccaaaaacctgcgcgagccttccatcgtcgagatcgccaacgagatgaacctgccgaaggaggaggtcgtgttcgcgctcgacgccattcaggaccccgtctccatgttcgagcccatctaccacgacgggggagatcccatctacgtgatggatcagatccacgacgagcgagaaaaggattcggcgtgggtggagggcattgcgctgcgggaggcgatgaaaaagctgtcggaccgagagaagaagattctggcgaagcggttttacgagggcaagacccagatggaggtggcggacgagattggcatctcgcaggcgcaggtctcccgcctcgagaaggcagccattcaccgcatgtacaagcacatccagtcgtaa

SEQ ID NO: 286 - DNA, 807 bp, Artificial
  Substituion in SEQ ID NO 274
atgacgggcagacttggggggacttctttgaagcgcaacaaggtggagatctgcggcgtcaacacttctcagcttccggttctcaccaacgctcaaatgcgcgagctgttcgaacagcttcgggccggagacccctcggcgcgcgagaagctggtcaacggcaacctgcgcttggtcttatcggtcattcagcggtttaacaatcggggcgagtacgtggacgacctgttccaagtcggatgcatcggactgatgaaagccatagacaattttgacctcaatcaaaacgtgcgcttttccacctacgcggtccccatgatcgtcggcgaaattcgcaggtatctgcgggacaacaaccccatccgcgtcagccgttcccttcgcgacttagcctacaaagcgctgcaggttcgcgacatgctggcgtccaaaaacctgcgcgagccttccatcgtcgagatcgccaacgagatgaacctgccgaaggaggaggtcgtgttcgcgctcgacgccattcaggaccccgtctccatgttcgagcccatctaccacgacgggggagatcccatctacgtgatggatcagatccacgacgagcgagaaaaggattcggcgtgggtggagggcattgcgctgcgggaggcgatgcggaagctgtcggaccgagagaagaagattctggcgaagcggttttacgagggcaagacccagatggaggtggcggacgagattggcatctcgcaggcgcaggtctcccgcctcgagaaggcagccattcaccgcatgtacaagcacatccagtcgtaa

SEQ ID NO: 287 - DNA, 807 bp, Artificial
  Substituion in SEQ ID NO 274
atgacgggcagacttggggggacttctttgaagcgcaacaaggtggagatctgcggcgtcaacacttctcagcttccggttctcaccaacgctcaaatgcgcgagctgttcgaacagcttcgggccggagacccctcggcgcgcgagaagctggtcaacggcaacctgcgcttggtcttatcggtcattcagcggtttaacaatcggggcgagtacgtggacgacctgttccaagtcggatgcatcggactgatgaaagccatagacaattttgacctcaatcaaaacgtgcgcttttccacctacgcggtccccatgatcgtcggcgaaattcgcaggtatctgcgggacaacaaccccatccgcgtcagccgttcccttcgcgacatcgcctacaaagcgctgcaggttcgcgacatgctggcgtccaaaaacctgcgcgagccttccatcgtcgagatcgccaacgagatgaacctgccgaaggaggaggtcgtgttcgcgctcgacgccattcaggaccccgtctccatgttcgagcccatctaccacgacgggggagatcccatctacgtgatggatcagatccacgacgagcgagaaaaggattcggcgtggattgagggcattgcgctgcgggaggcgatgcggaagctgtcggaccgagagaagaagattctggcgaagcggttttacgagggcaagacccagatggaggtggcggacgagattggcatctcgcaggcgcaggtctcccgcctcgagaaggcagccattcaccgcatgtacaagcacatccagtcgtaa

SEQ ID NO: 288 - DNA, 807 bp, Artificial
  Substituion in SEQ ID NO 274
atgacgggcagacttggggggacttctttgaagcgcaacaaggtggagatctgcggcgtcaacacttctcagcttccggttctcaccaacgctcaaatgcgcgagctgttcgaacagcttcgggccggagacccctcggcgcgcgagaagctggtcaacggcaacctgcgcttggtcttatcggtcattcagcggtttaacaatcggggcgagtacgtggacgacctgttccaagtcggatgcatcggactgatgaaagccatagacaattttgacctcaatcaaaacgtgcgcttttccacctacgcggtccccatgatcgtcggcgaaattcgcaggtatctgcgggacaacaaccccatccgcgtcagccgttcccttcgcgacatcgcctacaaagcgctgcaggttcgcgacatgctggcgtccaaaaacctgcgcgagccttccatcgtcgagatcgccaacgatatgaacctgccgaaggaggaggtcgtgttcgcgctcgacgccattcaggaccccgtctccatgttcgagcccatctaccacgacgggggagatcccatctacgtgatggatcagatccacgacgagcgagaaaaggattcggcgtgggtggagggcattgcgctgcgggaggcgatgcggaagctgtcggaccgagagaagaagattctggcgaagcggttttacgagggcaagacccagatggaggtggcggacgagattggcatctcgcaggcgcaggtctcccgcctcgagaaggcagccattcaccgcatgtacaagcacatccagtcgtaa

SEQ ID NO: 289 - DNA, 807 bp, Artificial
  Substituion in SEQ ID NO 274
atgacgggcagacttggggggacttctttgaagcgcaacaaggtggagatctgcggcgtcaacacttctcagcttccggttctcaccaacgctcaaatgaaagagctgttcgaacagcttcgggccggagacccctcggcgcgcgagaagctggtcaacggcaacctgcgcttggtcttatcggtcattcagcggtttaacaatcggggcgagtacgtggacgacctgttccaagtcggatgcatcggactgatgaaagccatagacaattttgacctcaatcaaaacgtgcgcttttccacctacgcggtccccatgatcgtcggcgaaattcgcaggtatctgcgggacaacaaccccatccgcgtcagccgttcccttcgcgacatcgcctacaaagcgctgcaggttcgcgacatgctggcgtccaaaaacctgcgcgagccttccatcgtcgagatcgccaacgagatgaacctgccgaaggaggaggtcgtgttcgcgctcgacgccattcaggaccccgtctccatgttcgagcccatctaccacgacgggggagatcccatctacgtgatggatcagatccacgacgagcgagaaaaggattcggcgtgggtggagggcattgcgctgcgggaggcgatgcggaagctgtcggaccgagagaagaagattctggcgaagcggttttacgagggcaagacccagatggaggtggcggacgagattggcatctcgcaggcgcaggtctcccgcctcgagaaggcagccattcaccgcatgtacaagcacatccagtcgtaa

SEQ ID NO: 290 - protein, 177 aa, Alicyclobacillus acidocaldarius
MAQKTQIMDEAAMRRSLTRMAHEILERNKGLDDLVLVGIVTRGAILAERLGRKLFEIEGQVVPCHRLDPRPYRDDRDRTVSPEAPAPNIDVADRKVILVDDVLYTGRTVRAALDAMMRAGRARCVQLATLVDRGHRELPIRPDFVGKNVPTARDEQVIVRLAEVDGLDGVWIAEGRA

SEQ ID NO: 291 - DNA, 534 bp, Alicyclobacillus acidocaldarius
gtggctcaaaagacgcagattatggacgaagcggcaatgcgcagatcgctcacccgcatggcccacgagatcctggagcgcaacaaggggctggacgacctcgtgctcgtcgggatcgtcacgcgcggcgccatcctggcggagaggctcgggcggaagctgttcgaaattgaggggcaggtcgtgccgtgccaccggctggatccccggccgtaccgggacgatcgcgaccggacggtctcgcccgaggcgcccgcgccaaacatcgacgtggcggatcgcaaggtcattctcgtcgatgacgtgctgtacacggggcggacggtgagggccgcgctggacgccatgatgcgcgcgggccgcgcgcggtgtgtgcagctcgcgacgctggtggaccgcggccatcgggagcttcccattcggcccgactttgtgggcaaaaacgtgccgacggcgcgagacgagcaggtcatcgtccgcctcgcggaagtggacggtttggacggcgtctggattgcggaaggaagggcgtga

SEQ ID NO: 292 - protein, 177 aa, Bacillus sp. SG-1
MAQKTVVLDQPAIRRALTRIAHEIIERNKGIQDCVLVGIKTRGIHLAKRLANRIEEIEGAKMPVGEIDITLYRDDLTVKTANEEPEVKGSDLPVDVTDKKVILIDDVLFTGRTVRAALDALMDVGRPSNIQLAVLVDRGHRELPIRADFVGKNIPTSSSEKIVVELTEVDDEDQVTI

SEQ ID NO: 293 - protein, 177 aa, Geobacillus kaustophilus HTA426
QKAVVMDEQAIRRALTRIAHEIIERNKGIDGCVLVGIKTRGIYLARRLAERIEQIEGASVPVGELDITLYRDDLTVKTDDHEPLVKGTNVPFPVTERNVILVDDVLFTGRTVRAAMDAVMDLGRPARIQLAVLVDRGHRELPIRADFVGKNVPTSRSELIVVELSEVDGIDQVSIHE

SEQ ID NO: 294 - protein, 177 aa, Bacillus coagulans 36D1
MAQKAVVMDEIMIRRALTRIAHEIIERNKGIEDTMLIGIKTRGIYLADRLAERIERIEGRKVEVGELDITLYRDDLSKKTVDGEPEVKGANLPSSITGKKIVLVDDVLYTGRTVRAAMDALMDIGRPSRIQLAVLVDRGHRELPIRPDFIGKNIPTSQSERIVVQLTDVDGRDLVTI

SEQ ID NO: 295 - protein, 177 aa, Geobacillus thermodenitrificans NG80-2
QKAVVMDEQAIRRALTRIAHEIIERNKGIDGCVLVGIKTRGIYLARRLAERIEQIEGTSVPVGELDITLYRDDLTMKTEDHEPLVKGTNVPFPVSEQKVILVDDVLFTGRTVRAAMDAVMDLGRPARIQLAVLVDRGHRELPIRADFVGKNVPTSSAEVIVVELAEVDGVDQVSIHE

SEQ ID NO: 296 - protein, 177 aa, Lactobacillus casei ATCC 334
MAQSKQVVDEVTMKRALTRISYEIIEQNKGLNDLVLVGIKTRGIYLAHRIAKRLEQLEGLQVPVGELDIQFYRDDVHKIDHDHQPDVEGAQLPVNITGKHVILVDDVIFTGRTIRAALDALMDEGRPRKISLAVLVDRGHRELPIRPDFVGKNIPTSLDEQIQVQVSELDGKDGISI

SEQ ID NO: 297 - protein, 177 aa, Artificial
  Substituion in SEQ ID NO 290
MAQKTQIMDEAAMRRSLTRMAHEILERNKGLDDLVLVGIVTRGAILAERLGRKLFEIEGQVVPCHRLDPRPYRDDRDRTVSPEAPAPNIDVADRKVILVDDVLYTGRTVRAALDAMMRAGRARCVQLATLVDRGHRELPIRPDFVGKNVPTARDEQVIVRLAEVDGLDGIWIAEGRA

SEQ ID NO: 298 - protein, 177 aa, Artificial
  Substituion in SEQ ID NO 290
MAQKTQIMDEAAMRRSLTRMAHEILERNKGLDDLVLVGIVTRGAILAERLGRKLFEIEGQVVPCHRLDPRPYRDDRDRTVSPEAPAPNIDVADRKVILVDDVLYTGRTVRAALDAMMRAGRARCVQLATLVDRGHRELPIRPDFVGKNVPTARDEQVIVRLADVDGLDGVWIAEGRA

SEQ ID NO: 299 - protein, 177 aa, Artificial
  Substituion in SEQ ID NO 290
MAQKTQIMDEAAMRRSLTRMAHEILERNKGLDDIVLVGIVTRGAILAERLGRKLFEIEGQVVPCHRLDPRPYRDDRDRTVSPEAPAPNIDVADRKVILVDDVLYTGRTVRAALDAMMRAGRARCVQLATLVDRGHRELPIRPDFVGKNVPTARDEQVIVRLAEVDGLDGVWIAEGRA

SEQ ID NO: 300 - protein, 177 aa, Artificial
  Substituion in SEQ ID NO 290
MAQRTQIMDEAAMRRSLTRMAHEILERNKGLDDLVLVGIVTRGAILAERLGRKLFEIEGQVVPCHRLDPRPYRDDRDRTVSPEAPAPNIDVADRKVILVDDVLYTGRTVRAALDAMMRAGRARCVQLATLVDRGHRELPIRPDFVGKNVPTARDEQVIVRLAEVDGLDGVWIAEGRA

SEQ ID NO: 301 - protein, 177 aa, Artificial
  Substituion in SEQ ID NO 290
MAQKTQIMDEAAMRRSLTRMAHEILERNKGLDDLVLVGIVTRGAILAERLGRKLFDIEGQVVPCHRLDPRPYRDDRDRTVSPEAPAPNIDVADRKVILVDDVLYTGRTVRAALDAMMRAGRARCVQLATLVDRGHRELPIRPDFVGKNVPTARDEQVIVRLAEVDGLDGVWIAEGRA

SEQ ID NO: 302 - DNA, 534 bp, Artificial
  Substituion in SEQ ID NO 291
gtggctcaaaagacgcagattatggacgaagcggcaatgcgcagatcgctcacccgcatggcccacgagatcctggagcgcaacaaggggctggacgacctcgtgctcgtcgggatcgtcacgcgcggcgccatcctggcggagaggctcgggcggaagctgttcgaaattgaggggcaggtcgtgccgtgccaccggctggatccccggccgtaccgggacgatcgcgaccggacggtctcgcccgaggcgcccgcgccaaacatcgacgtggcggatcgcaaggtcattctcgtcgatgacgtgctgtacacggggcggacggtgagggccgcgctggacgccatgatgcgcgcgggccgcgcgcggtgtgtgcagctcgcgacgctggtggaccgcggccatcgggagcttcccattcggcccgactttgtgggcaaaaacgtgccgacggcgcgagacgagcaggtcatcgtccgcctcgcggaagtggacggtttggacggcatttggattgcggaaggaagggcgtga

SEQ ID NO: 303 - DNA, 534 bp, Artificial
  Substituion in SEQ ID NO 291
gtggctcaaaagacgcagattatggacgaagcggcaatgcgcagatcgctcacccgcatggcccacgagatcctggagcgcaacaaggggctggacgacctcgtgctcgtcgggatcgtcacgcgcggcgccatcctggcggagaggctcgggcggaagctgttcgaaattgaggggcaggtcgtgccgtgccaccggctggatccccggccgtaccgggacgatcgcgaccggacggtctcgcccgaggcgcccgcgccaaacatcgacgtggcggatcgcaaggtcattctcgtcgatgacgtgctgtacacggggcggacggtgagggccgcgctggacgccatgatgcgcgcgggccgcgcgcggtgtgtgcagctcgcgacgctggtggaccgcggccatcgggagcttcccattcggcccgactttgtgggcaaaaacgtgccgacggcgcgagacgagcaggtcatcgtccgcctcgcggatgtggacggtttggacggcgtctggattgcggaaggaagggcgtga

SEQ ID NO: 304 - DNA, 534 bp, Artificial
  Substituion in SEQ ID NO 291
gtggctcaaaagacgcagattatggacgaagcggcaatgcgcagatcgctcacccgcatggcccacgagatcctggagcgcaacaaggggctggacgacattgtgctcgtcgggatcgtcacgcgcggcgccatcctggcggagaggctcgggcggaagctgttcgaaattgaggggcaggtcgtgccgtgccaccggctggatccccggccgtaccgggacgatcgcgaccggacggtctcgcccgaggcgcccgcgccaaacatcgacgtggcggatcgcaaggtcattctcgtcgatgacgtgctgtacacggggcggacggtgagggccgcgctggacgccatgatgcgcgcgggccgcgcgcggtgtgtgcagctcgcgacgctggtggaccgcggccatcgggagcttcccattcggcccgactttgtgggcaaaaacgtgccgacggcgcgagacgagcaggtcatcgtccgcctcgcggaagtggacggtttggacggcgtctggattgcggaaggaagggcgtga

SEQ ID NO: 305 - DNA, 534 bp, Artificial
  Substituion in SEQ ID NO 291
gtggctcaacgtacgcagattatggacgaagcggcaatgcgcagatcgctcacccgcatggcccacgagatcctggagcgcaacaaggggctggacgacctcgtgctcgtcgggatcgtcacgcgcggcgccatcctggcggagaggctcgggcggaagctgttcgaaattgaggggcaggtcgtgccgtgccaccggctggatccccggccgtaccgggacgatcgcgaccggacggtctcgcccgaggcgcccgcgccaaacatcgacgtggcggatcgcaaggtcattctcgtcgatgacgtgctgtacacggggcggacggtgagggccgcgctggacgccatgatgcgcgcgggccgcgcgcggtgtgtgcagctcgcgacgctggtggaccgcggccatcgggagcttcccattcggcccgactttgtgggcaaaaacgtgccgacggcgcgagacgagcaggtcatcgtccgcctcgcggaagtggacggtttggacggcgtctggattgcggaaggaagggcgtga

SEQ ID NO: 306 - DNA, 534 bp, Artificial
  Substituion in SEQ ID NO 291
gtggctcaaaagacgcagattatggacgaagcggcaatgcgcagatcgctcacccgcatggcccacgagatcctggagcgcaacaaggggctggacgacctcgtgctcgtcgggatcgtcacgcgcggcgccatcctggcggagaggctcgggcggaagctgttcgatattgaggggcaggtcgtgccgtgccaccggctggatccccggccgtaccgggacgatcgcgaccggacggtctcgcccgaggcgcccgcgccaaacatcgacgtggcggatcgcaaggtcattctcgtcgatgacgtgctgtacacggggcggacggtgagggccgcgctggacgccatgatgcgcgcgggccgcgcgcggtgtgtgcagctcgcgacgctggtggaccgcggccatcgggagcttcccattcggcccgactttgtgggcaaaaacgtgccgacggcgcgagacgagcaggtcatcgtccgcctcgcggaagtggacggtttggacggcgtctggattgcggaaggaagggcgtga

SEQ ID NO: 307 - protein, 66 aa, Alicyclobacillus acidocaldarius
MIYPSIDRLLERCNSKYALVVLAAKRARKLQNETLNQPGASTTRNVSRALWEIHDGVVRCKNFDGE

SEQ ID NO: 308 - DNA, 201 bp, Alicyclobacillus acidocaldarius
ttgatctatccgtccatcgatcgactgttggagcggtgcaacagcaaatacgcgctcgtcgtgctcgcggcgaagcgcgcccgcaaactgcagaacgagaccctgaaccagcccggcgcgtcgacgacgcggaacgtgagccgcgcgctctgggaaattcacgacggcgtcgttcgctgcaagaacttcgacggcgagtga

SEQ ID NO: 309 - protein, 64 aa, Listeria welshimeri serovar 6b str. SLCC5334
MLYPSIDNLLLKIDSKYSLVTVAAKRARYMQLENDKGVLPSYQSDKFVGKALEEIHAGKLVLKN

SEQ ID NO: 310 - protein, 66 aa, Listeria monocytogenes EGD-e
MLYPSIDNLLLKIDSKYSLVTVAAKRARYMQLENDKGVLPSYQSDKFVGKALEEIHAGKLVLQNDD

SEQ ID NO: 311 - protein, 66 aa, Listeria monocytogenes str. 4b F2365; identical to SEQ ID NO: 310

SEQ ID NO: 312 - protein, 59 aa, Lactococcus lactis subsp. lactis Il1403
MLEPSIDKLLDQVDSKYSLVVLEAKRAHELRDKERPTKEFKAVKNTLRALEEIADGTVK

SEQ ID NO: 313 - protein, 64 aa, Listeria innocua Clip11262
MLYPSIDNLLLKIDSKYSLVTVAAKRARYMQLENDKGVLPSYQSDKFVGKALEEIHAGKLVLQN

SEQ ID NO: 314 - protein, 66 aa, Artificial
  Substituion in SEQ ID NO 307
MIYPSIDRLLERCNSKYALVVLAAKRARKLQNETLNQPGASTTRNVSRALWEIHDGVIRCKNFDGE

SEQ ID NO: 315 - protein, 66 aa, Artificial
  Substituion in SEQ ID NO 307
MIYPSIDRLLERCNSKYALVVLAAKRARKLQNETINQPGASTTRNVSRALWEIHDGVVRCKNFDGE

SEQ ID NO: 316 - protein, 66 aa, Artificial
  Substituion in SEQ ID NO 307
MIYPSIDRLLDRCNSKYALVVLAAKRARKLQNETLNQPGASTTRNVSRALWEIHDGVVRCKNFDGE

SEQ ID NO: 317 - protein, 66 aa, Artificial
  Substituion in SEQ ID NO 307
MIYPSIDRLLERCNSKYALVVLAAKRARKLQNETLNQPGASTTRNVSRALWEIHDGVVKCKNFDGE

SEQ ID NO: 318 - protein, 66 aa, Artificial
  Substituion in SEQ ID NO 307
MIYPSIDRLLERCNSKYALVVLAAKRARKLQNETLNQPGASTTKNVSRALWEIHDGVVRCKNFDGE

SEQ ID NO: 319 - DNA, 201 bp, Artificial
  Substituion in SEQ ID NO 308
ttgatctatccgtccatcgatcgactgttggagcggtgcaacagcaaatacgcgctcgtcgtgctcgcggcgaagcgcgcccgcaaactgcagaacgagaccctgaaccagcccggcgcgtcgacgacgcggaacgtgagccgcgcgctctgggaaattcacgacggcgtcattcgctgcaagaacttcgacggcgagtga

SEQ ID NO: 320 - DNA, 201 bp, Artificial
  Substituion in SEQ ID NO 308
ttgatctatccgtccatcgatcgactgttggagcggtgcaacagcaaatacgcgctcgtcgtgctcgcggcgaagcgcgcccgcaaactgcagaacgagaccattaaccagcccggcgcgtcgacgacgcggaacgtgagccgcgcgctctgggaaattcacgacggcgtcgttcgctgcaagaacttcgacggcgagtga

SEQ ID NO: 321 - DNA, 201 bp, Artificial
  Substituion in SEQ ID NO 308
ttgatctatccgtccatcgatcgactgttggatcggtgcaacagcaaatacgcgctcgtcgtgctcgcggcgaagcgcgcccgcaaactgcagaacgagaccctgaaccagcccggcgcgtcgacgacgcggaacgtgagccgcgcgctctgggaaattcacgacggcgtcgttcgctgcaagaacttcgacggcgagtga

SEQ ID NO: 322 - DNA, 201 bp, Artificial
  Substituion in SEQ ID NO 308
ttgatctatccgtccatcgatcgactgttggagcggtgcaacagcaaatacgcgctcgtcgtgctcgcggcgaagcgcgcccgcaaactgcagaacgagaccctgaaccagcccggcgcgtcgacgacgcggaacgtgagccgcgcgctctgggaaattcacgacggcgtcgttaaatgcaagaacttcgacggcgagtga

SEQ ID NO: 323 - DNA, 201 bp, Artificial
  Substituion in SEQ ID NO 308
ttgatctatccgtccatcgatcgactgttggagcggtgcaacagcaaatacgcgctcgtcgtgctcgcggcgaagcgcgcccgcaaactgcagaacgagaccctgaaccagcccggcgcgtcgacgacgaaaaacgtgagccgcgcgctctgggaaattcacgacggcgtcgttcgctgcaagaacttcgacggcgagtga

SEQ ID NO: 324 - protein, 66 aa, Alicyclobacillus acidocaldarius
MMANQNGSNKVLVQGANRALDQMKYEIATEFGVQLGPDTTARQNGSVGGEITKRLVAYAEQQLAGH

SEQ ID NO: 325 - DNA, 201 bp, Alicyclobacillus acidocaldarius
gtgatggcaaaccagaacggaagcaacaaggtgctcgtgcagggtgccaaccgcgcgctggaccagatgaagtacgaaatcgcgacggagttcggcgttcagctgggccccgacacgaccgctcgccagaacggctctgtgggcggcgagatcacgaagcgcttggtggcctacgccgagcaacagcttgctggtcactaa

SEQ ID NO: 326 - protein, 65 aa, Bacillus firmus
MANNNSSNQLVVPGVQQALDQMKYEIASEFGVQLGPDATARANGSVGGEITKRLVQMAEQQMGGY

SEQ ID NO: 327 - protein, 64 aa, Bacillus cereus subsp. cytotoxis NVH 391-98
MANQNSSNQLVVPGATAAIDQMKYEIAQEFGVQLGADTTARANGSVGGEITKRLVAMAEQSLGG

SEQ ID NO: 328 - protein, 64 aa, Bacillus cereus ATCC 14579
MANQNSSNQLVVPGATAAIDQMKYEIAQEFGVQLGADSTARANGSVGGEITKRLVAMAEQSLGG

SEQ ID NO: 329 - protein, 66 aa, Bacillus thuringiensis serovar konkukian str. 97-27
MANKNSGSRNELLVRGAEQALDQMKYEIAQEFGVQLGADTTARSNGSVGGEITKRLVAMAEQQLGG

SEQ ID NO: 330 - protein, 66 aa, Bacillus cereus ATCC 10987
MANNNSGNRNELLVRGAEQALDQMKYEIAQEFGVQLGADTTARSNGSVGGEITKRLVAMAEQQLGG

SEQ ID NO: 331 - protein, 66 aa, Artificial
  Substituion in SEQ ID NO 324
MMANQNGSNKVLVQGANKALDQMKYEIATEFGVQLGPDTTARQNGSVGGEITKRLVAYAEQQLAGH

SEQ ID NO: 332 - protein, 66 aa, Artificial
  Substituion in SEQ ID NO 324
MMANQNGSNKVLVQGANRALDQMKYEIATEFGVQLGPDTTARQNGSVGGEITKRLVAYAEQNLAGH

SEQ ID NO: 333 - protein, 66 aa, Artificial
  Substituion in SEQ ID NO 324
MMANNNGSNKVLVQGANRALDQMKYEIATEFGVQLGPDTTARQNGSVGGEITKRLVAYAEQQLAGH

SEQ ID NO: 334 - protein, 66 aa, Artificial
  Substituion in SEQ ID NO 324
MMANQNGSNKVLVNGANRALDQMKYEIATEFGVQLGPDTTARQNGSVGGEITKRLVAYAEQQLAGH

SEQ ID NO: 335 - protein, 66 aa, Artificial
  Substituion in SEQ ID NO 324
MMANQNGSNKVLVQGANRAIDQMKYEIATEFGVQLGPDTTARQNGSVGGEITKRLVAYAEQQLAGH

SEQ ID NO: 336 - DNA, 201 bp, Artificial
  Substituion in SEQ ID NO 325
gtgatggcaaaccagaacggaagcaacaaggtgctcgtgcagggtgccaacaaagcgctggaccagatgaagtacgaaatcgcgacggagttcggcgttcagctgggccccgacacgaccgctcgccagaacggctctgtgggcggcgagatcacgaagcgcttggtggcctacgccgagcaacagcttgctggtcactaa

SEQ ID NO: 337 - DNA, 201 bp, Artificial
  Substituion in SEQ ID NO 325
gtgatggcaaaccagaacggaagcaacaaggtgctcgtgcagggtgccaaccgcgcgctggaccagatgaagtacgaaatcgcgacggagttcggcgttcagctgggccccgacacgaccgctcgccagaacggctctgtgggcggcgagatcacgaagcgcttggtggcctacgccgagcaaaatcttgctggtcactaa

SEQ ID NO: 338 - DNA, 201 bp, Artificial
  Substituion in SEQ ID NO 325
gtgatggcaaacaataacggaagcaacaaggtgctcgtgcagggtgccaaccgcgcgctggaccagatgaagtacgaaatcgcgacggagttcggcgttcagctgggccccgacacgaccgctcgccagaacggctctgtgggcggcgagatcacgaagcgcttggtggcctacgccgagcaacagcttgctggtcactaa

SEQ ID NO: 339 - DNA, 201 bp, Artificial
  Substituion in SEQ ID NO 325
gtgatggcaaaccagaacggaagcaacaaggtgctcgtgaatggtgccaaccgcgcgctggaccagatgaagtacgaaatcgcgacggagttcggcgttcagctgggccccgacacgaccgctcgccagaacggctctgtgggcggcgagatcacgaagcgcttggtggcctacgccgagcaacagcttgctggtcactaa

SEQ ID NO: 340 - DNA, 201 bp, Artificial
  Substituion in SEQ ID NO 325
gtgatggcaaaccagaacggaagcaacaaggtgctcgtgcagggtgccaaccgcgcgattgaccagatgaagtacgaaatcgcgacggagttcggcgttcagctgggccccgacacgaccgctcgccagaacggctctgtgggcggcgagatcacgaagcgcttggtggcctacgccgagcaacagcttgctggtcactaa

SEQ ID NO: 341 - protein, 80 aa, Alicyclobacillus acidocaldarius
MKSTGIVRKVDELGRVVIPIELRRTLGIGEKDALEIYVDGDRIILKKYEPACIFCGQADEIIHFKGKNICPSCIAEMQHA

SEQ ID NO: 342 - DNA, 243 bp, Alicyclobacillus acidocaldarius
gtgaagtctacaggtattgtccgcaaggtggacgaactcggtcgggtggtcattcccatcgagttgcgccgcacgctcggcatcggcgagaaggatgcgctcgaaatctacgtcgatggagatcgcatcattctcaagaagtacgagccggcctgcatcttctgcggtcaggcggacgagatcatccacttcaagggcaagaacatctgcccgtcctgcatcgccgagatgcagcacgcgtaa

SEQ ID NO: 343 - protein, 77 aa, Syntrophomonas wolfei subsp. wolfei str. Goettingen
LKSTGVVRKVDELGRIVIPIELRRTMGIEEKDALEIYVDSEKIILKKYEPACIFCGNAEEVVNYKGKNLCKSCLTEL

SEQ ID NO: 344 - protein, 78 aa, Thermoanaerobacter pseudethanolicus ATCC 33223
LKSTGIVRKVDELGRVVIPIELRRTLNIAERDALEIYVDGEQIVLKKYEPACIFCGNAENVINYKGKNICKNCLEELK

SEQ ID NO: 345 - protein, 78 aa, Thermoanaerobacter tengcongensis MB4; identical to SEQ ID NO: 344

SEQ ID NO: 346 - protein, 77 aa, Thermosinus carboxydivorans Nor1
MKSTGIVRRVDELGRVVIPIELRRTLDIEEKDALEIYVDNDRIILRKYEPACVFCGNADEVTNFKGKNVCRECLEAM

SEQ ID NO: 347 - protein, 77 aa, Symbiobacterium thermophilum IAM 14863
MKSTGIVRKVDELGRVVIPIELRRTLNIEEKDSLEIYVDGDKIILRKYEPACVFCGNAANVENFKGKNVCQSCLASM

SEQ ID NO: 348 - protein, 80 aa, Artificial
  Substituion in SEQ ID NO 341
MKSTGIVRKVDELGRVVIPIELRRTLGIGEKDALEIYVDGDRIILKKYEPACIFCGQADDIIHFKGKNICPSCIAEMQHA

SEQ ID NO: 349 - protein, 80 aa, Artificial
  Substituion in SEQ ID NO 341
MKSTGIVRKVDELGRVVIPIELRRTLGIGEKDALEIYVDGDRIILRKYEPACIFCGQADEIIHFKGKNICPSCIAEMQHA

SEQ ID NO: 350 - protein, 80 aa, Artificial
  Substituion in SEQ ID NO 341
MKSTGIVRKVDELGRVVIPIELRRTLGIGEKDALEIYVDGDRIILKKYEPACIFCGQADEILHFKGKNICPSCIAEMQHA

SEQ ID NO: 351 - protein, 80 aa, Artificial
  Substituion in SEQ ID NO 341
MKSTGIVRKVDELGRVVIPIELRRTLGIGEKDALEIYVDGDRIILKKYEPACIFCGNADEIIHFKGKNICPSCIAEMQHA

SEQ ID NO: 352 - protein, 80 aa, Artificial
  Substituion in SEQ ID NO 341
MKSTGIVRKVDELGRVVIPIELRRTLGIGEKDALEIYVDGDRILLKKYEPACIFCGQADEIIHFKGKNICPSCIAEMQHA

SEQ ID NO: 353 - DNA, 243 bp, Artificial
  Substituion in SEQ ID NO 342
gtgaagtctacaggtattgtccgcaaggtggacgaactcggtcgggtggtcattcccatcgagttgcgccgcacgctcggcatcggcgagaaggatgcgctcgaaatctacgtcgatggagatcgcatcattctcaagaagtacgagccggcctgcatcttctgcggtcaggcggacgatatcatccacttcaagggcaagaacatctgcccgtcctgcatcgccgagatgcagcacgcgtaa

SEQ ID NO: 354 - DNA, 243 bp, Artificial
  Substituion in SEQ ID NO 342
gtgaagtctacaggtattgtccgcaaggtggacgaactcggtcgggtggtcattcccatcgagttgcgccgcacgctcggcatcggcgagaaggatgcgctcgaaatctacgtcgatggagatcgcatcattctccgtaagtacgagccggcctgcatcttctgcggtcaggcggacgagatcatccacttcaagggcaagaacatctgcccgtcctgcatcgccgagatgcagcacgcgtaa

SEQ ID NO: 355 - DNA, 243 bp, Artificial
  Substituion in SEQ ID NO 342
gtgaagtctacaggtattgtccgcaaggtggacgaactcggtcgggtggtcattcccatcgagttgcgccgcacgctcggcatcggcgagaaggatgcgctcgaaatctacgtcgatggagatcgcatcattctcaagaagtacgagccggcctgcatcttctgcggtcaggcggacgagatcttacacttcaagggcaagaacatctgcccgtcctgcatcgccgagatgcagcacgcgtaa

SEQ ID NO: 356 - DNA, 243 bp, Artificial
  Substituion in SEQ ID NO 342
gtgaagtctacaggtattgtccgcaaggtggacgaactcggtcgggtggtcattcccatcgagttgcgccgcacgctcggcatcggcgagaaggatgcgctcgaaatctacgtcgatggagatcgcatcattctcaagaagtacgagccggcctgcatcttctgcggtaatgcggacgagatcatccacttcaagggcaagaacatctgcccgtcctgcatcgccgagatgcagcacgcgtaa

SEQ ID NO: 357 - DNA, 243 bp, Artificial
  Substituion in SEQ ID NO 342
gtgaagtctacaggtattgtccgcaaggtggacgaactcggtcgggtggtcattcccatcgagttgcgccgcacgctcggcatcggcgagaaggatgcgctcgaaatctacgtcgatggagatcgcatcttactcaagaagtacgagccggcctgcatcttctgcggtcaggcggacgagatcatccacttcaagggcaagaacatctgcccgtcctgcatcgccgagatgcagcacgcgtaa

SEQ ID NO: 358 - protein, 229 aa, Alicyclobacillus acidocaldarius
MRPFAGGYNLMVTIVGVRFKPAGKIYYFDPGDLPIEKGADVIVETTRGIECGRVVVGPKQVAEDDVVLPLKEVMRIATEADRAVVEENRRRAKQAMGVFREKVAKHGLEMKLVDAEYTFDRNKLIFYFTADGRVDFRELVKDLASVFRVRIELRQIGVRDEAKILGGIGPCGRLLCCSTWMGEFDPVSIRMAKDQSLSLNPSKISGLCGRLMCCLKFENDAYHDQDAMA

SEQ ID NO: 359 - DNA, 690 bp, Alicyclobacillus acidocaldarius
gtgcgtccgtttgcgggaggttacaacctcatggtgacgatagtcggcgtgcgcttcaaaccggccgggaagatttattatttcgatcccggcgatcttccgatagaaaagggcgcggacgtgatcgtcgagaccacgcgcgggattgagtgcgggcgcgtggtggtggggccgaaacaggtggcggaggacgacgtcgtcctgcctcttaaagaggtcatgcggatcgccacggaggcggaccgggcggtggtggaggagaatcgccggcgcgccaagcaggcgatgggggtgtttcgcgagaaggtggcgaagcacggcctggagatgaagctcgtggacgcggagtacacgttcgaccggaacaagctcatcttctacttcaccgccgacgggcgcgtggattttcgcgaactggtgaaagatttggccagcgtgttccgcgtgcggatcgagctccggcaaattggcgtgcgggacgaggcgaagatcctcggcggaattggcccgtgcgggcgcctgttgtgttgttccacctggatgggcgagttcgatcccgtctccatccggatggcgaaggatcagagcctgtcgctcaatccgtccaaaatctcgggcctgtgcggccgcctgatgtgttgcttgaagttcgagaacgacgcataccacgaccaggacgcgatggcgtaa

SEQ ID NO: 360 - protein, 212 aa, Geobacillus kaustophilus HTA426
MYTVVGVRFKKAGKIYYFDPGDAVIPVGEFVIVETVRGIEYGKVVIANKQVDENDIVLPLKKVIRVANEKDKWVVEENKKAAREAYDICLRKVEEHGLEMKLVDVEYTFDRNKVIFYFTADGRVDFRELVKDLASIFRTRIELRQIGVRDEAKMLGGIGPCGRMLCCSTFLGDFEPVSIKMAKDQNLSLNPTKISGLCGRLMCCLKYENEEY

SEQ ID NO: 361 - protein, 212 aa, Bacillus coagulans 36D1
MFNVVGIRFKKAGKVYYFDPGDFPVKKNDAVIVETARGIEYGFVVTNPKVVGEHDVVLPLKKIIRIADQKDHMTVDENKAAAKEAYGICMKKIAEHQLEMKLVDVEYTFDRNKIIFYFTADGRVDFRELVKDLASIFRTRIELRQIGVRDEAKMLGGIGPCGRMLCCSTFLGDFEPVSIKMAKDQNLSLNPAKISGLCGRLMCCLKYENDEY

SEQ ID NO: 362 - protein, 212 aa, Geobacillus thermodenitrificans NG80-2
MYTVVGVRFKKAGKIYYFDPGDFVIPAGEFVIVETARGIEYGKVVIANKQVDENDIVLPLKKVIRVANEKDKWVVEENKKAAREAYDICLRKVEEHGLEMKLVDVEYTFDRNKVIFYFTADGRVDFRELVKDLASIFRTRIELRQIGVRDEAKMLGGIGPCGRMLCCSTFLGDFEPVSIKMAKDQNLSLNPTKISGLCGRLMCCLKYESEEY

SEQ ID NO: 363 - protein, 212 aa, Bacillus sp. NRRL B-14911
MYDVVGVRFKKAGKIYYFDPGDLSIQKDDFVIVETVRGVEYGKVVIARKQVDENDVVLPLKKVLRIADQKDRMIVEENKEAAHEAYEVCCEKVSTHQLDMKLVDVEYTFDRNKVIFYFTADGRVDFRELVKDLAAIFRTRIELRQIGVRDEAKMLGGIGPCGRMLCCSTFLGDFDPVSIKMAKDQNLSLNPTKISGLCGRLMCCLKYENDEY

SEQ ID NO: 364 - protein, 212 aa, Bacillus weihenstephanensis KBAB4
MYDVVGVRFKKAGKVYYFDPNQFDISENEFVIVETVRGIEYGKVVITKKQVDENDVVLPLKKVIRIANENDRTIVEENRHAAKEAYQVCQQKVGEHNLDMKLVDVEYTFDRNKIIFYFTADGRIDFRELVKDLAAIFRTRIELRQIGVRDEAKMLGGIGPCGRMLCCSTFLGDFEPVSIKMAKDQNLSLNPAKISGLCGRLMCCLKYENDEY

SEQ ID NO: 365 - protein, 229 aa, Artificial
  Substituion in SEQ ID NO 358
MRPFAGGYNLMVTIVGVRFKPAGKIYYFDPGDLPIEKGADVIVETTRGIECGRVVVGPKQVAEDDVVLPLKEVMRIATEADRAVVEENRRRAKQAMGVFREKVAKHGLEMKLVDAEYTFDRNKLIFYFTADGRVDFRELVKDLASVFRVRIELRQIGVRDEAKILGGIGPCGRLLCCSTWMGEFDPVSIRMAKDQSLSLNPSKISGLCGRLMCCLKFENDAYHDNDAMA

SEQ ID NO: 366 - protein, 229 aa, Artificial
  Substituion in SEQ ID NO 358
MRPFAGGYNLMVTIVGVRFKPAGKIYYFDPGDLPIEKGADVIVETTRGIECGRVVVGPKQVAEDDVVLPLKEVMRIATEADRAVVEENRKRAKQAMGVFREKVAKHGLEMKLVDAEYTFDRNKLIFYFTADGRVDFRELVKDLASVFRVRIELRQIGVRDEAKILGGIGPCGRLLCCSTWMGEFDPVSIRMAKDQSLSLNPSKISGLCGRLMCCLKFENDAYHDQDAMA

SEQ ID NO: 367 - protein, 229 aa, Artificial
  Substituion in SEQ ID NO 358
MRPFAGGYNLMVTIVGVRFKPAGKIYYFDPGELPIEKGADVIVETTRGIECGRVVVGPKQVAEDDVVLPLKEVMRIATEADRAVVEENRRRAKQAMGVFREKVAKHGLEMKLVDAEYTFDRNKLIFYFTADGRVDFRELVKDLASVFRVRIELRQIGVRDEAKILGGIGPCGRLLCCSTWMGEFDPVSIRMAKDQSLSLNPSKISGLCGRLMCCLKFENDAYHDQDAMA

SEQ ID NO: 368 - protein, 229 aa, Artificial
  Substituion in SEQ ID NO 358
MRPFAGGYNLMVTIVGVRFKPAGKIYYFDPGDLPIEKGADVIVETTRGIECGRVVVGPKQVAEDDVVLPLKEVMRIATEADRAVVEENRRRARQAMGVFREKVAKHGLEMKLVDAEYTFDRNKLIFYFTADGRVDFRELVKDLASVFRVRIELRQIGVRDEAKILGGIGPCGRLLCCSTWMGEFDPVSIRMAKDQSLSLNPSKISGLCGRLMCCLKFENDAYHDQDAMA

SEQ ID NO: 369 - protein, 229 aa, Artificial
  Substituion in SEQ ID NO 358
MRPFAGGYNLMVTIVGVRFKPAGKIYYFDPGDLPIDKGADVIVETTRGIECGRVVVGPKQVAEDDVVLPLKEVMRIATEADRAVVEENRRRAKQAMGVFREKVAKHGLEMKLVDAEYTFDRNKLIFYFTADGRVDFRELVKDLASVFRVRIELRQIGVRDEAKILGGIGPCGRLLCCSTWMGEFDPVSIRMAKDQSLSLNPSKISGLCGRLMCCLKFENDAYHDQDAMA

SEQ ID NO: 370 - DNA, 690 bp, Artificial
  Substituion in SEQ ID NO 359
gtgcgtccgtttgcgggaggttacaacctcatggtgacgatagtcggcgtgcgcttcaaaccggccgggaagatttattatttcgatcccggcgatcttccgatagaaaagggcgcggacgtgatcgtcgagaccacgcgcgggattgagtgcgggcgcgtggtggtggggccgaaacaggtggcggaggacgacgtcgtcctgcctcttaaagaggtcatgcggatcgccacggaggcggaccgggcggtggtggaggagaatcgccggcgcgccaagcaggcgatgggggtgtttcgcgagaaggtggcgaagcacggcctggagatgaagctcgtggacgcggagtacacgttcgaccggaacaagctcatcttctacttcaccgccgacgggcgcgtggattttcgcgaactggtgaaagatttggccagcgtgttccgcgtgcggatcgagctccggcaaattggcgtgcgggacgaggcgaagatcctcggcggaattggcccgtgcgggcgcctgttgtgttgttccacctggatgggcgagttcgatcccgtctccatccggatggcgaaggatcagagcctgtcgctcaatccgtccaaaatctcgggcctgtgcggccgcctgatgtgttgcttgaagttcgagaacgacgcataccacgacaatgacgcgatggcgtaa

SEQ ID NO: 371 - DNA, 690 bp, Artificial
  Substituion in SEQ ID NO 359
gtgcgtccgtttgcgggaggttacaacctcatggtgacgatagtcggcgtgcgcttcaaaccggccgggaagatttattatttcgatcccggcgatcttccgatagaaaagggcgcggacgtgatcgtcgagaccacgcgcgggattgagtgcgggcgcgtggtggtggggccgaaacaggtggcggaggacgacgtcgtcctgcctcttaaagaggtcatgcggatcgccacggaggcggaccgggcggtggtggaggagaatcgcaaacgcgccaagcaggcgatgggggtgtttcgcgagaaggtggcgaagcacggcctggagatgaagctcgtggacgcggagtacacgttcgaccggaacaagctcatcttctacttcaccgccgacgggcgcgtggattttcgcgaactggtgaaagatttggccagcgtgttccgcgtgcggatcgagctccggcaaattggcgtgcgggacgaggcgaagatcctcggcggaattggcccgtgcgggcgcctgttgtgttgttccacctggatgggcgagttcgatcccgtctccatccggatggcgaaggatcagagcctgtcgctcaatccgtccaaaatctcgggcctgtgcggccgcctgatgtgttgcttgaagttcgagaacgacgcataccacgaccaggacgcgatggcgtaa

SEQ ID NO: 372 - DNA, 690 bp, Artificial
  Substituion in SEQ ID NO 359
gtgcgtccgtttgcgggaggttacaacctcatggtgacgatagtcggcgtgcgcttcaaaccggccgggaagatttattatttcgatcccggcgaacttccgatagaaaagggcgcggacgtgatcgtcgagaccacgcgcgggattgagtgcgggcgcgtggtggtggggccgaaacaggtggcggaggacgacgtcgtcctgcctcttaaagaggtcatgcggatcgccacggaggcggaccgggcggtggtggaggagaatcgccggcgcgccaagcaggcgatgggggtgtttcgcgagaaggtggcgaagcacggcctggagatgaagctcgtggacgcggagtacacgttcgaccggaacaagctcatcttctacttcaccgccgacgggcgcgtggattttcgcgaactggtgaaagatttggccagcgtgttccgcgtgcggatcgagctccggcaaattggcgtgcgggacgaggcgaagatcctcggcggaattggcccgtgcgggcgcctgttgtgttgttccacctggatgggcgagttcgatcccgtctccatccggatggcgaaggatcagagcctgtcgctcaatccgtccaaaatctcgggcctgtgcggccgcctgatgtgttgcttgaagttcgagaacgacgcataccacgaccaggacgcgatggcgtaa

SEQ ID NO: 373 - DNA, 690 bp, Artificial
  Substituion in SEQ ID NO 359
gtgcgtccgtttgcgggaggttacaacctcatggtgacgatagtcggcgtgcgcttcaaaccggccgggaagatttattatttcgatcccggcgatcttccgatagaaaagggcgcggacgtgatcgtcgagaccacgcgcgggattgagtgcgggcgcgtggtggtggggccgaaacaggtggcggaggacgacgtcgtcctgcctcttaaagaggtcatgcggatcgccacggaggcggaccgggcggtggtggaggagaatcgccggcgcgcccgtcaggcgatgggggtgtttcgcgagaaggtggcgaagcacggcctggagatgaagctcgtggacgcggagtacacgttcgaccggaacaagctcatcttctacttcaccgccgacgggcgcgtggattttcgcgaactggtgaaagatttggccagcgtgttccgcgtgcggatcgagctccggcaaattggcgtgcgggacgaggcgaagatcctcggcggaattggcccgtgcgggcgcctgttgtgttgttccacctggatgggcgagttcgatcccgtctccatccggatggcgaaggatcagagcctgtcgctcaatccgtccaaaatctcgggcctgtgcggccgcctgatgtgttgcttgaagttcgagaacgacgcataccacgaccaggacgcgatggcgtaa

SEQ ID NO: 374 - DNA, 690 bp, Artificial
  Substituion in SEQ ID NO 359
gtgcgtccgtttgcgggaggttacaacctcatggtgacgatagtcggcgtgcgcttcaaaccggccgggaagatttattatttcgatcccggcgatcttccgatagataagggcgcggacgtgatcgtcgagaccacgcgcgggattgagtgcgggcgcgtggtggtggggccgaaacaggtggcggaggacgacgtcgtcctgcctcttaaagaggtcatgcggatcgccacggaggcggaccgggcggtggtggaggagaatcgccggcgcgccaagcaggcgatgggggtgtttcgcgagaaggtggcgaagcacggcctggagatgaagctcgtggacgcggagtacacgttcgaccggaacaagctcatcttctacttcaccgccgacgggcgcgtggattttcgcgaactggtgaaagatttggccagcgtgttccgcgtgcggatcgagctccggcaaattggcgtgcgggacgaggcgaagatcctcggcggaattggcccgtgcgggcgcctgttgtgttgttccacctggatgggcgagttcgatcccgtctccatccggatggcgaaggatcagagcctgtcgctcaatccgtccaaaatctcgggcctgtgcggccgcctgatgtgttgcttgaagttcgagaacgacgcataccacgaccaggacgcgatggcgtaa

SEQ ID NO: 375 - protein, 339 aa, Alicyclobacillus acidocaldarius
MTTIYDIARRAGVSATTVSKVLNGYPDVSQKTREKVQRITRELGYQPNAAARGLVTRRSMSIGVFFQDDARMGFRHPFLHDIVASFQDVVGESGYDLLFFSRTTPPNAPQGFEARARHRGVDGLFLLGIPRTSPGLPSLVRSRIPIVSVDLDLFGPRASWLSSDNVGGARLAVEHLAAMGHTKIGFVGDRYGTKPGQDRALGYHMAMQELGLTFRSEWVAEGDFMEESGEEAMHRILEAREWPTAVFFASDMMAIGAMKALRQRGLEPGRDISLVGFDDVAIARLVTPSLTTIRQNTRAMGEEAARELLDLMQNPNRPPRVITIPVELVSRDSVARIGG

SEQ ID NO: 376 - DNA, 1020 bp, Alicyclobacillus acidocaldarius
atgaccacaatctacgatatcgcgcgccgggctggcgtgtccgccaccacggtgtccaaggtgctgaacggctatcccgacgtgagtcaaaagacccgcgagaaggtgcagcgcatcacgcgcgaattggggtatcaaccgaacgcggcggcccgcggtctcgtcacgcgccgctccatgtccatcggcgtgttctttcaagacgacgcccgaatgggttttcggcatccgttcctccacgacatcgtcgccagcttccaggacgtcgtcggcgaaagcggctacgatctcctcttcttctcccggaccacacctcccaacgcgccccagggttttgaggcgcgggcccgccatcgcggcgtggacggcctgttcttgctcggcattccgcgcacgtcgccgggacttccttcacttgtccgcagccgcattcccatcgtgtcggtcgatctcgacctgttcggcccgagggcgagctggctgtcgtccgacaatgtcggcggggcgaggctcgccgtcgagcacctcgccgccatggggcacaccaagatcggctttgtcggggatcgctacgggaccaagccggggcaggatcgcgcgctcggctatcacatggccatgcaggagttagggcttacgtttcgaagcgagtgggtcgcggagggagatttcatggaggagtcgggcgaagaggccatgcaccggattctcgaggcgcgcgagtggccgaccgccgtctttttcgcttcggacatgatggccatcggcgcgatgaaggcactgcgccaaaggggcctcgagccggggcgggacatctccctcgtgggtttcgacgacgtggccattgcccggctcgtgacgccctccttgacgacgattcggcagaacacgcgcgccatgggcgaggaggcggcgcgcgaactgcttgatctcatgcagaatccgaatcgccccccgcgcgtcatcaccattccggtcgaactggtctcgcgagacagcgtggcgcgaatcggtggatga

SEQ ID NO: 377 - protein, 336 aa, Halothermothrix orenii H 168
MATIKDIAKLAGVSVTTVSKVINNYPDISDKTKEKVIKIMEQQNYRPNAIARSLSTSRSRSIGVFFTDHLNSGLRHPFFRDIIYGIEKTFFRKGYDLILFAHQWGDRFSYTEKCKSRHVDGAILMGMPRTDPNLDKLVNSNIPTVFIDLDIVGKNATYVISDNVQGAKQAVNYLYSLGHIKIGMIMGQRITKPAQDRLIGFQEELTNLGLEYNPEWIIEAEFGEEGGYQAMKRIITQEIRPSAVFCQGDEMAIGAINAIKEHGYNVPQDFSIVGFDNIEISSYVSPGLTTIHQDKLTMGKKAASILLEMINNPNKTFSPVVLPTKLIERESCRKIG

SEQ ID NO: 378 - protein, 335 aa, Halothermothrix orenii H 168
MATIKDIAKIAGVSTATVSRVINNYPDVSEKTKKKILKIMKENNYRPNSVARSLSTSKSNIIGIFFTDHFNTGIHHPFFREVIYGLEKIFDEKGYDILYFTNRKWGENFSYVEKCHDRQVDGVVLMGVPKTDSNIPKLLDSDIPTVFVDLDIVGKKASYVISDNYRGAEMAVNYLHSLGHTRIGMIMGISSTKVTNDRLLGYQTAIKNLGLVYNSQWILDGRYTEEGGYQAMSKYLEMDERPTAIFCQSDSMAIGAMQAIHEAGMSVPEDFSLIGFDDIEVSRYVNPALTTIKQDKIGLGRAAGELLINIVENENESQAPVILPVELVKRDSCGR

SEQ ID NO: 379 - protein, 336 aa, Halothermothrix orenii H 168
MVTIKDIARIAGVSTATVSRVINNYPQVNEKTKKKVLEVMKENNYRPNSVARSLSTSRSYTIGIFFTDHFDTGLRHPFFREVIYGLEKIFGQKGYDILYFTKRNWDDKCSYVDKCRDRHVDGVVLMGVSREDTNLPQLLDSGIPTVFIDVDIIGKRASYVTLNNTDGAKMAVNYLYSLGHTKIGMIMGISSTKIAHDRFLGYQMALKDLSLSYNPDWVLNGLFSEEGGYRAMNKFLKMIDRPTAIFCQSDTMAIGAMKAIKEAKMNVPGDFSIIGFDDIEISKYVKPALTTIRQDKVKLGRAAGKLLLNIINNDLDGYKPVILPVKLIKRKSCAKL

SEQ ID NO: 380 - protein, 335 aa, Bacillus halodurans C-125
MATIYDIAKKTGYSITTVSKVLNNYTDVSDKARKKVMDAVTEMGYFPSSSARMLTTKKSWTIGVVFVESAGIGMEHPFFSSVIENFKKNVERFGYDLLFASNQIGNEAKTYLEHFRYRGVDGIVVVCSLLNDPEVEKLMKADIPSVVIDLDSKGSSAVYSDNEYGSELAVDYLVSLGHRSIAHISGDQGLFVGVQRLKGFKDAIQKLNLSISDEYIVDGGFFTYEGGQRAMEALLRNRVRPTAVYAAGDLMALGAIDTIRKHGLSVPEDFSIVGFDDIQMIRYTAPALTTIRQNTDLIGKTAANLLLDQINENEKQSLSVKIPVTLIERDSCRKI

SEQ ID NO: 381 - protein, 335 aa, Bacillus halodurans C-125
MTTIKDIAKVAGVSVTTVSRALNGYSDVNEKTRKKIKDIANELKYSPNVMARSLVMNRSKTIGLLVSEISREGAKDNFTFEVLCGINDRASESDYDIILFNTNTSKQKLKSYTQLCRERCVDGVILQGIKKEDPYLEEVIESDIPCVMVDIPITGESVSYVTTDNVDGAKKAVETLIDFGHRKIAMMNGHERAYVSGKRKLGYEQALQEAGIPLQEEWVLNGEFSEQVAEKEAYQFLQKHSDVTAFFCASDLMALGVMKAAKLLNLRLPEQLSVIGFDDILLAQYTSPPLTTVAQNKYQMGYAAAGLLIDRLRMKEVPPFHMLDNELIIRESVAK

SEQ ID NO: 382 - protein, 339 aa, Artificial
  Substituion in SEQ ID NO 375
MTTIYDIARRAGVSATTVSKVLNGYPDVSQKTREKVQRITRELGYQPNAAARGLVTRRSMSIGVFFQDDARMGFRHPFLHDIVASFQDVVGESGYDLLFFSRTTPPNAPQGFEARARHRGVDGLFLLGIPRTSPGLPSLVRSRIPIVSVDLDLFGPRASWLSSDNVGGARLAVEHLAAMGHTKIGFVGDRYGTKPGQDRALGYHMAMQELGLTFRSEWVADGDFMEESGEEAMHRILEAREWPTAVFFASDMMAIGAMKALRQRGLEPGRDISLVGFDDVAIARLVTPSLTTIRQNTRAMGEEAARELLDLMQNPNRPPRVITIPVELVSRDSVARIGG

SEQ ID NO: 383 - protein, 339 aa, Artificial
  Substituion in SEQ ID NO 375
MTTIYDIARRAGVSATTVSKVLNGYPDVSQKTREKVQKITRELGYQPNAAARGLVTRRSMSIGVFFQDDARMGFRHPFLHDIVASFQDVVGESGYDLLFFSRTTPPNAPQGFEARARHRGVDGLFLLGIPRTSPGLPSLVRSRIPIVSVDLDLFGPRASWLSSDNVGGARLAVEHLAAMGHTKIGFVGDRYGTKPGQDRALGYHMAMQELGLTFRSEWVAEGDFMEESGEEAMHRILEAREWPTAVFFASDMMAIGAMKALRQRGLEPGRDISLVGFDDVAIARLVTPSLTTIRQNTRAMGEEAARELLDLMQNPNRPPRVITIPVELVSRDSVARIGG

SEQ ID NO: 384 - protein, 339 aa, Artificial
  Substituion in SEQ ID NO 375
MTTIYDIARRAGVSATTVSKVLNGYPDVSQKTREKIQRITRELGYQPNAAARGLVTRRSMSIGVFFQDDARMGFRHPFLHDIVASFQDVVGESGYDLLFFSRTTPPNAPQGFEARARHRGVDGLFLLGIPRTSPGLPSLVRSRIPIVSVDLDLFGPRASWLSSDNVGGARLAVEHLAAMGHTKIGFVGDRYGTKPGQDRALGYHMAMQELGLTFRSEWVAEGDFMEESGEEAMHRILEAREWPTAVFFASDMMAIGAMKALRQRGLEPGRDISLVGFDDVAIARLVTPSLTTIRQNTRAMGEEAARELLDLMQNPNRPPRVITIPVELVSRDSVARIGG

SEQ ID NO: 385 - protein, 339 aa, Artificial
  Substituion in SEQ ID NO 375
MTTIYDIARRAGVSATTVSKVLNGYPDVSQKTREKVQRLTRELGYQPNAAARGLVTRRSMSIGVFFQDDARMGFRHPFLHDIVASFQDVVGESGYDLLFFSRTTPPNAPQGFEARARHRGVDGLFLLGIPRTSPGLPSLVRSRIPIVSVDLDLFGPRASWLSSDNVGGARLAVEHLAAMGHTKIGFVGDRYGTKPGQDRALGYHMAMQELGLTFRSEWVAEGDFMEESGEEAMHRILEAREWPTAVFFASDMMAIGAMKALRQRGLEPGRDISLVGFDDVAIARLVTPSLTTIRQNTRAMGEEAARELLDLMQNPNRPPRVITIPVELVSRDSVARIGG

SEQ ID NO: 386 - protein, 339 aa, Artificial
  Substituion in SEQ ID NO 375
MTTIYDIARRAGVSATTVSKVLNGYPDVSQKTREKVQRITRELGYQPNAAARGLVTRRSMSIGVFFQDDARMGFRHPFLHDIVASFQDIVGESGYDLLFFSRTTPPNAPQGFEARARHRGVDGLFLLGIPRTSPGLPSLVRSRIPIVSVDLDLFGPRASWLSSDNVGGARLAVEHLAAMGHTKIGFVGDRYGTKPGQDRALGYHMAMQELGLTFRSEWVAEGDFMEESGEEAMHRILEAREWPTAVFFASDMMAIGAMKALRQRGLEPGRDISLVGFDDVAIARLVTPSLTTIRQNTRAMGEEAARELLDLMQNPNRPPRVITIPVELVSRDSVARIGG

SEQ ID NO: 387 - DNA, 1020 bp, Artificial
  Substituion in SEQ ID NO 376
atgaccacaatctacgatatcgcgcgccgggctggcgtgtccgccaccacggtgtccaaggtgctgaacggctatcccgacgtgagtcaaaagacccgcgagaaggtgcagcgcatcacgcgcgaattggggtatcaaccgaacgcggcggcccgcggtctcgtcacgcgccgctccatgtccatcggcgtgttctttcaagacgacgcccgaatgggttttcggcatccgttcctccacgacatcgtcgccagcttccaggacgtcgtcggcgaaagcggctacgatctcctcttcttctcccggaccacacctcccaacgcgccccagggttttgaggcgcgggcccgccatcgcggcgtggacggcctgttcttgctcggcattccgcgcacgtcgccgggacttccttcacttgtccgcagccgcattcccatcgtgtcggtcgatctcgacctgttcggcccgagggcgagctggctgtcgtccgacaatgtcggcggggcgaggctcgccgtcgagcacctcgccgccatggggcacaccaagatcggctttgtcggggatcgctacgggaccaagccggggcaggatcgcgcgctcggctatcacatggccatgcaggagttagggcttacgtttcgaagcgagtgggtcgcggatggagatttcatggaggagtcgggcgaagaggccatgcaccggattctcgaggcgcgcgagtggccgaccgccgtctttttcgcttcggacatgatggccatcggcgcgatgaaggcactgcgccaaaggggcctcgagccggggcgggacatctccctcgtgggtttcgacgacgtggccattgcccggctcgtgacgccctccttgacgacgattcggcagaacacgcgcgccatgggcgaggaggcggcgcgcgaactgcttgatctcatgcagaatccgaatcgccccccgcgcgtcatcaccattccggtcgaactggtctcgcgagacagcgtggcgcgaatcggtggatga

SEQ ID NO: 388 - DNA, 1020 bp, Artificial
  Substituion in SEQ ID NO 376
atgaccacaatctacgatatcgcgcgccgggctggcgtgtccgccaccacggtgtccaaggtgctgaacggctatcccgacgtgagtcaaaagacccgcgagaaggtgcagaaaatcacgcgcgaattggggtatcaaccgaacgcggcggcccgcggtctcgtcacgcgccgctccatgtccatcggcgtgttctttcaagacgacgcccgaatgggttttcggcatccgttcctccacgacatcgtcgccagcttccaggacgtcgtcggcgaaagcggctacgatctcctcttcttctcccggaccacacctcccaacgcgccccagggttttgaggcgcgggcccgccatcgcggcgtggacggcctgttcttgctcggcattccgcgcacgtcgccgggacttccttcacttgtccgcagccgcattcccatcgtgtcggtcgatctcgacctgttcggcccgagggcgagctggctgtcgtccgacaatgtcggcggggcgaggctcgccgtcgagcacctcgccgccatggggcacaccaagatcggctttgtcggggatcgctacgggaccaagccggggcaggatcgcgcgctcggctatcacatggccatgcaggagttagggcttacgtttcgaagcgagtgggtcgcggagggagatttcatggaggagtcgggcgaagaggccatgcaccggattctcgaggcgcgcgagtggccgaccgccgtctttttcgcttcggacatgatggccatcggcgcgatgaaggcactgcgccaaaggggcctcgagccggggcgggacatctccctcgtgggtttcgacgacgtggccattgcccggctcgtgacgccctccttgacgacgattcggcagaacacgcgcgccatgggcgaggaggcggcgcgcgaactgcttgatctcatgcagaatccgaatcgccccccgcgcgtcatcaccattccggtcgaactggtctcgcgagacagcgtggcgcgaatcggtggatga

SEQ ID NO: 389 - DNA, 1020 bp, Artificial
  Substituion in SEQ ID NO 376
atgaccacaatctacgatatcgcgcgccgggctggcgtgtccgccaccacggtgtccaaggtgctgaacggctatcccgacgtgagtcaaaagacccgcgagaagattcagcgcatcacgcgcgaattggggtatcaaccgaacgcggcggcccgcggtctcgtcacgcgccgctccatgtccatcggcgtgttctttcaagacgacgcccgaatgggttttcggcatccgttcctccacgacatcgtcgccagcttccaggacgtcgtcggcgaaagcggctacgatctcctcttcttctcccggaccacacctcccaacgcgccccagggttttgaggcgcgggcccgccatcgcggcgtggacggcctgttcttgctcggcattccgcgcacgtcgccgggacttccttcacttgtccgcagccgcattcccatcgtgtcggtcgatctcgacctgttcggcccgagggcgagctggctgtcgtccgacaatgtcggcggggcgaggctcgccgtcgagcacctcgccgccatggggcacaccaagatcggctttgtcggggatcgctacgggaccaagccggggcaggatcgcgcgctcggctatcacatggccatgcaggagttagggcttacgtttcgaagcgagtgggtcgcggagggagatttcatggaggagtcgggcgaagaggccatgcaccggattctcgaggcgcgcgagtggccgaccgccgtctttttcgcttcggacatgatggccatcggcgcgatgaaggcactgcgccaaaggggcctcgagccggggcgggacatctccctcgtgggtttcgacgacgtggccattgcccggctcgtgacgccctccttgacgacgattcggcagaacacgcgcgccatgggcgaggaggcggcgcgcgaactgcttgatctcatgcagaatccgaatcgccccccgcgcgtcatcaccattccggtcgaactggtctcgcgagacagcgtggcgcgaatcggtggatga

SEQ ID NO: 390 - DNA, 1020 bp, Artificial
  Substituion in SEQ ID NO 376
atgaccacaatctacgatatcgcgcgccgggctggcgtgtccgccaccacggtgtccaaggtgctgaacggctatcccgacgtgagtcaaaagacccgcgagaaggtgcagcgcttaacgcgcgaattggggtatcaaccgaacgcggcggcccgcggtctcgtcacgcgccgctccatgtccatcggcgtgttctttcaagacgacgcccgaatgggttttcggcatccgttcctccacgacatcgtcgccagcttccaggacgtcgtcggcgaaagcggctacgatctcctcttcttctcccggaccacacctcccaacgcgccccagggttttgaggcgcgggcccgccatcgcggcgtggacggcctgttcttgctcggcattccgcgcacgtcgccgggacttccttcacttgtccgcagccgcattcccatcgtgtcggtcgatctcgacctgttcggcccgagggcgagctggctgtcgtccgacaatgtcggcggggcgaggctcgccgtcgagcacctcgccgccatggggcacaccaagatcggctttgtcggggatcgctacgggaccaagccggggcaggatcgcgcgctcggctatcacatggccatgcaggagttagggcttacgtttcgaagcgagtgggtcgcggagggagatttcatggaggagtcgggcgaagaggccatgcaccggattctcgaggcgcgcgagtggccgaccgccgtctttttcgcttcggacatgatggccatcggcgcgatgaaggcactgcgccaaaggggcctcgagccggggcgggacatctccctcgtgggtttcgacgacgtggccattgcccggctcgtgacgccctccttgacgacgattcggcagaacacgcgcgccatgggcgaggaggcggcgcgcgaactgcttgatctcatgcagaatccgaatcgccccccgcgcgtcatcaccattccggtcgaactggtctcgcgagacagcgtggcgcgaatcggtggatga

SEQ ID NO: 391 - DNA, 1020 bp, Artificial
  Substituion in SEQ ID NO 376
atgaccacaatctacgatatcgcgcgccgggctggcgtgtccgccaccacggtgtccaaggtgctgaacggctatcccgacgtgagtcaaaagacccgcgagaaggtgcagcgcatcacgcgcgaattggggtatcaaccgaacgcggcggcccgcggtctcgtcacgcgccgctccatgtccatcggcgtgttctttcaagacgacgcccgaatgggttttcggcatccgttcctccacgacatcgtcgccagcttccaggacattgtcggcgaaagcggctacgatctcctcttcttctcccggaccacacctcccaacgcgccccagggttttgaggcgcgggcccgccatcgcggcgtggacggcctgttcttgctcggcattccgcgcacgtcgccgggacttccttcacttgtccgcagccgcattcccatcgtgtcggtcgatctcgacctgttcggcccgagggcgagctggctgtcgtccgacaatgtcggcggggcgaggctcgccgtcgagcacctcgccgccatggggcacaccaagatcggctttgtcggggatcgctacgggaccaagccggggcaggatcgcgcgctcggctatcacatggccatgcaggagttagggcttacgtttcgaagcgagtgggtcgcggagggagatttcatggaggagtcgggcgaagaggccatgcaccggattctcgaggcgcgcgagtggccgaccgccgtctttttcgcttcggacatgatggccatcggcgcgatgaaggcactgcgccaaaggggcctcgagccggggcgggacatctccctcgtgggtttcgacgacgtggccattgcccggctcgtgacgccctccttgacgacgattcggcagaacacgcgcgccatgggcgaggaggcggcgcgcgaactgcttgatctcatgcagaatccgaatcgccccccgcgcgtcatcaccattccggtcgaactggtctcgcgagacagcgtggcgcgaatcggtggatga

SEQ ID NO: 392 - protein, 164 aa, Alicyclobacillus acidocaldarius
MNDALRLKICDLLHENAKLSAETIARMLGETPDVIESTIRELEEEKVILRYSAVVNWDKLPVNQVTAVIDVKVLPQREVGFDAIARKIYRFDEVKSVALMSGGYDLQVTVVGRDLREVSRFVSEKLATLENVTSTATHFLLKTYKSDGVIYDDTDGERRLMITP

SEQ ID NO: 393 - DNA, 495 bp, Alicyclobacillus acidocaldarius
atgaacgacgcgctgcgcctgaaaatctgcgatcttcttcacgaaaacgccaaactcagcgccgagaccatcgcacgcatgctcggcgagacgccggacgtgatcgaaagcaccatccgagagctcgaggaggaaaaggtcatcctacgctactcggccgtcgtcaactgggataagctccctgtcaatcaggtgacggccgtgatcgacgtcaaggtgctcccccagcgggaggtcggcttcgacgccatcgcgcgcaagatctaccggttcgacgaggtgaagtccgtcgccctgatgtcggggggctacgaccttcaggtgacggtcgtcgggcgagatctccgtgaagtgtcccggttcgtttccgagaaactggcgacgctcgaaaacgtcacatccacggcgacgcacttcctgctcaagacgtacaagtcggatggcgtcatctacgacgacacagatggagaaaggcgactgatgatcacgccatga

SEQ ID NO: 394 - protein, 160 aa, Moorella thermoacetica ATCC 39073
MRKKILDLLENNGRLTAKEIAIMLALPVDQVAKEIAAMEQEKIILRYHTLINWEKAGEEEVAALIDVKVIPQRDLGFDEIASRIYRYPEVKSVFLMSGGYDLSVLVQGKSLKEVASFVSQKLATLEHVQSTMTHFILKRYKQDGVIFEDQEADRRQALQP

SEQ ID NO: 395 - protein, 157 aa, Carboxydothermus hydrogenoformans Z-2901
EILQLLHENAKLTPKQIATMLGVTEKEVRAKIKELEERKAIIKYHTLINWEKTEYEPVMALIEVKVTPQREVGFDGIARRIYQFAEVKDVYLMSGDYDLAVMVEGSSMKEVALFVALKLSTIEGVQSCATHFILKTYKHEGVILDDEEEDRRLVITP

SEQ ID NO: 396 - protein, 157 aa, Pelotomaculum thermopropionicum SI
EILELLEGNARLTPGQIATMLGMEEGEVTRIIKEMEEKKVILGYYTLVNWEKAGEEKVSALIEVKISPQREVGFDAVAERIYRFPEVKTVRLMSGAYDLAVMVEGQNLKEVANFVAQKLASLDNVLSTTTHFVLKTYKNQGVIVEDGEEDRRLVVTP

SEQ ID NO: 397 - protein, 162 aa, Paenibacillus larvae subsp. larvae BRL-230010
DDFKLKVLELLKEDARRGSDLIATMLGANEEQVAKAIKEMEEENIIVKYATVLNWAKVDSDKVTALIEVQITPERGTGFDAIAERIYLFPEVKAVYLMSGSYDLQVEIEGRTLQEVSSFVSTKLSTLDRVLSTKTHFILKKYKHDGIIFEDHEDDHRMLISP

SEQ ID NO: 398 - protein, 158 aa, Desulfotomaculum reducens MI-1
LEILELLQSNSRLTAKEIAVLTGQEEDEVKGIIERLEADKTIIKYFTLINWEKAGLEKVSALIEVKMSPQRDVGFDSVAERIYRFPEVKSVHLMSGAYDLAVFLEGATMKEVALFVAQKLATIDNVLSTATHFVLKTYKQDGFIFEDRENDQRLVIQP

SEQ ID NO: 399 - protein, 164 aa, Artificial
  Substituion in SEQ ID NO 392
MNDALRLKICDLLHENAKLSAETIARMLGETPDVIESTIRELEEEKVILRYSAVVNWDKLPVNQVTAVIDVKVLPQREVGFDAIARKIYRFDEVKSVALMSGGYDLQVTVVGRELREVSRFVSEKLATLENVTSTATHFLLKTYKSDGVIYDDTDGERRLMITP

SEQ ID NO: 400 - protein, 164 aa, Artificial
  Substituion in SEQ ID NO 392
MNDALRLKICDLLHENAKLSAETIARMLGETPDVIESTIRELEEEKVILRYSAVVNWDKLPVNQVTAVIDVKVLPQREVGFDAIARKIYRFDEVKSVALMSGGYDLQVTVVGRDLREVSRFVSEKLATLENVTSTATHFLLKTYKSDGVIYDDTDGEKRLMITP

SEQ ID NO: 401 - protein, 164 aa, Artificial
  Substituion in SEQ ID NO 392
MNDALRLKICDLLHENAKLSAETIARMLGETPDVIESTIRELEEEKVILRYSAVVNWDKLPVNQVTAVIDVKVLPQREVGFDAIARKIYRFDEVKSVALMSGGYDLQVTVVGRDLREVSRFVSEKLATLDNVTSTATHFLLKTYKSDGVIYDDTDGERRLMITP

SEQ ID NO: 402 - protein, 164 aa, Artificial
  Substituion in SEQ ID NO 392
MNDALRLKICDLLHENAKLSAETIARMLGETPDVIESTIREIEEEKVILRYSAVVNWDKLPVNQVTAVIDVKVLPQREVGFDAIARKIYRFDEVKSVALMSGGYDLQVTVVGRDLREVSRFVSEKLATLENVTSTATHFLLKTYKSDGVIYDDTDGERRLMITP

SEQ ID NO: 403 - protein, 164 aa, Artificial
  Substituion in SEQ ID NO 392
MNDALRLKICDLLHENAKLSAETIARMLGETPDVIESTIRELEEEKVILRYSAVVNWDKLPVNQVTAVIDVKVLPNREVGFDAIARKIYRFDEVKSVALMSGGYDLQVTVVGRDLREVSRFVSEKLATLENVTSTATHFLLKTYKSDGVIYDDTDGERRLMITP

SEQ ID NO: 404 - DNA, 495 bp, Artificial
  Substituion in SEQ ID NO 393
atgaacgacgcgctgcgcctgaaaatctgcgatcttcttcacgaaaacgccaaactcagcgccgagaccatcgcacgcatgctcggcgagacgccggacgtgatcgaaagcaccatccgagagctcgaggaggaaaaggtcatcctacgctactcggccgtcgtcaactgggataagctccctgtcaatcaggtgacggccgtgatcgacgtcaaggtgctcccccagcgggaggtcggcttcgacgccatcgcgcgcaagatctaccggttcgacgaggtgaagtccgtcgccctgatgtcggggggctacgaccttcaggtgacggtcgtcgggcgagaactccgtgaagtgtcccggttcgtttccgagaaactggcgacgctcgaaaacgtcacatccacggcgacgcacttcctgctcaagacgtacaagtcggatggcgtcatctacgacgacacagatggagaaaggcgactgatgatcacgccatga

SEQ ID NO: 405 - DNA, 495 bp, Artificial
  Substituion in SEQ ID NO 393
atgaacgacgcgctgcgcctgaaaatctgcgatcttcttcacgaaaacgccaaactcagcgccgagaccatcgcacgcatgctcggcgagacgccggacgtgatcgaaagcaccatccgagagctcgaggaggaaaaggtcatcctacgctactcggccgtcgtcaactgggataagctccctgtcaatcaggtgacggccgtgatcgacgtcaaggtgctcccccagcgggaggtcggcttcgacgccatcgcgcgcaagatctaccggttcgacgaggtgaagtccgtcgccctgatgtcggggggctacgaccttcaggtgacggtcgtcgggcgagatctccgtgaagtgtcccggttcgtttccgagaaactggcgacgctcgaaaacgtcacatccacggcgacgcacttcctgctcaagacgtacaagtcggatggcgtcatctacgacgacacagatggagaaaaacgactgatgatcacgccatga

SEQ ID NO: 406 - DNA, 495 bp, Artificial
  Substituion in SEQ ID NO 393
atgaacgacgcgctgcgcctgaaaatctgcgatcttcttcacgaaaacgccaaactcagcgccgagaccatcgcacgcatgctcggcgagacgccggacgtgatcgaaagcaccatccgagagctcgaggaggaaaaggtcatcctacgctactcggccgtcgtcaactgggataagctccctgtcaatcaggtgacggccgtgatcgacgtcaaggtgctcccccagcgggaggtcggcttcgacgccatcgcgcgcaagatctaccggttcgacgaggtgaagtccgtcgccctgatgtcggggggctacgaccttcaggtgacggtcgtcgggcgagatctccgtgaagtgtcccggttcgtttccgagaaactggcgacgctcgataacgtcacatccacggcgacgcacttcctgctcaagacgtacaagtcggatggcgtcatctacgacgacacagatggagaaaggcgactgatgatcacgccatga

SEQ ID NO: 407 - DNA, 495 bp, Artificial
  Substituion in SEQ ID NO 393
atgaacgacgcgctgcgcctgaaaatctgcgatcttcttcacgaaaacgccaaactcagcgccgagaccatcgcacgcatgctcggcgagacgccggacgtgatcgaaagcaccatccgagagattgaggaggaaaaggtcatcctacgctactcggccgtcgtcaactgggataagctccctgtcaatcaggtgacggccgtgatcgacgtcaaggtgctcccccagcgggaggtcggcttcgacgccatcgcgcgcaagatctaccggttcgacgaggtgaagtccgtcgccctgatgtcggggggctacgaccttcaggtgacggtcgtcgggcgagatctccgtgaagtgtcccggttcgtttccgagaaactggcgacgctcgaaaacgtcacatccacggcgacgcacttcctgctcaagacgtacaagtcggatggcgtcatctacgacgacacagatggagaaaggcgactgatgatcacgccatga

SEQ ID NO: 408 - DNA, 495 bp, Artificial
  Substituion in SEQ ID NO 393
atgaacgacgcgctgcgcctgaaaatctgcgatcttcttcacgaaaacgccaaactcagcgccgagaccatcgcacgcatgctcggcgagacgccggacgtgatcgaaagcaccatccgagagctcgaggaggaaaaggtcatcctacgctactcggccgtcgtcaactgggataagctccctgtcaatcaggtgacggccgtgatcgacgtcaaggtgctccccaatcgggaggtcggcttcgacgccatcgcgcgcaagatctaccggttcgacgaggtgaagtccgtcgccctgatgtcggggggctacgaccttcaggtgacggtcgtcgggcgagatctccgtgaagtgtcccggttcgtttccgagaaactggcgacgctcgaaaacgtcacatccacggcgacgcacttcctgctcaagacgtacaagtcggatggcgtcatctacgacgacacagatggagaaaggcgactgatgatcacgccatga

SEQ ID NO: 409 - protein, 200 aa, Alicyclobacillus acidocaldarius
MDRRVQKSRQAIRDAFVALMKEKDFDHITVQDITERANVSRKTFYLHFLDKYDLLDRVMEDAIRDMDEFGQCVSELDWVPATEQCFQYLADRYDFFGTMLTQAGAPYFRRRYVESCKASFTREIRRVVGRDPLPEEDAILQFVVNAYVGTVEWWLQEGMPYPPRVMADRIGRMLESVYTQLPSLAEKPASPRETSQVRPA

SEQ ID NO: 410 - DNA, 603 bp, Alicyclobacillus acidocaldarius
ttggaccggcgcgtgcagaagtcgcggcaggccattcgggatgcctttgtggctttgatgaaggagaaggatttcgaccacatcaccgtgcaggatatcacagagcgcgcaaacgtcagtcgcaagaccttctacctgcacttcctcgacaaatacgacctgctcgatcgcgtcatggaagacgccattcgcgacatggacgagttcggccaatgcgtctccgagctcgattgggtccccgccacggagcagtgctttcagtacctggcggatcgatacgatttcttcggcaccatgctgacccaggccggcgctccctactttcgccgccgctacgtcgagtcgtgcaaggcgtccttcacgcgggagatccggcgcgtggtgggaagggatccgctgcccgaggaagacgccattctgcagtttgtcgtgaacgcctacgtgggcacggtggaatggtggctgcaggaggggatgccgtatccgcctcgggtgatggcggatcggattgggcgaatgctcgaatcggtatacacccaactcccatccctcgccgaaaagcccgcgtcgccgcgcgagacgtcgcaggtgcgtcccgcgtaa

SEQ ID NO: 411 - protein, 177 aa, Clostridium beijerinckii NCIMB 8052
MDRRIEKSKQAIMGAFIKLMSEKDFEKITINEIAEEANVNRGTVYLHYEDKFDLMNKCIDTHLNQLCDSCISDGESSNFDSKASLLQTFQYLEKHAIFYSNMLTNKAMPAFRERILTMALKSMEEHLDMTGSNENISKNIMAQYVASAAVGVMEWWIVNSMPYPAAYMAEQLWQLLK

SEQ ID NO: 412 - protein, 175 aa, Bacillus weihenstephanensis KBAB4
VDRRIIKSKEAIKNAFIELMAEKGFDKITVKDICSGADVGNRTFYLHYLDKFDLLDKLVIERIEALKTLCAPLHDLSFREACIAWFENMEQHYFFFSTMLAGKGASAFRKHFFDYIIEQIKDDVDIKEGINKGFSEDMIITFFGSAIVGVVETYFMKGLPDPPEIVAEQLGMLLD

SEQ ID NO: 413 - protein, 175 aa, Bacillus licheniformis ATCC 14580
DRRVKRTKKMIRDALSELMKNKAFEEISVTDITKKADINRGTFYLHYEDKYDLLDQSEEEIIQEINKIAKRSIHSMDVLNQDVIDHPLTFVVDIFQYIKENEVFMKAVLGPKGPGSFRLKFKSVLISNLKRLKTAIRTDPIVPEDYLISYITGAHISVMQQWLENGMKETPHDMA

SEQ ID NO: 414 - protein, 184 aa, Bacillus weihenstephanensis KBAB4
DPRVKRTRQLIQDAFVALVGEKGFENVTVQHIAERAPVNRATFYSHYHDKYDLLEKSIEEMLEKLAAVIKPQNRNKEDFQLTFDSPHPTFLALFEHIADNTNFYNVMLGDKAAGNYSYKMMKTIQTHLTLSLSISQPDDEDLMVPRDILISYVTGAHIGMIMSWLKRGMIYTPHFMAMQLTRLI

SEQ ID NO: 415 - protein, 184 aa, Bacillus cereus ATCC 10987
DPRVKRTRQLIQDAFVALVGEKGFENVTVQHIAERAPVNRATFYSHYHDKYDLLDKSIEEMLEKLTKVIKQKNRNKEDFQLTFDSPHPSFLALFEHIAENANFYNVMLGDKAAGNYTYKMMKAIQTHLTLSLSISQPNDEKLMVPRDILISYVTGAHLGMIMSWLKKGMIYTPHFMAMQLTRLI

SEQ ID NO: 416 - protein, 200 aa, Artificial
  Substituion in SEQ ID NO 409
MDRRVQKSRQAIRDAFVALMKEKDFDHITVQDITERANVSRKTFYLHFLDKYDLLDRVMEDAIRDMDEFGQCVSELDWVPATEQCFQYLADRYDFFGTMLTQAGAPYFRRRYVESCKASFTREIRRVVGRDPLPEEDAILQFVVNAYVGTVEWWLQEGMPYPPRVMADRIGRMLESVYTQIPSLAEKPASPRETSQVRPA

SEQ ID NO: 417 - protein, 200 aa, Artificial
  Substituion in SEQ ID NO 409
MDRRVQKSRQAIRDAFVALMKEKDFDHITVQDITERANVSRKTFYLHFLDKYDLLDRVMEDAIRDMDEFGQCVSELDWVPATEQCFQYLADRYDFFGTMLTQAGAPYFRRRYVESCKASFTREIRRVVGREPLPEEDAILQFVVNAYVGTVEWWLQEGMPYPPRVMADRIGRMLESVYTQLPSLAEKPASPRETSQVRPA

SEQ ID NO: 418 - protein, 200 aa, Artificial
  Substituion in SEQ ID NO 409
MDRRVQKSRQAIRDAFVALMKEKDFDHITVQDITERANVSRKTFYLHFLDKYDLLDRVMEDAIRDMDEFGQCVSELDWVPATEQCFQYLADRYDFFGTMLTQAGAPYFRRRYVESCKASFTREIRRVVGRDPLPEEDAILQFVVNAYVGTIEWWLQEGMPYPPRVMADRIGRMLESVYTQLPSLAEKPASPRETSQVRPA

SEQ ID NO: 419 - protein, 200 aa, Artificial
  Substituion in SEQ ID NO 409
MDRRVQKSRQAIRDAFVALMKEKDFDHITVQDITERANVSRKTFYLHFLDKYDLLDRVMEDAIRDMDEFGQCVSELDWVPATEQCFQYLADRYDFFGTMLTNAGAPYFRRRYVESCKASFTREIRRVVGRDPLPEEDAILQFVVNAYVGTVEWWLQEGMPYPPRVMADRIGRMLESVYTQLPSLAEKPASPRETSQVRPA

SEQ ID NO: 420 - protein, 200 aa, Artificial
  Substituion in SEQ ID NO 409
MDRRVQKSRQAIRDAFVALMKEKDFDHITVQDITERANVSRKTFYLHFLDKYDLLDRVMEDAIRDMDEFGQCVSELDWVPATEQCFQYLADRYDFFGTMLTQAGAPYFRRRYVESCKASFTREIRRVVGRDPLPEEDAILQFVVNAYVGTVEWWLQEGMPYPPKVMADRIGRMLESVYTQLPSLAEKPASPRETSQVRPA

SEQ ID NO: 421 - DNA, 603 bp, Artificial
  Substituion in SEQ ID NO 410
ttggaccggcgcgtgcagaagtcgcggcaggccattcgggatgcctttgtggctttgatgaaggagaaggatttcgaccacatcaccgtgcaggatatcacagagcgcgcaaacgtcagtcgcaagaccttctacctgcacttcctcgacaaatacgacctgctcgatcgcgtcatggaagacgccattcgcgacatggacgagttcggccaatgcgtctccgagctcgattgggtccccgccacggagcagtgctttcagtacctggcggatcgatacgatttcttcggcaccatgctgacccaggccggcgctccctactttcgccgccgctacgtcgagtcgtgcaaggcgtccttcacgcgggagatccggcgcgtggtgggaagggatccgctgcccgaggaagacgccattctgcagtttgtcgtgaacgcctacgtgggcacggtggaatggtggctgcaggaggggatgccgtatccgcctcgggtgatggcggatcggattgggcgaatgctcgaatcggtatacacccaaattccatccctcgccgaaaagcccgcgtcgccgcgcgagacgtcgcaggtgcgtcccgcgtaa

SEQ ID NO: 422 - DNA, 603 bp, Artificial
  Substituion in SEQ ID NO 410
ttggaccggcgcgtgcagaagtcgcggcaggccattcgggatgcctttgtggctttgatgaaggagaaggatttcgaccacatcaccgtgcaggatatcacagagcgcgcaaacgtcagtcgcaagaccttctacctgcacttcctcgacaaatacgacctgctcgatcgcgtcatggaagacgccattcgcgacatggacgagttcggccaatgcgtctccgagctcgattgggtccccgccacggagcagtgctttcagtacctggcggatcgatacgatttcttcggcaccatgctgacccaggccggcgctccctactttcgccgccgctacgtcgagtcgtgcaaggcgtccttcacgcgggagatccggcgcgtggtgggaagggaaccgctgcccgaggaagacgccattctgcagtttgtcgtgaacgcctacgtgggcacggtggaatggtggctgcaggaggggatgccgtatccgcctcgggtgatggcggatcggattgggcgaatgctcgaatcggtatacacccaactcccatccctcgccgaaaagcccgcgtcgccgcgcgagacgtcgcaggtgcgtcccgcgtaa

SEQ ID NO: 423 - DNA, 603 bp, Artificial
  Substituion in SEQ ID NO 410
ttggaccggcgcgtgcagaagtcgcggcaggccattcgggatgcctttgtggctttgatgaaggagaaggatttcgaccacatcaccgtgcaggatatcacagagcgcgcaaacgtcagtcgcaagaccttctacctgcacttcctcgacaaatacgacctgctcgatcgcgtcatggaagacgccattcgcgacatggacgagttcggccaatgcgtctccgagctcgattgggtccccgccacggagcagtgctttcagtacctggcggatcgatacgatttcttcggcaccatgctgacccaggccggcgctccctactttcgccgccgctacgtcgagtcgtgcaaggcgtccttcacgcgggagatccggcgcgtggtgggaagggatccgctgcccgaggaagacgccattctgcagtttgtcgtgaacgcctacgtgggcacgattgaatggtggctgcaggaggggatgccgtatccgcctcgggtgatggcggatcggattgggcgaatgctcgaatcggtatacacccaactcccatccctcgccgaaaagcccgcgtcgccgcgcgagacgtcgcaggtgcgtcccgcgtaa

SEQ ID NO: 424 - DNA, 603 bp, Artificial
  Substituion in SEQ ID NO 410
ttggaccggcgcgtgcagaagtcgcggcaggccattcgggatgcctttgtggctttgatgaaggagaaggatttcgaccacatcaccgtgcaggatatcacagagcgcgcaaacgtcagtcgcaagaccttctacctgcacttcctcgacaaatacgacctgctcgatcgcgtcatggaagacgccattcgcgacatggacgagttcggccaatgcgtctccgagctcgattgggtccccgccacggagcagtgctttcagtacctggcggatcgatacgatttcttcggcaccatgctgaccaatgccggcgctccctactttcgccgccgctacgtcgagtcgtgcaaggcgtccttcacgcgggagatccggcgcgtggtgggaagggatccgctgcccgaggaagacgccattctgcagtttgtcgtgaacgcctacgtgggcacggtggaatggtggctgcaggaggggatgccgtatccgcctcgggtgatggcggatcggattgggcgaatgctcgaatcggtatacacccaactcccatccctcgccgaaaagcccgcgtcgccgcgcgagacgtcgcaggtgcgtcccgcgtaa

SEQ ID NO: 425 - DNA, 603 bp, Artificial
  Substituion in SEQ ID NO 410
ttggaccggcgcgtgcagaagtcgcggcaggccattcgggatgcctttgtggctttgatgaaggagaaggatttcgaccacatcaccgtgcaggatatcacagagcgcgcaaacgtcagtcgcaagaccttctacctgcacttcctcgacaaatacgacctgctcgatcgcgtcatggaagacgccattcgcgacatggacgagttcggccaatgcgtctccgagctcgattgggtccccgccacggagcagtgctttcagtacctggcggatcgatacgatttcttcggcaccatgctgacccaggccggcgctccctactttcgccgccgctacgtcgagtcgtgcaaggcgtccttcacgcgggagatccggcgcgtggtgggaagggatccgctgcccgaggaagacgccattctgcagtttgtcgtgaacgcctacgtgggcacggtggaatggtggctgcaggaggggatgccgtatccgcctaaagtgatggcggatcggattgggcgaatgctcgaatcggtatacacccaactcccatccctcgccgaaaagcccgcgtcgccgcgcgagacgtcgcaggtgcgtcccgcgtaa

SEQ ID NO: 426 - protein, 259 aa, Alicyclobacillus acidocaldarius
MIMHGKHRHVPLAFAAMAMLVGATSLVVPVQDARAAWFRPLQHRVNPGVQATGIQGKVIVVDAGHGGRDSGARGVGGIEEKDITLSVALKLARYLQQGGAIVIMTRTTDTDLATERDRAMRQRHLGDLRGRLNVVRRQRVDAFVSIHCNSAPSPDWRGAQVLYLKTNPHAKQLATVMQEAFRTELLPTHRDVQSNRTLFLLKRIEGPTVLAEIGFVSNPEEARALTTDAYQERVAFAMYEALVRYFSDPAVEQVPEDDG

SEQ ID NO: 427 - DNA, 780 bp, Alicyclobacillus acidocaldarius
atgatcatgcacgggaagcacaggcacgtgccgctcgcgttcgctgcgatggcgatgctcgtgggggcgacctccctcgtggtacccgtacaggatgcgcgggcggcatggtttcgtccgcttcagcatagggtgaatccaggtgttcaagcgaccggcatccagggcaaggtcatcgtcgtggatgcaggccatggcggccgcgactccggagcgcgaggcgtcggcggaattgaggagaaggatatcacactctccgttgcgctcaagctcgcgcgctacctgcagcagggcggcgccatcgtcatcatgacaaggaccacggacaccgacctcgccacagagcgcgatcgcgccatgagacagcgccatttgggcgatctgcgcggccgattgaacgtggttcgccgccagcgcgtcgacgcctttgtttcgattcactgcaacagcgcaccatctcccgactggcgtggcgctcaggtcctgtacctgaagacgaatccgcacgccaagcagctcgcaaccgtgatgcaggaggcgtttcggacggagcttctgccgacgcaccgcgatgtgcagtcgaatcggacgctcttccttctcaagcgcatcgaagggcccacggttctggcggaaatcggatttgtgtcgaacccggaggaggcgcgcgcgctcaccacggacgcctatcaggagcgcgtggccttcgccatgtacgaagccctggttcgctacttcagcgatccggccgtagagcaagtgccggaggacgacggctaa

SEQ ID NO: 428 - protein, 221 aa, Bacillus clausii KSM-K16
LLFAAVLLWVQYDSTLKDSSSTWHLPMSGKVIVLDPGHGGMDGGAVSKTGTLEKEVTLAVALKLRDYLQEAGALVIMTREEDVDLADAGTAKIRQRKTEDLRKRAMIINDSEADAFLSIHMNAIPSERWNGAQTFYHLKNQRNEDMAVFIQEEIKRNLQNTNRYPKPIHHVYLLKEAEIPGALVEAGFLSNPQEAALLATEEYQDKMAASIYEGMLRFFTD

SEQ ID NO: 429 - protein, 222 aa, Paenibacillus larvae subsp. larvae BRL-230010
VALLVMIYAYKLPATETWTEWTQPLAGKTIALDAGHGGPDGGASSKSGVIEKDINLIISLYVRDYLQQAGAIVVMTREMDKDLANPDTKGYSKRKTEDLLKRAEFVIQKKADLFLSIHLNSVPSPKWRGAQAFYYPNNQDNYRLASLIQEEIKRNMENTDRVAKQEESVYLLKTLKMPSTLIELGFLSNPDEARMLADDKYQKKLAASIYQGILRYYAGEKV

SEQ ID NO: 430 - protein, 168 aa, Bacillus coagulans 36D1
EKDVALSVAAKIKDYLQQQGALVIMTRETDTDLADNETKGYSRRKVEDLRKRLSLINESEADLFISIHLNAIPQSQWHGAQTFYAPTMIENKRIATFIQAELVRNLENTNRASKTLSNVYLLKHAKKPGCLVEIGFLSNPGEREQLKSDAYQTKVAASIYEGIMRYFT

SEQ ID NO: 431 - protein, 200 aa, Bacillus halodurans C-125
LSGKVIILDPGHGGIDGGATSRAGALEKDITLAVSLELRDYLQEAGALVLMTREEDRDLADATTAKVRQRKVQDLKRRVEIVNGSGADMFVSIHLNAIASPRWSGAQTFYNRAIPENEPLARFVQDQLKRNLENTSRYAKPINNVFLLKHAEIPGLLVEAGFLSNPSEAELLETEDYQQKVAASIYQGIMRYYTNEDAPE

SEQ ID NO: 432 - protein, 171 aa, Geobacillus thermodenitrificans NG80-2
VVEKEIALNVAKKLRDYLQQQGALVLMTRETDRDLASPSTRGYSRRKTEDLRERTTFINKSDADLFISIHLNAIPSPRWRGAQTFYYGSLIENERLAKFIQAELRRNLENTHRVAKMIDTVYLLKHAKKPGALVEIGFLSNPDERELLASDHYQTQLAASIYKGVLRYFSN

SEQ ID NO: 433 - protein, 259 aa, Artificial
  Substituion in SEQ ID NO 426
MIMHGKHRHVPLAFAAMAMLVGATSLVIPVQDARAAWFRPLQHRVNPGVQATGIQGKVIVVDAGHGGRDSGARGVGGIEEKDITLSVALKLARYLQQGGAIVIMTRTTDTDLATERDRAMRQRHLGDLRGRLNVVRRQRVDAFVSIHCNSAPSPDWRGAQVLYLKTNPHAKQLATVMQEAFRTELLPTHRDVQSNRTLFLLKRIEGPTVLAEIGFVSNPEEARALTTDAYQERVAFAMYEALVRYFSDPAVEQVPEDDG

SEQ ID NO: 434 - protein, 259 aa, Artificial
  Substituion in SEQ ID NO 426
MIMHGKHRHVPLAFAAMAMLVGATSLVVPVQDARAAWFRPLQHRVNPGVQATGIQGKVIVVDAGHGGRDSGARGVGGIEEKDITLSVALKLARYLQQGGAIVIMTRTTDTDLATERDRAMRQRHLGDLRGRLNVVRRQRVDAFVSIHCNSAPSPDWRGAQVLYLKTNPHAKQLATVMQDAFRTELLPTHRDVQSNRTLFLLKRIEGPTVLAEIGFVSNPEEARALTTDAYQERVAFAMYEALVRYFSDPAVEQVPEDDG

SEQ ID NO: 435 - protein, 259 aa, Artificial
  Substituion in SEQ ID NO 426
MIMHGKHRHVPLAFAAMAMLVGATSLVVPVQDARAAWFRPLQHRVNPGVQATGIQGKVIVVDAGHGGRDSGARGVGGIEEKDITLSVALKLARYLQQGGAIVIMTRTTDTDLATERDRAMRQRHLGDLRGRLNVVRRQRVDAFVSIHCNSAPSPDWRGAQILYLKTNPHAKQLATVMQEAFRTELLPTHRDVQSNRTLFLLKRIEGPTVLAEIGFVSNPEEARALTTDAYQERVAFAMYEALVRYFSDPAVEQVPEDDG

SEQ ID NO: 436 - protein, 259 aa, Artificial
  Substituion in SEQ ID NO 426
MIMHGKHRHVPLAFAAMAMLVGATSLVVPVQDARAAWFRPIQHRVNPGVQATGIQGKVIVVDAGHGGRDSGARGVGGIEEKDITLSVALKLARYLQQGGAIVIMTRTTDTDLATERDRAMRQRHLGDLRGRLNVVRRQRVDAFVSIHCNSAPSPDWRGAQVLYLKTNPHAKQLATVMQEAFRTELLPTHRDVQSNRTLFLLKRIEGPTVLAEIGFVSNPEEARALTTDAYQERVAFAMYEALVRYFSDPAVEQVPEDDG

SEQ ID NO: 437 - protein, 259 aa, Artificial
  Substituion in SEQ ID NO 426
MIMHGKHRHVPLAFAAMAMLVGATSLVVPVQDARAAWFRPLQHRVNPGVQATGIQGKVIVVDAGHGGRDSGARGVGGIEEKDITLSVALKLARYLQQGGAIVIMTRTTDTDLATERDRAMRQRHLGDLRGRLNVVRRQRVDAFVSIHCNSAPSPDWRGAQVLYLKTNPHAKQLATIMQEAFRTELLPTHRDVQSNRTLFLLKRIEGPTVLAEIGFVSNPEEARALTTDAYQERVAFAMYEALVRYFSDPAVEQVPEDDG

SEQ ID NO: 438 - DNA, 780 bp, Artificial
  Substituion in SEQ ID NO 427
atgatcatgcacgggaagcacaggcacgtgccgctcgcgttcgctgcgatggcgatgctcgtgggggcgacctccctcgtgattcccgtacaggatgcgcgggcggcatggtttcgtccgcttcagcatagggtgaatccaggtgttcaagcgaccggcatccagggcaaggtcatcgtcgtggatgcaggccatggcggccgcgactccggagcgcgaggcgtcggcggaattgaggagaaggatatcacactctccgttgcgctcaagctcgcgcgctacctgcagcagggcggcgccatcgtcatcatgacaaggaccacggacaccgacctcgccacagagcgcgatcgcgccatgagacagcgccatttgggcgatctgcgcggccgattgaacgtggttcgccgccagcgcgtcgacgcctttgtttcgattcactgcaacagcgcaccatctcccgactggcgtggcgctcaggtcctgtacctgaagacgaatccgcacgccaagcagctcgcaaccgtgatgcaggaggcgtttcggacggagcttctgccgacgcaccgcgatgtgcagtcgaatcggacgctcttccttctcaagcgcatcgaagggcccacggttctggcggaaatcggatttgtgtcgaacccggaggaggcgcgcgcgctcaccacggacgcctatcaggagcgcgtggccttcgccatgtacgaagccctggttcgctacttcagcgatccggccgtagagcaagtgccggaggacgacggctaa

SEQ ID NO: 439 - DNA, 780 bp, Artificial
  Substituion in SEQ ID NO 427
atgatcatgcacgggaagcacaggcacgtgccgctcgcgttcgctgcgatggcgatgctcgtgggggcgacctccctcgtggtacccgtacaggatgcgcgggcggcatggtttcgtccgcttcagcatagggtgaatccaggtgttcaagcgaccggcatccagggcaaggtcatcgtcgtggatgcaggccatggcggccgcgactccggagcgcgaggcgtcggcggaattgaggagaaggatatcacactctccgttgcgctcaagctcgcgcgctacctgcagcagggcggcgccatcgtcatcatgacaaggaccacggacaccgacctcgccacagagcgcgatcgcgccatgagacagcgccatttgggcgatctgcgcggccgattgaacgtggttcgccgccagcgcgtcgacgcctttgtttcgattcactgcaacagcgcaccatctcccgactggcgtggcgctcaggtcctgtacctgaagacgaatccgcacgccaagcagctcgcaaccgtgatgcaggatgcgtttcggacggagcttctgccgacgcaccgcgatgtgcagtcgaatcggacgctcttccttctcaagcgcatcgaagggcccacggttctggcggaaatcggatttgtgtcgaacccggaggaggcgcgcgcgctcaccacggacgcctatcaggagcgcgtggccttcgccatgtacgaagccctggttcgctacttcagcgatccggccgtagagcaagtgccggaggacgacggctaa

SEQ ID NO: 440 - DNA, 780 bp, Artificial
  Substituion in SEQ ID NO 427
atgatcatgcacgggaagcacaggcacgtgccgctcgcgttcgctgcgatggcgatgctcgtgggggcgacctccctcgtggtacccgtacaggatgcgcgggcggcatggtttcgtccgcttcagcatagggtgaatccaggtgttcaagcgaccggcatccagggcaaggtcatcgtcgtggatgcaggccatggcggccgcgactccggagcgcgaggcgtcggcggaattgaggagaaggatatcacactctccgttgcgctcaagctcgcgcgctacctgcagcagggcggcgccatcgtcatcatgacaaggaccacggacaccgacctcgccacagagcgcgatcgcgccatgagacagcgccatttgggcgatctgcgcggccgattgaacgtggttcgccgccagcgcgtcgacgcctttgtttcgattcactgcaacagcgcaccatctcccgactggcgtggcgctcagattctgtacctgaagacgaatccgcacgccaagcagctcgcaaccgtgatgcaggaggcgtttcggacggagcttctgccgacgcaccgcgatgtgcagtcgaatcggacgctcttccttctcaagcgcatcgaagggcccacggttctggcggaaatcggatttgtgtcgaacccggaggaggcgcgcgcgctcaccacggacgcctatcaggagcgcgtggccttcgccatgtacgaagccctggttcgctacttcagcgatccggccgtagagcaagtgccggaggacgacggctaa

SEQ ID NO: 441 - DNA, 780 bp, Artificial
  Substituion in SEQ ID NO 427
atgatcatgcacgggaagcacaggcacgtgccgctcgcgttcgctgcgatggcgatgctcgtgggggcgacctccctcgtggtacccgtacaggatgcgcgggcggcatggtttcgtccgattcagcatagggtgaatccaggtgttcaagcgaccggcatccagggcaaggtcatcgtcgtggatgcaggccatggcggccgcgactccggagcgcgaggcgtcggcggaattgaggagaaggatatcacactctccgttgcgctcaagctcgcgcgctacctgcagcagggcggcgccatcgtcatcatgacaaggaccacggacaccgacctcgccacagagcgcgatcgcgccatgagacagcgccatttgggcgatctgcgcggccgattgaacgtggttcgccgccagcgcgtcgacgcctttgtttcgattcactgcaacagcgcaccatctcccgactggcgtggcgctcaggtcctgtacctgaagacgaatccgcacgccaagcagctcgcaaccgtgatgcaggaggcgtttcggacggagcttctgccgacgcaccgcgatgtgcagtcgaatcggacgctcttccttctcaagcgcatcgaagggcccacggttctggcggaaatcggatttgtgtcgaacccggaggaggcgcgcgcgctcaccacggacgcctatcaggagcgcgtggccttcgccatgtacgaagccctggttcgctacttcagcgatccggccgtagagcaagtgccggaggacgacggctaa

SEQ ID NO: 442 - DNA, 780 bp, Artificial
  Substituion in SEQ ID NO 427
atgatcatgcacgggaagcacaggcacgtgccgctcgcgttcgctgcgatggcgatgctcgtgggggcgacctccctcgtggtacccgtacaggatgcgcgggcggcatggtttcgtccgcttcagcatagggtgaatccaggtgttcaagcgaccggcatccagggcaaggtcatcgtcgtggatgcaggccatggcggccgcgactccggagcgcgaggcgtcggcggaattgaggagaaggatatcacactctccgttgcgctcaagctcgcgcgctacctgcagcagggcggcgccatcgtcatcatgacaaggaccacggacaccgacctcgccacagagcgcgatcgcgccatgagacagcgccatttgggcgatctgcgcggccgattgaacgtggttcgccgccagcgcgtcgacgcctttgtttcgattcactgcaacagcgcaccatctcccgactggcgtggcgctcaggtcctgtacctgaagacgaatccgcacgccaagcagctcgcaaccattatgcaggaggcgtttcggacggagcttctgccgacgcaccgcgatgtgcagtcgaatcggacgctcttccttctcaagcgcatcgaagggcccacggttctggcggaaatcggatttgtgtcgaacccggaggaggcgcgcgcgctcaccacggacgcctatcaggagcgcgtggccttcgccatgtacgaagccctggttcgctacttcagcgatccggccgtagagcaagtgccggaggacgacggctaa

SEQ ID NO: 443 - protein, 312 aa, Alicyclobacillus acidocaldarius
MIEIEKPRIEIVEQTGDYGKFVCEPLERGYGTTLGNSLRRILLSSIPGAAVRSVKIEGVLHEFSTIPGVVEDVTEIILNLKRLSLKIHSDEEKTLIIDAVGPGVVTAGDIRADSDVDIMNPDLHIATLTEGARIYMEMRAGRGRGYVPAHRNKPEEQEIGLIPIDSLYSPISRVNFSVENTRVGQITDYDKLTLEVWTDGSVAPDEAVSIGAKILTEHLMLFVGLTDRARDTDLMVEKENAHNDKILDMPIEELDLSVRSYNCLKRAGINTVAELCAKSEEEMMKVRNLGRKSLEEVVEKLHALGLSLRKDD

SEQ ID NO: 444 - DNA, 939 bp, Alicyclobacillus acidocaldarius
atgatcgagatagagaagccgcggatcgagattgtggaacaaaccggcgactacgggaagttcgtgtgcgaaccgctggagcgcggctacgggacgacgctcggcaactcactgcgccgcatcctgctgtcttctatcccgggggcagcggtgcggtcggtgaagatcgagggcgtgctgcacgagttctccacgattcctggggtcgtcgaggatgtcaccgagatcattctcaatctcaaacggctctcgttgaaaattcattccgacgaagagaagacgctgatcatcgacgccgtgggcccgggagtggtgacggctggcgacatccgcgcggattcggacgtcgacatcatgaatcctgacctgcacatcgcgacgctgaccgagggcgcgcgcatctacatggagatgcgcgccggccgggggcgcggatacgtgccggcacaccgcaacaagccggaggagcaggagattgggctcattcccatcgactcgttgtactcgcccatctcgcgcgtgaacttctccgtggagaacacgcgcgtgggtcagatcacggactacgacaaactcacgctcgaggtgtggacggacggaagcgtggcgccggacgaggcggtctcgatcggagcaaagatcctgacggaacacttgatgctgtttgtcggtctgacggatcgggcgcgggacacggatctcatggtcgaaaaggagaacgcgcacaacgacaagatcctcgacatgccgattgaggagctggacctgtcggtgcgctcctacaactgcctgaagcgcgcgggcatcaacacggtggcggagctctgcgcgaagtcggaagaagagatgatgaaggtccgcaacctcggccgcaagtcgctggaggaagtggtcgagaagttgcatgcccttggacttagtttacgcaaggacgactga

SEQ ID NO: 445 - protein, 314 aa, Geobacillus kaustophilus HTA426
MIEIEKPKIETVELSEDAKYGKFVVEPLERGYGTTLGNSLRRILLSSLPGAAVTSVQIDGVLHEFSTIDGVVEDVTAIILNIKKLALKIYSDEEKTLEIDVQGEGVVTAADITHDSDVEILNPDLHIATLAEGGRLRMRMTAKRGRGYVPAEANKREDQPIGVIPIDSIYTPVSRVSYQVENTRVGQVTDYDKLTIDVWTDGSIGPKEAISLGAKILTEHLNIFVGLTDEAQNAEIMVEKEDDQKEKVLEMTIEELDLSVRSYNCLKRAGINTVQELTQKTEEDMMKVRNLGRKSLEEVKAKLAELGLSLRKDD

SEQ ID NO: 446 - protein, 314 aa, Geobacillus thermodenitrificans NG80-2
MIEIEKPKIETVELSEDAKYGKFVVEPLERGYGTTLGNSLRRILLSSLPGAAVTSVQIDGVLHEFSTIEGVVEDVTAIILNVKKLALKIYSDEEKTLEIDVQGEGVVTAADITHDSDVEILNPDLHIATLAEGGRLRMRMTARRGRGYVPAEANKREDQPIGVIPIDSIYTPVSRVSYQVENTRVGQVTDYDKLTIDVWTDGSIGPKEAISLGAKILTEHLNIFVGLTDEAQNAEIMVEKEDDQKEKVLEMTIEELDLSVRSYNCLKRAGINTVQELTQKTEEDMMKVRNLGRKSLEEVKAKLAELGLSLRKDD

SEQ ID NO: 447 - protein, 314 aa, Bacillus halodurans C-125
MIEIEKPVIETIEISEDAKYGKFVVEPLERGYGTTLGNSLRRILLSSLPGAAVTSVQIDGVLHEFSTIEGVVEDVTTIVLNLKQLALKIYSDEDKTLEIDTQGEGVVTAGDLTHDSDVDVLNPDLHIATLTTGAHLRMRITAKRGRGYVPAEGNKSDELAIGVIPIDSIYTPVSRVNYQVENTRVGQVTNYDKLTLDVWTDGSIRPEEAVSLGAKILTEHLNIFVGLTDQAQNAEIMVEKEEDQKEKVLEMTIEELDLSVRSYNCLKRAGINTVQELTQKTEEDMMKVRNLGRKSLEEVQEKLGELGLGLRKEE

SEQ ID NO: 448 - protein, 314 aa, Pelotomaculum thermopropionicum SI
MLEIEKPKIEIVEMSDDNTYGKFVVEPLERGYGITLGNSLRRILLSSLPGAAVTSVKIDGVLHEFSTIPGVVEDVTDIILNLKNLCLKIYGDEEKVLRVEASTEGVVKAKDIIHDADVEIMNPDLTIATLAENARLYMEITVAKGRGYVSAERNKKGDHIIGVIPVDSVFTPVRKVNYTVENTRVGQITDYDKLTLEVWTDGSIRPDEATSLSAKILSEHLRLFIGLTETVSDVEIMVEKEEEHKDRVLEMTIEELDLSVRSYNCLKRAGINTVEELIQRNEEDMMKVRNLGKKSLEEVINKLHELGLSLRKDD

SEQ ID NO: 449 - protein, 314 aa, Desulfotomaculum reducens MI-1
MLEIEKPKIEIVEQSEDNTYGKFVVEPLERGYGITLGNSLRRILLSSLPGAAVTSVKIEGVLHEFATVPGVQEDVTDIILNLKNLCLKIHSDEEKVLRVEAQTEGPVTAGDIIHDADVEILNPDLHLATLDTGGRLFMEISVNKGRGYSSAEKNKKGEHIIGVIPIDSIYTPVRRVNYNVENTRVGQITDYDKLTLEVWTNGSIRPDEATSLSAKILSEHLRLFIGLTETVNDVEIMVEKEEEQKDKILEMTIEELDMSVRSYNCLKRAGINTVEELIQRNEEDMMKVRNLGKKSLEEVINKLHELGLSLRQED

SEQ ID NO: 450 - protein, 312 aa, Artificial
  Substituion in SEQ ID NO 443
MIEIEKPRIEIVEQTGDYGKFVCEPLERGYGTTLGNSLRRILLSSIPGAAVRSVKIEGVLHEFSTIPGVVEDVTEIILNLKRLSLKIHSDEEKTLLIDAVGPGVVTAGDIRADSDVDIMNPDLHIATLTEGARIYMEMRAGRGRGYVPAHRNKPEEQEIGLIPIDSLYSPISRVNFSVENTRVGQITDYDKLTLEVWTDGSVAPDEAVSIGAKILTEHLMLFVGLTDRARDTDLMVEKENAHNDKILDMPIEELDLSVRSYNCLKRAGINTVAELCAKSEEEMMKVRNLGRKSLEEVVEKLHALGLSLRKDD

SEQ ID NO: 451 - protein, 312 aa, Artificial
  Substituion in SEQ ID NO 443
MIEIEKPRIEIVEQTGDYGKFVCEPLERGYGTTLGNSLRRILLSSIPGAAVRSVKIEGVLHEFSTIPGVVEDVTEIILNLKRLSLKIHSDEEKTLIIDAVGPGVVTAGDIRADSDVDIMNPDLHIATLTEGARIYMEMRAGRGRGYVPAHRNKPEEQEIGLIPIDSLYSPISRVNFSVENTRVGQITDYDKLTLEVWTDGSVAPDEAVSIGAKILTEHLMLFVGLTDRARDTDLMVEKENAHNEKILDMPIEELDLSVRSYNCLKRAGINTVAELCAKSEEEMMKVRNLGRKSLEEVVEKLHALGLSLRKDD

SEQ ID NO: 452 - protein, 312 aa, Artificial
  Substituion in SEQ ID NO 443
MIEIEKPRIEIVEQTGDYGKFVCEPLERGYGTTLGNSLRRILLSSIPGAAVRSVKIEGVLHEFSTIPGVVEDVTEIILNLKRLSLKIHSDEEKTLIIDAVGPGVVTAGDIRADSDVDIMNPDLHIATLTEGARIYMEMRAGRGRGYVPAHRNKPEEQEIGLIPIDSLYSPISRVNFSVENTRVGQITDYDKLTLEVWTDGSVAPDEAVSIGAKILTEHLMLFVGLTERARDTDLMVEKENAHNDKILDMPIEELDLSVRSYNCLKRAGINTVAELCAKSEEEMMKVRNLGRKSLEEVVEKLHALGLSLRKDD

SEQ ID NO: 453 - protein, 312 aa, Artificial
  Substituion in SEQ ID NO 443
MIEIEKPRIEIVEQTGDYGKFVCEPLERGYGTTLGNSLRRILLSSIPGAAVRSVKIEGVLHEFSTIPGVVEDVTEIILNLKRLSLKIHSDEEKTLIIDAVGPGVVTAGDIRADSDVDIMNPDLHIATLTEGARIYMEMRAGRGRGYVPAHRNKPEEQEIGLIPIDSLYSPISRVNFSVENTRVGQLTDYDKLTLEVWTDGSVAPDEAVSIGAKILTEHLMLFVGLTDRARDTDLMVEKENAHNDKILDMPIEELDLSVRSYNCLKRAGINTVAELCAKSEEEMMKVRNLGRKSLEEVVEKLHALGLSLRKDD

SEQ ID NO: 454 - protein, 312 aa, Artificial
  Substituion in SEQ ID NO 443
MIEIEKPRIEIVEQTGDYGKFVCEPLERGYGTTLGNSLRRILLSSIPGAAVRSVKIEGVLHEFSTIPGVVEDVTEIILNLKRLSLKIHSDEEKTLIIDAVGPGVVTAGDIRADSDVDIMNPDLHIATLTEGARIYMEMRAGRGRGYVPAHRNKPEEQEIGLIPIDSLYSPISRVNFSVENTRVGQITDYDKLTIEVWTDGSVAPDEAVSIGAKILTEHLMLFVGLTDRARDTDLMVEKENAHNDKILDMPIEELDLSVRSYNCLKRAGINTVAELCAKSEEEMMKVRNLGRKSLEEVVEKLHALGLSLRKDD

SEQ ID NO: 455 - DNA, 939 bp, Artificial
  Substituion in SEQ ID NO 444
atgatcgagatagagaagccgcggatcgagattgtggaacaaaccggcgactacgggaagttcgtgtgcgaaccgctggagcgcggctacgggacgacgctcggcaactcactgcgccgcatcctgctgtcttctatcccgggggcagcggtgcggtcggtgaagatcgagggcgtgctgcacgagttctccacgattcctggggtcgtcgaggatgtcaccgagatcattctcaatctcaaacggctctcgttgaaaattcattccgacgaagagaagacgctgttaatcgacgccgtgggcccgggagtggtgacggctggcgacatccgcgcggattcggacgtcgacatcatgaatcctgacctgcacatcgcgacgctgaccgagggcgcgcgcatctacatggagatgcgcgccggccgggggcgcggatacgtgccggcacaccgcaacaagccggaggagcaggagattgggctcattcccatcgactcgttgtactcgcccatctcgcgcgtgaacttctccgtggagaacacgcgcgtgggtcagatcacggactacgacaaactcacgctcgaggtgtggacggacggaagcgtggcgccggacgaggcggtctcgatcggagcaaagatcctgacggaacacttgatgctgtttgtcggtctgacggatcgggcgcgggacacggatctcatggtcgaaaaggagaacgcgcacaacgacaagatcctcgacatgccgattgaggagctggacctgtcggtgcgctcctacaactgcctgaagcgcgcgggcatcaacacggtggcggagctctgcgcgaagtcggaagaagagatgatgaaggtccgcaacctcggccgcaagtcgctggaggaagtggtcgagaagttgcatgcccttggacttagtttacgcaaggacgactga

SEQ ID NO: 456 - DNA, 939 bp, Artificial
  Substituion in SEQ ID NO 444
atgatcgagatagagaagccgcggatcgagattgtggaacaaaccggcgactacgggaagttcgtgtgcgaaccgctggagcgcggctacgggacgacgctcggcaactcactgcgccgcatcctgctgtcttctatcccgggggcagcggtgcggtcggtgaagatcgagggcgtgctgcacgagttctccacgattcctggggtcgtcgaggatgtcaccgagatcattctcaatctcaaacggctctcgttgaaaattcattccgacgaagagaagacgctgatcatcgacgccgtgggcccgggagtggtgacggctggcgacatccgcgcggattcggacgtcgacatcatgaatcctgacctgcacatcgcgacgctgaccgagggcgcgcgcatctacatggagatgcgcgccggccgggggcgcggatacgtgccggcacaccgcaacaagccggaggagcaggagattgggctcattcccatcgactcgttgtactcgcccatctcgcgcgtgaacttctccgtggagaacacgcgcgtgggtcagatcacggactacgacaaactcacgctcgaggtgtggacggacggaagcgtggcgccggacgaggcggtctcgatcggagcaaagatcctgacggaacacttgatgctgtttgtcggtctgacggatcgggcgcgggacacggatctcatggtcgaaaaggagaacgcgcacaacgaaaagatcctcgacatgccgattgaggagctggacctgtcggtgcgctcctacaactgcctgaagcgcgcgggcatcaacacggtggcggagctctgcgcgaagtcggaagaagagatgatgaaggtccgcaacctcggccgcaagtcgctggaggaagtggtcgagaagttgcatgcccttggacttagtttacgcaaggacgactga

SEQ ID NO: 457 - DNA, 939 bp, Artificial
  Substituion in SEQ ID NO 444
atgatcgagatagagaagccgcggatcgagattgtggaacaaaccggcgactacgggaagttcgtgtgcgaaccgctggagcgcggctacgggacgacgctcggcaactcactgcgccgcatcctgctgtcttctatcccgggggcagcggtgcggtcggtgaagatcgagggcgtgctgcacgagttctccacgattcctggggtcgtcgaggatgtcaccgagatcattctcaatctcaaacggctctcgttgaaaattcattccgacgaagagaagacgctgatcatcgacgccgtgggcccgggagtggtgacggctggcgacatccgcgcggattcggacgtcgacatcatgaatcctgacctgcacatcgcgacgctgaccgagggcgcgcgcatctacatggagatgcgcgccggccgggggcgcggatacgtgccggcacaccgcaacaagccggaggagcaggagattgggctcattcccatcgactcgttgtactcgcccatctcgcgcgtgaacttctccgtggagaacacgcgcgtgggtcagatcacggactacgacaaactcacgctcgaggtgtggacggacggaagcgtggcgccggacgaggcggtctcgatcggagcaaagatcctgacggaacacttgatgctgtttgtcggtctgacggaacgggcgcgggacacggatctcatggtcgaaaaggagaacgcgcacaacgacaagatcctcgacatgccgattgaggagctggacctgtcggtgcgctcctacaactgcctgaagcgcgcgggcatcaacacggtggcggagctctgcgcgaagtcggaagaagagatgatgaaggtccgcaacctcggccgcaagtcgctggaggaagtggtcgagaagttgcatgcccttggacttagtttacgcaaggacgactga

SEQ ID NO: 458 - DNA, 939 bp, Artificial
  Substituion in SEQ ID NO 444
atgatcgagatagagaagccgcggatcgagattgtggaacaaaccggcgactacgggaagttcgtgtgcgaaccgctggagcgcggctacgggacgacgctcggcaactcactgcgccgcatcctgctgtcttctatcccgggggcagcggtgcggtcggtgaagatcgagggcgtgctgcacgagttctccacgattcctggggtcgtcgaggatgtcaccgagatcattctcaatctcaaacggctctcgttgaaaattcattccgacgaagagaagacgctgatcatcgacgccgtgggcccgggagtggtgacggctggcgacatccgcgcggattcggacgtcgacatcatgaatcctgacctgcacatcgcgacgctgaccgagggcgcgcgcatctacatggagatgcgcgccggccgggggcgcggatacgtgccggcacaccgcaacaagccggaggagcaggagattgggctcattcccatcgactcgttgtactcgcccatctcgcgcgtgaacttctccgtggagaacacgcgcgtgggtcagttaacggactacgacaaactcacgctcgaggtgtggacggacggaagcgtggcgccggacgaggcggtctcgatcggagcaaagatcctgacggaacacttgatgctgtttgtcggtctgacggatcgggcgcgggacacggatctcatggtcgaaaaggagaacgcgcacaacgacaagatcctcgacatgccgattgaggagctggacctgtcggtgcgctcctacaactgcctgaagcgcgcgggcatcaacacggtggcggagctctgcgcgaagtcggaagaagagatgatgaaggtccgcaacctcggccgcaagtcgctggaggaagtggtcgagaagttgcatgcccttggacttagtttacgcaaggacgactga

SEQ ID NO: 459 - DNA, 939 bp, Artificial
  Substituion in SEQ ID NO 444
atgatcgagatagagaagccgcggatcgagattgtggaacaaaccggcgactacgggaagttcgtgtgcgaaccgctggagcgcggctacgggacgacgctcggcaactcactgcgccgcatcctgctgtcttctatcccgggggcagcggtgcggtcggtgaagatcgagggcgtgctgcacgagttctccacgattcctggggtcgtcgaggatgtcaccgagatcattctcaatctcaaacggctctcgttgaaaattcattccgacgaagagaagacgctgatcatcgacgccgtgggcccgggagtggtgacggctggcgacatccgcgcggattcggacgtcgacatcatgaatcctgacctgcacatcgcgacgctgaccgagggcgcgcgcatctacatggagatgcgcgccggccgggggcgcggatacgtgccggcacaccgcaacaagccggaggagcaggagattgggctcattcccatcgactcgttgtactcgcccatctcgcgcgtgaacttctccgtggagaacacgcgcgtgggtcagatcacggactacgacaaactcacgattgaggtgtggacggacggaagcgtggcgccggacgaggcggtctcgatcggagcaaagatcctgacggaacacttgatgctgtttgtcggtctgacggatcgggcgcgggacacggatctcatggtcgaaaaggagaacgcgcacaacgacaagatcctcgacatgccgattgaggagctggacctgtcggtgcgctcctacaactgcctgaagcgcgcgggcatcaacacggtggcggagctctgcgcgaagtcggaagaagagatgatgaaggtccgcaacctcggccgcaagtcgctggaggaagtggtcgagaagttgcatgcccttggacttagtttacgcaaggacgactga

SEQ ID NO: 460 - protein, 1215 aa, Alicyclobacillus acidocaldarius
MHKLFDLNNFEFMKIGLASPEKIRSWSHGEVKKPETINYRTLRPEKEGLFCEKIFGPTRDWECHCGKYKRIRYKGVVCDRCGVEVTRSKVRRERMGHIELAAPVSHIWFFKGIPSRMGLILDMSPRALEEVIYFASYVVTDPGDTPLEKKQLLSEKEYRSYREKYGYAFKAGMGAEAIRTLLQEIDLDREVEILREELRTAQGQRRNRAIKRLEVIEAFRQSGNKPSWMILEALPVIPPDLRPMVQLDGGRFATSDLNDLYRRVINRNNRLKRLLDLGAPDIIVQNEKRMLQEAVDALIDNGRRGRPVTGPGNRPLKSLSHMLKGKQGRFRQNLLGKRVDYSGRSVIVVGPELRMYQCGLPKEMALELFKPFVMKELVARGLAHNIKSAKRKVERVSDEVWDVVEDVIKQHPVLLNRAPTLHRLGIQAFEPVLVEGRAIKLHPLVCTAYNADFDGDQMAVHVPLSAEAQAEARLLMLAAHNILNPKDGKPVVTPTQDMVLGSYYLTIEREGAPGEGKVFASVSEVEYALHQRLITLQTRIALPAKAVGKTSFTEKQANALLITTPGKLIFNSIFPSDFPYLNSAAKSNLLGGPPDDTFIFEKGVDIREAILKRPIPKAVIKKDLGNILAECFRRYGTTMTAEILDKVKRLGFHYSTLAGITISISDIVVPEEKKRIIAEAEAKEHKLKLQYRRGLITEEEQYVTFSQIWSEAKEQISSILMESMDQFNPIYMMATSGARGSNSQITQLAGMRGLMANPSGEIIQLAIKSNFREGLSVLEYFISTHGARKGLADTALRTADSGYLTRRLVDVAQDTIVREHDCGTDKGLRVMEIRDGSEVIEDLRDRLEGRVAFQDVYHPETGEKIVGKNEMIDEEAADKIVAAGIKEVTIRSVLTCRTRHGVCQLCYGRNLATGDMVEVGEAVGIIAAQSIGEPGTQLTMRTFHTGGVAGDDITQGLPRVQELFEARNPKGQAVIAEFDGVITDIREGKDKREIELTGESETKTYQIPYGSRIRVSVGQQLEAGEELTEGSVDPKEMLRVKGLQGVQNYLLREVQRVYRLQGVDINDKHIEVMIRQMLRKVRILDAGDTDLLPGTYVDLFEYEAANREALLSGKEPAVARPALLGITKASLETDSFLSAASFQETTRVLTEAAIKGKVDRLLGLKENVIIGKLIPAGTGMVRYRNVEPEVVRPGDAEAAATGEEVAETEAVSSAE

SEQ ID NO: 461 - DNA, 3648 bp, Alicyclobacillus acidocaldarius
gtgcacaagttgtttgacctgaacaactttgagttcatgaagattgggctcgcgtcgccggaaaagatccgctcctggtcgcacggcgaggtgaagaagccggagaccatcaactaccgcacgctccgcccggagaaggaggggctgttctgcgagaagatcttcggcccgacgcgggactgggagtgccactgcggcaagtacaagcggatccgctacaagggtgtcgtgtgtgaccgctgcggcgttgaggtcacgcggtccaaggtgcgccgcgagcgcatggggcacatcgagctggcggcgcccgtctcgcacatctggttcttcaagggcatcccgagccgcatggggctcatcctcgacatgtcgccgcgggcgctcgaggaggtcatctacttcgcgtcgtacgtcgtgaccgatcccggcgatacgccgctcgagaaaaagcagctgctctcggagaaggagtaccggtcctaccgcgagaagtacggctacgcgttcaaagcgggcatgggcgccgaggccatccgcacgctcctgcaggagatcgatcttgaccgcgaggttgagatcctgcgcgaggagctgcgcacggcccaagggcagcggcgcaaccgggccatcaagcgcctagaggtcatcgaggcgttccgtcagtccggcaacaagccgagctggatgatcctcgaggcgctgccggtcattccgccggacctgcgtcccatggtgcagctggacggcggccgcttcgccacgtccgacctgaacgatctgtaccgccgcgtcatcaaccgcaacaaccgcctgaagcgactgctcgatctcggcgcgcccgacatcatcgtgcagaacgagaagcggatgttgcaggaggctgtggacgcgctgatcgacaacggccggcgtggacgcccggtcacaggacccggcaatcggccgctcaagagcctgtcgcacatgctgaagggcaagcagggccgcttccgccagaacctgctcgggaagcgcgtcgactactccggccgatccgtcatcgtggtggggcccgagctgcgcatgtaccagtgcggcctgccgaaagagatggcgcttgagttgttcaagccgttcgtcatgaaggaactggtggcgcgcgggctcgcgcacaacatcaagagcgcgaagcgcaaggtcgagcgcgtgtcggatgaagtgtgggacgtcgtcgaggacgtcatcaaacagcaccctgtgctgttgaaccgcgcgccgacgctgcaccgtctgggcattcaggcgttcgagcccgtccttgtcgaagggcgcgccatcaagctgcatcctctcgtctgcacggcgtacaacgcggatttcgacggcgaccagatggccgtgcacgtgccgctttccgccgaggcgcaggcggaggcgcgcctgctgatgcttgccgcgcacaacatcctgaacccgaaggacggcaagccggtcgtgacgccgacgcaggacatggtgctcggatcctactatttgaccatcgagcgcgagggcgcgcccggcgaaggcaaggtctttgcgtccgtgtctgaggtggagtacgcgctccatcagcggctcatcacgctgcagacgcgcatcgcgctgccggccaaggcggtcggcaagacgtcgttcacggagaagcaggcgaatgcgctcctgatcacgacgccgggcaagctcatcttcaacagcatcttcccgtccgacttcccgtatctgaactctgcggcgaagtccaacctgctcggcggtccgccggacgacacgttcatcttcgagaagggcgtggacatccgcgaggcgattctcaagcgcccgatcccgaaggcggtcatcaagaaggatctgggcaacattctggccgaatgcttccgccgctatggcacgacgatgacggccgagatcctcgacaaggtgaagcggctcgggttccactattcgacgctcgccggtatcaccatctcgatcagcgacatcgtggtgcccgaagagaagaagcgcatcatcgccgaggcggaggcgaaggaacacaagctgaagcttcaataccggcgcggtctcatcacggaagaggagcagtacgtgaccttcagccagatctggtcggaggccaaggagcagatctcgtccatcctcatggagagcatggaccagttcaatcccatttatatgatggccacttccggtgcgcgcggttcgaactcgcagatcacgcagctcgcgggcatgcgcgggctcatggcgaacccgtcgggcgagatcatccagctggccatcaagtcgaacttccgcgagggcctgtcggtgttggagtacttcatctcgacccacggcgcgcgcaagggcctcgctgacacggcgctgcgcacggcggactcgggttatctcacgcgccgcctcgtcgacgtggcgcaggacacgattgtgcgtgagcacgactgcggcaccgacaagggcctgcgggtcatggagatccgcgatggcagcgaggtcatcgaagacttgcgcgatcgcctcgaaggtcgtgtcgcgttccaggatgtgtatcacccggagacgggcgagaagatcgtcggcaagaacgagatgatcgacgaggaagccgcggacaagattgtcgcggcgggcatcaaagaggttaccatccgctccgtcctgacctgtcgcacgcgtcacggggtgtgccagctctgctacggccgcaacttggcgacgggcgatatggtcgaggtgggcgaggcggtcggcatcatcgccgcgcagtccatcggcgagccgggtacgcagctcaccatgcgcacgttccacacgggcggcgtggcgggtgacgacatcacccagggtctgccgcgcgtgcaggaactctttgaggcgcgcaacccgaaaggtcaggccgtgatcgcggagttcgacggcgtcatcaccgacatccgcgagggcaaggacaagcgcgaaatcgagctcacgggcgagagcgagacgaagacgtatcagatcccgtacgggtcgcggattcgggtgagcgtgggccagcagttggaggccggcgaggagctcacggagggctcggtcgatccgaaggagatgctgcgcgtcaagggcctgcagggcgtgcaaaactacctgctgcgcgaggtgcagcgcgtttaccgcctgcagggcgtggacatcaacgacaagcacatcgaggtcatgatccggcagatgttgcgcaaagttcgcatcctcgacgctggagacacggatctcctgccggggacgtacgtggatctcttcgagtacgaagccgccaaccgggaggcacttctctcgggcaaggagcctgcggtggcgcgcccggcgctgcttgggatcaccaaggcgtcgcttgagacggattcgttcctctcggccgcgtcattccaagagacgacccgcgtgctcaccgaggcggccatcaagggcaaggtagatcgcctgctcggcctgaaggagaacgtgatcatcggcaagttgatcccggcgggcacgggcatggtgaggtaccgcaacgtggagccggaggtcgtgcgcccgggcgacgcagaggcggctgcgacaggcgaagaggttgccgaaaccgaggctgtgtcgagcgcggagtga

SEQ ID NO: 462 - protein, 1183 aa, Paenibacillus larvae subsp. larvae BRL-230010
MMDVNNFEFMKIGLASPDKIRSWSRGEVKKPETINYRTLKPEKEGLFCEKIFGPTKDWECHCGKYKRVRYKGVVCDRCGVEVTRQKVRRERMGHIELAAPVSHIWYFKGIPSRMGLALDMSPRSLEEIIYFASYVVTDPGDTPLEKKQLLSEKEYRSYREKYGYAFQAGMGAEAVKKLLQDIDIDKEVDVLKEELRTAQGQRRNRAIKRLEVMEAFRNSKNKPDWMILDVLPVIPPELRPMVQLDGGRFATSDLNDLYRRVINRNNRLKRLLDLGAPDIIVQNEKRMLQEAVDALIDNGRRGRPVTGPGNRPLKSLSHMLKGKQGRFRQNLLGKRVDYSGRSVIVVGPSLKMYQCGLPKEMALELFKPFVMKELVNKQLAHNIKSAKRKVERVSPEVWDVLEEVIKEHPVLLNRAPTLHRLGIQAFEPILVEGRAIMLHPLVCTAYNADFDGDQMAVHVPLSAEAQAEARILMLAAGNILNPKDGKPVVTPSQDMVLGSFYLTTDNKHAKGSGMILRSVHEAFSVYQNGTAELHARVAIPAKALNKISFTDKQQDAYLITTIGKIIFNEIFPKDFPYINQSTTSNLMHGPSDDYFAFEKGSDIRAKMEELPECKAVGKDYLGSIIAECFRKYHTTETSIILDKVKQLGFTYSTKAGITVAVADVIVPKEKQEILKESEQKVQTITNQYRRGLITDDERYDRVIAIWSKAKDDITDILMKSLDKYNSINMMVESKARGNKSQITQLGGMRGLMANPAGKIIELPIKSNFREGLTVLEYFISTHGARKGLADTALRTADSGYLTRRLVDVAQDVIVREEDCGTDKGFVVSKIQDGKEVIEDLFDRIEGRYAFETVRHPETGEIIVHRNELIDANLASRIVEAGVEKIQIRSVMSCRARYGVCKKCYGRNLATGQHVEIGEAVGIIAAQSIGEPGTQLTMRTFHTGGVAGDDITQGLPRIQELFEARNPKGQAIITEIDGMVKDIREAKDRREIEVEGEAESRVYSVPFGSRIRVAVNDHIEAGDELTEGSIDPKEMLRIKGIRGVQNYILQEVQRVYRNQGVEINDKHVEVMIRQMLRKIRIVDAGDTNLLPGSFVDMHEYEEANKTALLEGREPAVAKPILLGITKASLETDSFLSAASFQETTRVLTDAAIKGKVDQLLGLKENVIIGKLIPAGTGMQRYRNI

SEQ ID NO: 463 - protein, 1190 aa, Geobacillus thermodenitrificans NG80-2
VYPLLDVNKFEYMKIGLASPEKIRSWSYGEVKKPETINYRTLKPEKDGLFCERIFGPTKDWECHCGKYKRVRYKGVVCDRCGVEVTRSKVRRERMGHIELAAPVSHIWYFKGIPSRMGLVLDMSPRALEEVIYFASYVVTDPGDTPLEKKQLLSEKEYRAYREKYGQSFQASMGAEAIKKLLQDIDLDKEVATLKEELKTAQGQRRARIIKRLEVLESFRSSGNDPAWMVLDVLPVIPPELRPMVQLDGGRFATSDLNDLYRRVINRNNRLKRLLDLGAPNIIVQNEKRMLQEAVDALIDNGRRGRPVTGPGNRPLKSLSHMLKGKQGRFRQNLLGKRVDYSGRSVIVVGPNLKMYQCGLPKEMALELFKPFVMKELVERGLAHNIKSAKRKIERVHPEVWDVLEDVIKEHPVLLNRAPTLHRLGIQAFEPTLVEGRAIRLHPLVCTAYNADFDGDQMAVHVPLSAEAQAEARLLMLAAQNILNPKDGKPVVTPSQDMVLGNYYLTMEREGAIGEGMVFKDTDEALLAYHNGYVHLHSRIAIHAGSLKNETFTPEQNNKLLLTTVGKLIFNEILPKSFPYINEPTTENIEGRTPDKYFLDKGVDVREEIRKRELVPPFKKKVLGQIIAEVFKRFKITETSKMLDRMKDLGFQYSTKAGITIGVSDIVVLPEKQEILDEAQAKVDTVLKQFRRGLITDEERYERVISVWSAAKDKIQDRLMKSLDKRNPIFMMSDSGARGNASNFTQLAGMRGLMANPAGRIIELPIKSSFREGLTVLEYFISTHGARKGLADTALKTADSGYLTRRLVDVAQDVIVREEDCGTDRGILARALTDGTEVVVKLEERLVGRYAHKTVHHPETGEVIVRKDEMITEDIANEIIKAGITEVWIRSVFACNTRHGVCKKCYGRNMATGMDVEVGEAVGIIAAQSIGEPGTQLTMRTFHTGGVAGDDITQGLPRVQELFEARNPKGQAVISEIDGTVVAINETRDNQYEIVVQSEVETRSYVAPYNARLKVEEGQHVERGQELTEGSVDPKQLLRVRDITSVQEYLLREVQKVYRMQGVEISDKHIEVMVRQMLRKVRVIDAGDTDVLPGTLLDVHQFTDVNAQAIREGKRPATARPVLLGITKASLETDSFLSAASFQETTRVLTDAAIKGKRDELLGLKENVIIGKLVPAGTGMARYRNVKPAV

SEQ ID NO: 464 - protein, 1182 aa, Bacillus halodurans C-125
MIDVNNFEYMKIGLASPNKIRSWSRGEVKKPETINYRTLKPEKDGLFCERIFGPQKDWECHCGKYKRVRYKGVVCDRCGVEVTRAKVRRERMGHIELAAPVSHIWYFKGIPSRMGLVLDMSPRSLEEVIYFASYVVTDPGDTPLEKKQLLSEKEFRAYLDKYGRSFTAQMGAEAIRKLLMDIDLDKEVDGLKEELQTAQGQRRTRAIKRLEVLEAFRNSGNEPSWMILDVLPVIPPELRPMVQLDGGRFATSDLNDLYRRVINRNNRLKRLLDLGAPSIIVQNEKRMLQEAVDALIDNGRRGRPVTGPGNRPLKSLSHMLKGKQGRFRQNLLGKRVDYSGRSVIVVGPNLKMYQCGLPKEMALELFKPFVMKELVSKGLAHNIKSAKRKVERVQPEVWDVLEEVIKEHPVLLNRAPTLHRLGIQAFEPTLVEGRAIKLHPLVCTAYNADFDGDQMAVHVPLSAEAQAEARILMLAAQNILNPKDGKPVVTPSQDMVLGNYYLTMEREGAKGEGSVFKDTNEALIAYQNGYVHLHTRIAIPVASLGKTTFKEEQNSQLLLTTVGKLIFNEILPESFPYVNEPTAHNLEVETPSKYMVPTSTNVKELFQERDVVAPFKKGFLGNIIAEVFKKFKITETSKMLDRMKDLGFKYSTKAGITVGVADIVVLPEKKEILAEAEKKVDRVLKQFRRGLITEEERYDRVISIWSEAKDVIQDKLMGSLDKRNPIFMMSDSGARGNASNFTQLAGMRGLMANPSGRIIELPIKSSFREGLTVLEYFISTHGARKGLADTALKTADSGYLTRRLVDVAQDVIVREDDCGTDRGLEVEAIKEGNEIIEGLYDRLVGRVAFKTVRHPETGEPIVKKNELIHEDLAKQIVEAGVEQVTIRSVFTCDTRHGVCKKCYGRNLATGSDVEVGEAVGIIAAQSIGEPGTQLTMRTFHTGGVAGDDITQGLPRIQELFEARNPKGQAVITEIEGEVTNINEADKREITVKGEMETKTYSIPYGARIKVELGEQVVPGQSLTEGSIDPKELLKVQGMTGVQEYLLREVQKVYRMQGVEIGDKHVEVMVRQMLRKIRVIDAGDTEVLPGSLIEIQHFNDENKKVLLSGKRPATGRPVLLGITKASLETDSFLSAASFQETTRVLTDAAIKGKRDELVGLKENVIIGKLVPAGTGMNRYRNLD

SEQ ID NO: 465 - protein, 1187 aa, Geobacillus kaustophilus HTA426
MLDVNKFEYMKIGLASPEKIRSWSYGEVKKPETINYRTLKPEKDGLFCERIFGPTKDWECHCGKYKRVRYKGVVCDRCGVEVTRSKVRRERMGHIELAAPVSHIWYFKGIPSRMGLVLDMSPRALEEVIYFASYVVTDPGDTPLEKKQLLSEKEYRAYREKYGQSFQASMGAEAIKKLLQDIDLDKEVAALKEELKTAQGQRRARIIKRLEVLEAFRSSGNDPAWMVLDVLPVIPPELRPMVQLDGGRFATSDLNDLYRRVINRNNRLKRLLDLGAPNIIVQNEKRMLQEAVDALIDNGRRGRPVTGPGNRPLKSLSHMLKGKQGRFRQNLLGKRVDYSGRSVIVVGPNLKMYQCGLPKEMALELFKPFVMKELVERGLAHNIKSAKRKIERVHPEVWDVLEDVIKEHPVLLNRAPTLHRLGIQAFEPTLVEGRAIRLHPLVCTAYNADFDGDQMAVHVPLSAEAQAEARLLMLAAQNILNPKDGKPVVTPSQDMVLGNYYLTMEREGAIGEGMVFKDTDEALLAYHNGYVHLHSRIAIHAGSLKNETFTEEQNNKLLLTTVGKLIFNEILPNSFPYINEPTTENIEGRTPDKYFLDKGVNVREEIRKRELVPPFKKKVLGQIIAEVFKRFKITETSKMLDRMKDLGFQYSTKAGITIGVADIVVLPEKQEILDEAQAKVDTVLKQFRRGLITDEERYERVISIWSAAKDKIQDRLMKSLDKRNPIFMMSDSGARGNASNFTQLAGMRGLMANPAGRIIELPIKSSFREGLTVLEYFISTHGARKGLADTALKTADSGYLTRRLVDVAQDVIVREEDCGTDRGILARALTDGTEVVVKLEERLVGRYAHKTVRHPETGEVIVRKDEMITEDIANEIMKAGITEVWIRSVFACNTRHGVCKKCYGRNMATGMDVEVGEAVGIIAAQSIGEPGTQLTMRTFHTGGVAGDDITQGLPRVQELFEARNPKGQAVISEIDGTVISINKTRDNQYEVVVQGEVETRTYVAPYNARLKVEEGQRVERGQELTEGSVDPKQLLRVRDITSVQEYLLREVQKVYRMQGVEISDKHIEVMVRQMLRKVRVIDAGDTDVLPGTLLDVHQFTDVNAKALREGKRPATARQVLLGITKASLETDSFLSAASFQETTRVLTDAAIKGKRDELLGLKENVIIGKLVPAGTGMARYRKVKPAV

SEQ ID NO: 466 - protein, 1183 aa, Bacillus cereus ATCC 10987
MIDVNNFEYMKIGLASPDKIRSWSYGEVKKPETINYRTLKPEKDGLFCERIFGPQKDWECHCGKYKRVRYKGVVCDRCGVEVTRAKVRRERMGHIELAAPVSHIWYFKGIPSRMGLVLDMSPRALEEVIYFASYVVTESGDTPLDKKQLLSEKEYRAYRDRYGSTFQAAMGAEAIKKLLQDIDLDKEVDFLKEELKTAQGQRRTRAIKRLEVLEAFRNSGNEPSWMILDVLPVIPPELRPMVQLDGGRFATSDLNDLYRRVINRNNRLKRLLDLGAPSIIVQNEKRMLQEAVDALIDNGRRGRPVTGPGNRPLKSLSHMLKGKQGRFRQNLLGKRVDYSGRSVIVVGPNLKMYQCGLPKEMALELFKPFVMKELVEKGLAHNIKSAKRKIERVQPEVWDVLESVIKEHPVLLNRAPTLHRLGIQAFEPTLVEGRAIRLHPLVCTAYNADFDGDQMAVHVPLSSEAQAEARLLMLAAQNILNPKDGKPVVTPSQDMVLGNYYLTLEREGAIGEGMVFKDANEALLAYQNGYVHLHTRVAVAASAVNNATFTEEQKSMLLLTTVGKLIFNEILPESFPYINEPTNSNLEKETPAKYFVEKGANIKEIIASREEVAPFSKKILGNIIAEVFKRFKITETSRMLDRMKNLGFKYSTKAGITVGVSDILVLGEKDEILHEAQAKVDNVIKQFRRGLITEEERYDRVISIWSNAKDVIQGKLMKSLNKRNPIFMMSDSGARGNASNFTQLAGMRGLMANPSGRIIELPIKSSFREGLTVLEYFISTHGARKGLADTALKTADSGYLTRRLVDVAQDVIVREDDCGTDRGLLIGAIKEGNEVIESLYDRLVGRFARKTVKHPETGEVLVAENQLITEDIAHIVENSGVETVNIRSAFTCNTRHGVCKKCYGRNLATGTDVEVGEAVGIIAAQSIGEPGTQLTMRTFHTGGVAGDDITQGLPRIQEIFEARNPKGQAVISEIDGVIAAINDVKDRQEVVVQGEVETRTYAIPYGARLKVIPGQQISHGKELTEGSIDPKELLKVTDITAVQEYLLREVQKVYRMQGVEIGDKHVEVMVRQMLRKVRVSDAGETDVLPGTLLDIHQFTDANAKVLLQGKQPATARPVLLGITKASLETDSFLSAASFQETTRVLTDAAIKGKRDELLGLKENVIIGKLVPAGTGMNRYRKVD

SEQ ID NO: 467 - protein, 1215 aa, Artificial
  Substituion in SEQ ID NO 460
MHKLFDLNNFEFMKIGLASPEKIRSWSHGEVKKPETINYRTLRPEKEGLFCEKIFGPTRDWECHCGKYKRIRYKGVVCDRCGVEVTRSKVRRERMGHIELAAPVSHIWFFKGIPSRMGLILDMSPRALEEVIYFASYVVTDPGDTPLEKKQLLSEKEYRSYREKYGYAFKAGMGAEAIRTLLQEIDLDREVEILREELRTAQGQRRNRAIKRLEVIEAFRQSGNKPSWMILEALPVIPPDLRPMVQLDGGRFATSDLNDLYRRVINRNNRLKRLLDLGAPDIIVQNEKRMLQEAVDALIDNGRRGRPVTGPGNRPLKSLSHMLKGKQGRFRQNLLGKRVDYSGRSVIVVGPELRMYQCGLPKEMALELFKPFVMKELVARGLAHNIKSAKRKVERVSDEVWDVVEDVIKQHPVLLNRAPTLHRLGIQAFEPVLVEGRAIKLHPLVCTAYNADFDGDQMAVHVPLSAEAQAEARLLMLAAHNILNPKDGKPVVTPTQDMVLGSYYLTIEREGAPGEGKVFASVSEVEYALHQRLITLQTRIALPAKAVGKTSFTEKQANALLITTPGKLIFNSIFPSDFPYLNSAAKSNLLGGPPDDTFIFEKGVDIREAILKRPIPKAVIKKDLGNILAECFRRYGTTMTAEILDKVKRLGFHYSTLAGITISISDIVVPEEKKRIIAEAEAKEHKLKLQYRRGLITEEEQYVTFSQIWSEAKEQISSILMESMDQFNPIYMMATSGARGSNSQITQLAGMRGLMANPSGEIIQLAIKSNFREGLSVLEYFISTHGARKGLADTALRTADSGYLTRRLVDVAQDTIVREHDCGTDKGLRVMEIRDGSEVIEDLRDRLEGRVAFQDVYHPETGEKIVGKNEMIDEEAADKIVAAGIKEVTIRSVLTCRTRHGVCQLCYGRNLATGDMVEVGEAVGIIAAQSIGEPGTQLTMRTFHTGGVAGDDITQGLPRVQELFEARNPKGQAVIAEFDGVITDIREGKDKREIELTGESETKTYQIPYGSRIRVSVGQQLEAGEELTEGSVDPKEMLRVKGLQGVQNYLLREVQRVYRLQGVDINDKHIEVMIRQMLRKVRILDAGDTDILPGTYVDLFEYEAANREALLSGKEPAVARPALLGITKASLETDSFLSAASFQETTRVLTEAAIKGKVDRLLGLKENVIIGKLIPAGTGMVRYRNVEPEVVRPGDAEAAATGEEVAETEAVSSAE

SEQ ID NO: 468 - protein, 1215 aa, Artificial
  Substituion in SEQ ID NO 460
MHKLFDLNNFEFMKIGLASPEKIRSWSHGEVKKPETINYRTLRPEKEGLFCEKIFGPTRDWECHCGKYKRIRYKGVVCDRCGVEVTRSKVRRERMGHIELAAPVSHIWFFKGIPSRMGLILDMSPRALEEVIYFASYVVTDPGDTPLEKKQLLSEKEYRSYREKYGYAFKAGMGAEAIRTLLQEIDLDREVEILREELRTAQGQRRNRAIKRLEVIEAFRQSGNKPSWMILEALPVIPPDLRPMVQLDGGRFATSDLNDLYRRVINRNNRLKRLLDLGAPDIIVQNEKRMLQEAVDALIDNGRRGRPVTGPGNRPLKSLSHMLKGKQGRFRQNLLGKRVDYSGRSVIVVGPELRMYQCGLPKEMALELFKPFVMKELVARGLAHNIKSAKRKVERVSDEVWDVVEDVIKQHPVLLNRAPTLHRLGIQAFEPVLVEGRAIKLHPLVCTAYNADFDGDQMAVHVPLSAEAQAEARLLMLAAHNILNPKDGKPVVTPTQDMVLGSYYLTIEREGAPGEGKVFASVSEVEYALHQRLITLQTRIALPAKAVGKTSFTEKQANALLITTPGKLIFNSIFPSDFPYLNSAAKSNLLGGPPDDTFIFEKGVDIREAILKRPIPKAVIKKDLGNILAECFRRYGTTMTAEILDKVKRLGFHYSTLAGITISISDIVVPEEKKRIIAEAEAKEHKLKLQYRRGLITEEEQYVTFSQIWSEAKEQISSILMESMDQFNPIYMMATSGARGSNSQITQLAGMRGLMANPSGEIIQLAIKSNFREGLSVLEYFISTHGARKGLADTALRTADSGYLTRRLVDVAQDTIVREHDCGTDKGLRVMEIRDGSEVIEDLRDRLEGRVAFQDVYHPETGEKIVGKNEMIDEEAADKIVAAGIKEVTIRSVLTCRTRHGVCQLCYGRNLATGDMVEVGEAVGIIAAQSIGEPGTQLTMRTFHTGGVAGDDITQGLPRVQELFEARNPKGQAVIAEFDGVITDIREGKDKREIELTGESETKTYQIPYGSRIRVSVGQQLEAGEELTEGSVDPKEMLRVKGLQGVQNYLLREVQRVYRLQGVDINDKHIEVMIRQMLRKVRILDAGDTDLLPGTYVDLFEYEAANREALLSGKEPAVARPALLGITKASLETDSFLSAASFQETTRVLTEAAIKGKVDRLLGLKENVIIGKLIPAGTGMVRYRNVEPEVVRPGEAEAAATGEEVAETEAVSSAE

SEQ ID NO: 469 - protein, 1215 aa, Artificial
  Substituion in SEQ ID NO 460
MHKLFDLNNFEFMKIGLASPEKIRSWSHGEVKKPETINYRTLRPEKEGLFCEKIFGPTRDWECHCGKYKRIRYKGVVCDRCGVEVTRSKVRRERMGHIELAAPVSHIWFFKGIPSRMGLILDMSPRALEEVIYFASYVVTDPGDTPLEKKQLLSEKEYRSYREKYGYAFKAGMGAEAIRTLLQEIDLDREVEILREELRTAQGQRRNRAIKRLEVIEAFRQSGNKPSWMILEALPVIPPDLRPMVQLDGGRFATSDLNDLYRRVINRNNRLKRLLDLGAPDIIVQNEKRMLQEAVDALIDNGRRGRPVTGPGNRPLKSLSHMLKGKQGRFRQNLLGKRVDYSGRSVIVVGPELRMYQCGLPKEMALELFKPFVMKELVARGLAHNIKSAKRKVERVSDEVWDVVEDVIKQHPVLLNRAPTLHRLGIQAFEPVLVEGRAIKLHPLVCTAYNADFDGDQMAVHVPLSAEAQAEARLLMLAAHNILNPKDGKPVVTPTQDMVLGSYYLTIEREGAPGEGKVFASVSEVEYALHQRLITLQTRIALPAKAVGKTSFTEKQANALLITTPGKLIFNSIFPSDFPYLNSAAKSNLLGGPPDDTFIFEKGVDIREAILKRPIPKAVIKKDLGNILAECFRRYGTTMTAEILDKVKRLGFHYSTLAGITISISDIVVPEEKKRIIAEAEAKEHKLKLQYRRGLITEEEQYVTFSQIWSEAKEQISSILMESMDQFNPIYMMATSGARGSNSQITQLAGMRGLMANPSGEIIQLAIKSNFREGLSVLEYFISTHGARKGLADTALRTADSGYLTRRLVDVAQDTIVREHDCGTDKGLRVMEIRDGSEVIEDLRDRLEGRVAFQDVYHPETGEKIVGKNEMIDEEAADKIVAAGIKEVTIRSVLTCRTRHGVCQLCYGRNLATGDMVEVGEAVGIIAAQSIGEPGTQLTMRTFHTGGVAGDDITQGLPRVQELFEARNPKGQAVIAEFDGVITDIREGKDKREIELTGESETKTYQIPYGSRIRVSVGQQLEAGEELTEGSVDPKEMLRVKGLQGVQNYLLREVQRVYRLQGVDINDKHIEVMIRQMLRKIRILDAGDTDLLPGTYVDLFEYEAANREALLSGKEPAVARPALLGITKASLETDSFLSAASFQETTRVLTEAAIKGKVDRLLGLKENVIIGKLIPAGTGMVRYRNVEPEVVRPGDAEAAATGEEVAETEAVSSAE

SEQ ID NO: 470 - protein, 1215 aa, Artificial
  Substituion in SEQ ID NO 460
MHKLFDLNNFEFMKIGLASPEKIRSWSHGEVKKPETINYRTLRPEKEGLFCEKIFGPTRDWECHCGKYKRIRYKGVVCDRCGVEVTRSKVRRERMGHIELAAPVSHIWFFKGIPSRMGLILDMSPRALEEVIYFASYVVTDPGDTPLEKKQLLSEKEYRSYREKYGYAFKAGMGAEAIRTLLQEIDLDREVEILREELRTAQGQRRNRAIKRLEVIEAFRQSGNKPSWMILEALPVIPPDLRPMVQLDGGRFATSDLNDLYRRVINRNNRLKRLLDLGAPDIIVQNEKRMLQEAVDALIDNGRRGRPVTGPGNRPLKSLSHMLKGKQGRFRQNLLGKRVDYSGRSVIVVGPELRMYQCGLPKEMALELFKPFVMKELVARGLAHNIKSAKRKVERVSDEVWDVVEDVIKQHPVLLNRAPTLHRLGIQAFEPVLVEGRAIKLHPLVCTAYNADFDGDQMAVHVPLSAEAQAEARLLMLAAHNILNPKDGKPVVTPTQDMVLGSYYLTIEREGAPGEGKVFASVSEVEYALHQRLITLQTRIALPAKAVGKTSFTEKQANALLITTPGKLIFNSIFPSDFPYLNSAAKSNLLGGPPDDTFIFEKGVDIREAILKRPIPKAVIKKDLGNILAECFRRYGTTMTAEILDKVKRLGFHYSTLAGITISISDIVVPEEKKRIIAEAEAKEHKLKLQYRRGLITEEEQYVTFSQIWSEAKEQISSILMESMDQFNPIYMMATSGARGSNSQITQLAGMRGLMANPSGEIIQLAIKSNFREGLSVLEYFISTHGARKGLADTALRTADSGYLTRRLVDVAQDTIVREHDCGTDKGLRVMEIRDGSEVIEDLRDRLEGRVAFQDVYHPETGEKLVGKNEMIDEEAADKIVAAGIKEVTIRSVLTCRTRHGVCQLCYGRNLATGDMVEVGEAVGIIAAQSIGEPGTQLTMRTFHTGGVAGDDITQGLPRVQELFEARNPKGQAVIAEFDGVITDIREGKDKREIELTGESETKTYQIPYGSRIRVSVGQQLEAGEELTEGSVDPKEMLRVKGLQGVQNYLLREVQRVYRLQGVDINDKHIEVMIRQMLRKVRILDAGDTDLLPGTYVDLFEYEAANREALLSGKEPAVARPALLGITKASLETDSFLSAASFQETTRVLTEAAIKGKVDRLLGLKENVIIGKLIPAGTGMVRYRNVEPEVVRPGDAEAAATGEEVAETEAVSSAE

SEQ ID NO: 471 - protein, 1215 aa, Artificial
  Substituion in SEQ ID NO 460
MHKLFDLNNFEFMKIGLASPEKIRSWSHGEVKKPETINYRTLRPEKEGLFCEKIFGPTRDWECHCGKYKRIRYKGVVCDRCGVEVTRSKVRRERMGHIELAAPVSHIWFFKGIPSRMGLILDMSPRALEEVIYFASYVVTDPGDTPLEKKQLLSEKEYRSYREKYGYAFKAGMGAEAIRTLLQEIDLDREVEILREELRTAQGQRRNRAIKRLEVIEAFRQSGNKPSWMILEALPVIPPDLRPMVQLDGGRFATSDLNDLYRRVINRNNRLKRLLDLGAPDIIVQNEKRMLQEAVDALIDNGRRGRPVTGPGNRPLKSLSHMLKGKQGRFRQNLLGKRVDYSGRSVIVVGPELRMYQCGLPKEMALELFKPFVMKELVARGLAHNIKSAKRKVERVSDEVWDVVEDVIKQHPVLLNRAPTLHRLGIQAFEPVLVEGRAIKLHPLVCTAYNADFDGDQMAVHVPLSAEAQAEARLLMLAAHNILNPKDGKPVVTPTQDMVLGSYYLTIEREGAPGEGKVFASVSEVEYALHQRLITLQTRIALPAKAVGKTSFTEKQANALLITTPGKLIFNSIFPSDFPYLNSAAKSNLLGGPPDDTFIFEKGVDIREAILKRPIPKAVIKKDLGNILAECFRRYGTTMTAEILDKVKRLGFHYSTLAGITISISDIVVPEEKKRIIAEAEAKEHKLKLQYRRGLITEEEQYVTFSQIWSEAKEQISSILMESMDQFNPIYMMATSGARGSNSQITQLAGMRGLMANPSGEIIQLAIKSNFREGLSVLEYFISTHGARKGLADTALRTADSGYLTRRLVDVAQDTIVREHDCGTDKGLRVMEIRDGSEVIEDLRDRLEGRVAFQDVYHPETGEKIVGKNEMIDEEAADKIVAAGIKEVTIRSVLTCRTRHGVCNLCYGRNLATGDMVEVGEAVGIIAAQSIGEPGTQLTMRTFHTGGVAGDDITQGLPRVQELFEARNPKGQAVIAEFDGVITDIREGKDKREIELTGESETKTYQIPYGSRIRVSVGQQLEAGEELTEGSVDPKEMLRVKGLQGVQNYLLREVQRVYRLQGVDINDKHIEVMIRQMLRKVRILDAGDTDLLPGTYVDLFEYEAANREALLSGKEPAVARPALLGITKASLETDSFLSAASFQETTRVLTEAAIKGKVDRLLGLKENVIIGKLIPAGTGMVRYRNVEPEVVRPGDAEAAATGEEVAETEAVSSAE

SEQ ID NO: 472 - DNA, 3648 bp, Artificial
  Substituion in SEQ ID NO 461
gtgcacaagttgtttgacctgaacaactttgagttcatgaagattgggctcgcgtcgccggaaaagatccgctcctggtcgcacggcgaggtgaagaagccggagaccatcaactaccgcacgctccgcccggagaaggaggggctgttctgcgagaagatcttcggcccgacgcgggactgggagtgccactgcggcaagtacaagcggatccgctacaagggtgtcgtgtgtgaccgctgcggcgttgaggtcacgcggtccaaggtgcgccgcgagcgcatggggcacatcgagctggcggcgcccgtctcgcacatctggttcttcaagggcatcccgagccgcatggggctcatcctcgacatgtcgccgcgggcgctcgaggaggtcatctacttcgcgtcgtacgtcgtgaccgatcccggcgatacgccgctcgagaaaaagcagctgctctcggagaaggagtaccggtcctaccgcgagaagtacggctacgcgttcaaagcgggcatgggcgccgaggccatccgcacgctcctgcaggagatcgatcttgaccgcgaggttgagatcctgcgcgaggagctgcgcacggcccaagggcagcggcgcaaccgggccatcaagcgcctagaggtcatcgaggcgttccgtcagtccggcaacaagccgagctggatgatcctcgaggcgctgccggtcattccgccggacctgcgtcccatggtgcagctggacggcggccgcttcgccacgtccgacctgaacgatctgtaccgccgcgtcatcaaccgcaacaaccgcctgaagcgactgctcgatctcggcgcgcccgacatcatcgtgcagaacgagaagcggatgttgcaggaggctgtggacgcgctgatcgacaacggccggcgtggacgcccggtcacaggacccggcaatcggccgctcaagagcctgtcgcacatgctgaagggcaagcagggccgcttccgccagaacctgctcgggaagcgcgtcgactactccggccgatccgtcatcgtggtggggcccgagctgcgcatgtaccagtgcggcctgccgaaagagatggcgcttgagttgttcaagccgttcgtcatgaaggaactggtggcgcgcgggctcgcgcacaacatcaagagcgcgaagcgcaaggtcgagcgcgtgtcggatgaagtgtgggacgtcgtcgaggacgtcatcaaacagcaccctgtgctgttgaaccgcgcgccgacgctgcaccgtctgggcattcaggcgttcgagcccgtccttgtcgaagggcgcgccatcaagctgcatcctctcgtctgcacggcgtacaacgcggatttcgacggcgaccagatggccgtgcacgtgccgctttccgccgaggcgcaggcggaggcgcgcctgctgatgcttgccgcgcacaacatcctgaacccgaaggacggcaagccggtcgtgacgccgacgcaggacatggtgctcggatcctactatttgaccatcgagcgcgagggcgcgcccggcgaaggcaaggtctttgcgtccgtgtctgaggtggagtacgcgctccatcagcggctcatcacgctgcagacgcgcatcgcgctgccggccaaggcggtcggcaagacgtcgttcacggagaagcaggcgaatgcgctcctgatcacgacgccgggcaagctcatcttcaacagcatcttcccgtccgacttcccgtatctgaactctgcggcgaagtccaacctgctcggcggtccgccggacgacacgttcatcttcgagaagggcgtggacatccgcgaggcgattctcaagcgcccgatcccgaaggcggtcatcaagaaggatctgggcaacattctggccgaatgcttccgccgctatggcacgacgatgacggccgagatcctcgacaaggtgaagcggctcgggttccactattcgacgctcgccggtatcaccatctcgatcagcgacatcgtggtgcccgaagagaagaagcgcatcatcgccgaggcggaggcgaaggaacacaagctgaagcttcaataccggcgcggtctcatcacggaagaggagcagtacgtgaccttcagccagatctggtcggaggccaaggagcagatctcgtccatcctcatggagagcatggaccagttcaatcccatttatatgatggccacttccggtgcgcgcggttcgaactcgcagatcacgcagctcgcgggcatgcgcgggctcatggcgaacccgtcgggcgagatcatccagctggccatcaagtcgaacttccgcgagggcctgtcggtgttggagtacttcatctcgacccacggcgcgcgcaagggcctcgctgacacggcgctgcgcacggcggactcgggttatctcacgcgccgcctcgtcgacgtggcgcaggacacgattgtgcgtgagcacgactgcggcaccgacaagggcctgcgggtcatggagatccgcgatggcagcgaggtcatcgaagacttgcgcgatcgcctcgaaggtcgtgtcgcgttccaggatgtgtatcacccggagacgggcgagaagatcgtcggcaagaacgagatgatcgacgaggaagccgcggacaagattgtcgcggcgggcatcaaagaggttaccatccgctccgtcctgacctgtcgcacgcgtcacggggtgtgccagctctgctacggccgcaacttggcgacgggcgatatggtcgaggtgggcgaggcggtcggcatcatcgccgcgcagtccatcggcgagccgggtacgcagctcaccatgcgcacgttccacacgggcggcgtggcgggtgacgacatcacccagggtctgccgcgcgtgcaggaactctttgaggcgcgcaacccgaaaggtcaggccgtgatcgcggagttcgacggcgtcatcaccgacatccgcgagggcaaggacaagcgcgaaatcgagctcacgggcgagagcgagacgaagacgtatcagatcccgtacgggtcgcggattcgggtgagcgtgggccagcagttggaggccggcgaggagctcacggagggctcggtcgatccgaaggagatgctgcgcgtcaagggcctgcagggcgtgcaaaactacctgctgcgcgaggtgcagcgcgtttaccgcctgcagggcgtggacatcaacgacaagcacatcgaggtcatgatccggcagatgttgcgcaaagttcgcatcctcgacgctggagacacggatattctgccggggacgtacgtggatctcttcgagtacgaagccgccaaccgggaggcacttctctcgggcaaggagcctgcggtggcgcgcccggcgctgcttgggatcaccaaggcgtcgcttgagacggattcgttcctctcggccgcgtcattccaagagacgacccgcgtgctcaccgaggcggccatcaagggcaaggtagatcgcctgctcggcctgaaggagaacgtgatcatcggcaagttgatcccggcgggcacgggcatggtgaggtaccgcaacgtggagccggaggtcgtgcgcccgggcgacgcagaggcggctgcgacaggcgaagaggttgccgaaaccgaggctgtgtcgagcgcggagtga

SEQ ID NO: 473 - DNA, 3648 bp, Artificial
  Substituion in SEQ ID NO 461
gtgcacaagttgtttgacctgaacaactttgagttcatgaagattgggctcgcgtcgccggaaaagatccgctcctggtcgcacggcgaggtgaagaagccggagaccatcaactaccgcacgctccgcccggagaaggaggggctgttctgcgagaagatcttcggcccgacgcgggactgggagtgccactgcggcaagtacaagcggatccgctacaagggtgtcgtgtgtgaccgctgcggcgttgaggtcacgcggtccaaggtgcgccgcgagcgcatggggcacatcgagctggcggcgcccgtctcgcacatctggttcttcaagggcatcccgagccgcatggggctcatcctcgacatgtcgccgcgggcgctcgaggaggtcatctacttcgcgtcgtacgtcgtgaccgatcccggcgatacgccgctcgagaaaaagcagctgctctcggagaaggagtaccggtcctaccgcgagaagtacggctacgcgttcaaagcgggcatgggcgccgaggccatccgcacgctcctgcaggagatcgatcttgaccgcgaggttgagatcctgcgcgaggagctgcgcacggcccaagggcagcggcgcaaccgggccatcaagcgcctagaggtcatcgaggcgttccgtcagtccggcaacaagccgagctggatgatcctcgaggcgctgccggtcattccgccggacctgcgtcccatggtgcagctggacggcggccgcttcgccacgtccgacctgaacgatctgtaccgccgcgtcatcaaccgcaacaaccgcctgaagcgactgctcgatctcggcgcgcccgacatcatcgtgcagaacgagaagcggatgttgcaggaggctgtggacgcgctgatcgacaacggccggcgtggacgcccggtcacaggacccggcaatcggccgctcaagagcctgtcgcacatgctgaagggcaagcagggccgcttccgccagaacctgctcgggaagcgcgtcgactactccggccgatccgtcatcgtggtggggcccgagctgcgcatgtaccagtgcggcctgccgaaagagatggcgcttgagttgttcaagccgttcgtcatgaaggaactggtggcgcgcgggctcgcgcacaacatcaagagcgcgaagcgcaaggtcgagcgcgtgtcggatgaagtgtgggacgtcgtcgaggacgtcatcaaacagcaccctgtgctgttgaaccgcgcgccgacgctgcaccgtctgggcattcaggcgttcgagcccgtccttgtcgaagggcgcgccatcaagctgcatcctctcgtctgcacggcgtacaacgcggatttcgacggcgaccagatggccgtgcacgtgccgctttccgccgaggcgcaggcggaggcgcgcctgctgatgcttgccgcgcacaacatcctgaacccgaaggacggcaagccggtcgtgacgccgacgcaggacatggtgctcggatcctactatttgaccatcgagcgcgagggcgcgcccggcgaaggcaaggtctttgcgtccgtgtctgaggtggagtacgcgctccatcagcggctcatcacgctgcagacgcgcatcgcgctgccggccaaggcggtcggcaagacgtcgttcacggagaagcaggcgaatgcgctcctgatcacgacgccgggcaagctcatcttcaacagcatcttcccgtccgacttcccgtatctgaactctgcggcgaagtccaacctgctcggcggtccgccggacgacacgttcatcttcgagaagggcgtggacatccgcgaggcgattctcaagcgcccgatcccgaaggcggtcatcaagaaggatctgggcaacattctggccgaatgcttccgccgctatggcacgacgatgacggccgagatcctcgacaaggtgaagcggctcgggttccactattcgacgctcgccggtatcaccatctcgatcagcgacatcgtggtgcccgaagagaagaagcgcatcatcgccgaggcggaggcgaaggaacacaagctgaagcttcaataccggcgcggtctcatcacggaagaggagcagtacgtgaccttcagccagatctggtcggaggccaaggagcagatctcgtccatcctcatggagagcatggaccagttcaatcccatttatatgatggccacttccggtgcgcgcggttcgaactcgcagatcacgcagctcgcgggcatgcgcgggctcatggcgaacccgtcgggcgagatcatccagctggccatcaagtcgaacttccgcgagggcctgtcggtgttggagtacttcatctcgacccacggcgcgcgcaagggcctcgctgacacggcgctgcgcacggcggactcgggttatctcacgcgccgcctcgtcgacgtggcgcaggacacgattgtgcgtgagcacgactgcggcaccgacaagggcctgcgggtcatggagatccgcgatggcagcgaggtcatcgaagacttgcgcgatcgcctcgaaggtcgtgtcgcgttccaggatgtgtatcacccggagacgggcgagaagatcgtcggcaagaacgagatgatcgacgaggaagccgcggacaagattgtcgcggcgggcatcaaagaggttaccatccgctccgtcctgacctgtcgcacgcgtcacggggtgtgccagctctgctacggccgcaacttggcgacgggcgatatggtcgaggtgggcgaggcggtcggcatcatcgccgcgcagtccatcggcgagccgggtacgcagctcaccatgcgcacgttccacacgggcggcgtggcgggtgacgacatcacccagggtctgccgcgcgtgcaggaactctttgaggcgcgcaacccgaaaggtcaggccgtgatcgcggagttcgacggcgtcatcaccgacatccgcgagggcaaggacaagcgcgaaatcgagctcacgggcgagagcgagacgaagacgtatcagatcccgtacgggtcgcggattcgggtgagcgtgggccagcagttggaggccggcgaggagctcacggagggctcggtcgatccgaaggagatgctgcgcgtcaagggcctgcagggcgtgcaaaactacctgctgcgcgaggtgcagcgcgtttaccgcctgcagggcgtggacatcaacgacaagcacatcgaggtcatgatccggcagatgttgcgcaaagttcgcatcctcgacgctggagacacggatctcctgccggggacgtacgtggatctcttcgagtacgaagccgccaaccgggaggcacttctctcgggcaaggagcctgcggtggcgcgcccggcgctgcttgggatcaccaaggcgtcgcttgagacggattcgttcctctcggccgcgtcattccaagagacgacccgcgtgctcaccgaggcggccatcaagggcaaggtagatcgcctgctcggcctgaaggagaacgtgatcatcggcaagttgatcccggcgggcacgggcatggtgaggtaccgcaacgtggagccggaggtcgtgcgcccgggcgaagcagaggcggctgcgacaggcgaagaggttgccgaaaccgaggctgtgtcgagcgcggagtga

SEQ ID NO: 474 - DNA, 3648 bp, Artificial
  Substituion in SEQ ID NO 461
gtgcacaagttgtttgacctgaacaactttgagttcatgaagattgggctcgcgtcgccggaaaagatccgctcctggtcgcacggcgaggtgaagaagccggagaccatcaactaccgcacgctccgcccggagaaggaggggctgttctgcgagaagatcttcggcccgacgcgggactgggagtgccactgcggcaagtacaagcggatccgctacaagggtgtcgtgtgtgaccgctgcggcgttgaggtcacgcggtccaaggtgcgccgcgagcgcatggggcacatcgagctggcggcgcccgtctcgcacatctggttcttcaagggcatcccgagccgcatggggctcatcctcgacatgtcgccgcgggcgctcgaggaggtcatctacttcgcgtcgtacgtcgtgaccgatcccggcgatacgccgctcgagaaaaagcagctgctctcggagaaggagtaccggtcctaccgcgagaagtacggctacgcgttcaaagcgggcatgggcgccgaggccatccgcacgctcctgcaggagatcgatcttgaccgcgaggttgagatcctgcgcgaggagctgcgcacggcccaagggcagcggcgcaaccgggccatcaagcgcctagaggtcatcgaggcgttccgtcagtccggcaacaagccgagctggatgatcctcgaggcgctgccggtcattccgccggacctgcgtcccatggtgcagctggacggcggccgcttcgccacgtccgacctgaacgatctgtaccgccgcgtcatcaaccgcaacaaccgcctgaagcgactgctcgatctcggcgcgcccgacatcatcgtgcagaacgagaagcggatgttgcaggaggctgtggacgcgctgatcgacaacggccggcgtggacgcccggtcacaggacccggcaatcggccgctcaagagcctgtcgcacatgctgaagggcaagcagggccgcttccgccagaacctgctcgggaagcgcgtcgactactccggccgatccgtcatcgtggtggggcccgagctgcgcatgtaccagtgcggcctgccgaaagagatggcgcttgagttgttcaagccgttcgtcatgaaggaactggtggcgcgcgggctcgcgcacaacatcaagagcgcgaagcgcaaggtcgagcgcgtgtcggatgaagtgtgggacgtcgtcgaggacgtcatcaaacagcaccctgtgctgttgaaccgcgcgccgacgctgcaccgtctgggcattcaggcgttcgagcccgtccttgtcgaagggcgcgccatcaagctgcatcctctcgtctgcacggcgtacaacgcggatttcgacggcgaccagatggccgtgcacgtgccgctttccgccgaggcgcaggcggaggcgcgcctgctgatgcttgccgcgcacaacatcctgaacccgaaggacggcaagccggtcgtgacgccgacgcaggacatggtgctcggatcctactatttgaccatcgagcgcgagggcgcgcccggcgaaggcaaggtctttgcgtccgtgtctgaggtggagtacgcgctccatcagcggctcatcacgctgcagacgcgcatcgcgctgccggccaaggcggtcggcaagacgtcgttcacggagaagcaggcgaatgcgctcctgatcacgacgccgggcaagctcatcttcaacagcatcttcccgtccgacttcccgtatctgaactctgcggcgaagtccaacctgctcggcggtccgccggacgacacgttcatcttcgagaagggcgtggacatccgcgaggcgattctcaagcgcccgatcccgaaggcggtcatcaagaaggatctgggcaacattctggccgaatgcttccgccgctatggcacgacgatgacggccgagatcctcgacaaggtgaagcggctcgggttccactattcgacgctcgccggtatcaccatctcgatcagcgacatcgtggtgcccgaagagaagaagcgcatcatcgccgaggcggaggcgaaggaacacaagctgaagcttcaataccggcgcggtctcatcacggaagaggagcagtacgtgaccttcagccagatctggtcggaggccaaggagcagatctcgtccatcctcatggagagcatggaccagttcaatcccatttatatgatggccacttccggtgcgcgcggttcgaactcgcagatcacgcagctcgcgggcatgcgcgggctcatggcgaacccgtcgggcgagatcatccagctggccatcaagtcgaacttccgcgagggcctgtcggtgttggagtacttcatctcgacccacggcgcgcgcaagggcctcgctgacacggcgctgcgcacggcggactcgggttatctcacgcgccgcctcgtcgacgtggcgcaggacacgattgtgcgtgagcacgactgcggcaccgacaagggcctgcgggtcatggagatccgcgatggcagcgaggtcatcgaagacttgcgcgatcgcctcgaaggtcgtgtcgcgttccaggatgtgtatcacccggagacgggcgagaagatcgtcggcaagaacgagatgatcgacgaggaagccgcggacaagattgtcgcggcgggcatcaaagaggttaccatccgctccgtcctgacctgtcgcacgcgtcacggggtgtgccagctctgctacggccgcaacttggcgacgggcgatatggtcgaggtgggcgaggcggtcggcatcatcgccgcgcagtccatcggcgagccgggtacgcagctcaccatgcgcacgttccacacgggcggcgtggcgggtgacgacatcacccagggtctgccgcgcgtgcaggaactctttgaggcgcgcaacccgaaaggtcaggccgtgatcgcggagttcgacggcgtcatcaccgacatccgcgagggcaaggacaagcgcgaaatcgagctcacgggcgagagcgagacgaagacgtatcagatcccgtacgggtcgcggattcgggtgagcgtgggccagcagttggaggccggcgaggagctcacggagggctcggtcgatccgaaggagatgctgcgcgtcaagggcctgcagggcgtgcaaaactacctgctgcgcgaggtgcagcgcgtttaccgcctgcagggcgtggacatcaacgacaagcacatcgaggtcatgatccggcagatgttgcgcaaaattcgcatcctcgacgctggagacacggatctcctgccggggacgtacgtggatctcttcgagtacgaagccgccaaccgggaggcacttctctcgggcaaggagcctgcggtggcgcgcccggcgctgcttgggatcaccaaggcgtcgcttgagacggattcgttcctctcggccgcgtcattccaagagacgacccgcgtgctcaccgaggcggccatcaagggcaaggtagatcgcctgctcggcctgaaggagaacgtgatcatcggcaagttgatcccggcgggcacgggcatggtgaggtaccgcaacgtggagccggaggtcgtgcgcccgggcgacgcagaggcggctgcgacaggcgaagaggttgccgaaaccgaggctgtgtcgagcgcggagtga

SEQ ID NO: 475 - DNA, 3648 bp, Artificial
  Substituion in SEQ ID NO 461
gtgcacaagttgtttgacctgaacaactttgagttcatgaagattgggctcgcgtcgccggaaaagatccgctcctggtcgcacggcgaggtgaagaagccggagaccatcaactaccgcacgctccgcccggagaaggaggggctgttctgcgagaagatcttcggcccgacgcgggactgggagtgccactgcggcaagtacaagcggatccgctacaagggtgtcgtgtgtgaccgctgcggcgttgaggtcacgcggtccaaggtgcgccgcgagcgcatggggcacatcgagctggcggcgcccgtctcgcacatctggttcttcaagggcatcccgagccgcatggggctcatcctcgacatgtcgccgcgggcgctcgaggaggtcatctacttcgcgtcgtacgtcgtgaccgatcccggcgatacgccgctcgagaaaaagcagctgctctcggagaaggagtaccggtcctaccgcgagaagtacggctacgcgttcaaagcgggcatgggcgccgaggccatccgcacgctcctgcaggagatcgatcttgaccgcgaggttgagatcctgcgcgaggagctgcgcacggcccaagggcagcggcgcaaccgggccatcaagcgcctagaggtcatcgaggcgttccgtcagtccggcaacaagccgagctggatgatcctcgaggcgctgccggtcattccgccggacctgcgtcccatggtgcagctggacggcggccgcttcgccacgtccgacctgaacgatctgtaccgccgcgtcatcaaccgcaacaaccgcctgaagcgactgctcgatctcggcgcgcccgacatcatcgtgcagaacgagaagcggatgttgcaggaggctgtggacgcgctgatcgacaacggccggcgtggacgcccggtcacaggacccggcaatcggccgctcaagagcctgtcgcacatgctgaagggcaagcagggccgcttccgccagaacctgctcgggaagcgcgtcgactactccggccgatccgtcatcgtggtggggcccgagctgcgcatgtaccagtgcggcctgccgaaagagatggcgcttgagttgttcaagccgttcgtcatgaaggaactggtggcgcgcgggctcgcgcacaacatcaagagcgcgaagcgcaaggtcgagcgcgtgtcggatgaagtgtgggacgtcgtcgaggacgtcatcaaacagcaccctgtgctgttgaaccgcgcgccgacgctgcaccgtctgggcattcaggcgttcgagcccgtccttgtcgaagggcgcgccatcaagctgcatcctctcgtctgcacggcgtacaacgcggatttcgacggcgaccagatggccgtgcacgtgccgctttccgccgaggcgcaggcggaggcgcgcctgctgatgcttgccgcgcacaacatcctgaacccgaaggacggcaagccggtcgtgacgccgacgcaggacatggtgctcggatcctactatttgaccatcgagcgcgagggcgcgcccggcgaaggcaaggtctttgcgtccgtgtctgaggtggagtacgcgctccatcagcggctcatcacgctgcagacgcgcatcgcgctgccggccaaggcggtcggcaagacgtcgttcacggagaagcaggcgaatgcgctcctgatcacgacgccgggcaagctcatcttcaacagcatcttcccgtccgacttcccgtatctgaactctgcggcgaagtccaacctgctcggcggtccgccggacgacacgttcatcttcgagaagggcgtggacatccgcgaggcgattctcaagcgcccgatcccgaaggcggtcatcaagaaggatctgggcaacattctggccgaatgcttccgccgctatggcacgacgatgacggccgagatcctcgacaaggtgaagcggctcgggttccactattcgacgctcgccggtatcaccatctcgatcagcgacatcgtggtgcccgaagagaagaagcgcatcatcgccgaggcggaggcgaaggaacacaagctgaagcttcaataccggcgcggtctcatcacggaagaggagcagtacgtgaccttcagccagatctggtcggaggccaaggagcagatctcgtccatcctcatggagagcatggaccagttcaatcccatttatatgatggccacttccggtgcgcgcggttcgaactcgcagatcacgcagctcgcgggcatgcgcgggctcatggcgaacccgtcgggcgagatcatccagctggccatcaagtcgaacttccgcgagggcctgtcggtgttggagtacttcatctcgacccacggcgcgcgcaagggcctcgctgacacggcgctgcgcacggcggactcgggttatctcacgcgccgcctcgtcgacgtggcgcaggacacgattgtgcgtgagcacgactgcggcaccgacaagggcctgcgggtcatggagatccgcgatggcagcgaggtcatcgaagacttgcgcgatcgcctcgaaggtcgtgtcgcgttccaggatgtgtatcacccggagacgggcgagaagttagtcggcaagaacgagatgatcgacgaggaagccgcggacaagattgtcgcggcgggcatcaaagaggttaccatccgctccgtcctgacctgtcgcacgcgtcacggggtgtgccagctctgctacggccgcaacttggcgacgggcgatatggtcgaggtgggcgaggcggtcggcatcatcgccgcgcagtccatcggcgagccgggtacgcagctcaccatgcgcacgttccacacgggcggcgtggcgggtgacgacatcacccagggtctgccgcgcgtgcaggaactctttgaggcgcgcaacccgaaaggtcaggccgtgatcgcggagttcgacggcgtcatcaccgacatccgcgagggcaaggacaagcgcgaaatcgagctcacgggcgagagcgagacgaagacgtatcagatcccgtacgggtcgcggattcgggtgagcgtgggccagcagttggaggccggcgaggagctcacggagggctcggtcgatccgaaggagatgctgcgcgtcaagggcctgcagggcgtgcaaaactacctgctgcgcgaggtgcagcgcgtttaccgcctgcagggcgtggacatcaacgacaagcacatcgaggtcatgatccggcagatgttgcgcaaagttcgcatcctcgacgctggagacacggatctcctgccggggacgtacgtggatctcttcgagtacgaagccgccaaccgggaggcacttctctcgggcaaggagcctgcggtggcgcgcccggcgctgcttgggatcaccaaggcgtcgcttgagacggattcgttcctctcggccgcgtcattccaagagacgacccgcgtgctcaccgaggcggccatcaagggcaaggtagatcgcctgctcggcctgaaggagaacgtgatcatcggcaagttgatcccggcgggcacgggcatggtgaggtaccgcaacgtggagccggaggtcgtgcgcccgggcgacgcagaggcggctgcgacaggcgaagaggttgccgaaaccgaggctgtgtcgagcgcggagtga

SEQ ID NO: 476 - DNA, 3648 bp, Artificial
  Substituion in SEQ ID NO 461
gtgcacaagttgtttgacctgaacaactttgagttcatgaagattgggctcgcgtcgccggaaaagatccgctcctggtcgcacggcgaggtgaagaagccggagaccatcaactaccgcacgctccgcccggagaaggaggggctgttctgcgagaagatcttcggcccgacgcgggactgggagtgccactgcggcaagtacaagcggatccgctacaagggtgtcgtgtgtgaccgctgcggcgttgaggtcacgcggtccaaggtgcgccgcgagcgcatggggcacatcgagctggcggcgcccgtctcgcacatctggttcttcaagggcatcccgagccgcatggggctcatcctcgacatgtcgccgcgggcgctcgaggaggtcatctacttcgcgtcgtacgtcgtgaccgatcccggcgatacgccgctcgagaaaaagcagctgctctcggagaaggagtaccggtcctaccgcgagaagtacggctacgcgttcaaagcgggcatgggcgccgaggccatccgcacgctcctgcaggagatcgatcttgaccgcgaggttgagatcctgcgcgaggagctgcgcacggcccaagggcagcggcgcaaccgggccatcaagcgcctagaggtcatcgaggcgttccgtcagtccggcaacaagccgagctggatgatcctcgaggcgctgccggtcattccgccggacctgcgtcccatggtgcagctggacggcggccgcttcgccacgtccgacctgaacgatctgtaccgccgcgtcatcaaccgcaacaaccgcctgaagcgactgctcgatctcggcgcgcccgacatcatcgtgcagaacgagaagcggatgttgcaggaggctgtggacgcgctgatcgacaacggccggcgtggacgcccggtcacaggacccggcaatcggccgctcaagagcctgtcgcacatgctgaagggcaagcagggccgcttccgccagaacctgctcgggaagcgcgtcgactactccggccgatccgtcatcgtggtggggcccgagctgcgcatgtaccagtgcggcctgccgaaagagatggcgcttgagttgttcaagccgttcgtcatgaaggaactggtggcgcgcgggctcgcgcacaacatcaagagcgcgaagcgcaaggtcgagcgcgtgtcggatgaagtgtgggacgtcgtcgaggacgtcatcaaacagcaccctgtgctgttgaaccgcgcgccgacgctgcaccgtctgggcattcaggcgttcgagcccgtccttgtcgaagggcgcgccatcaagctgcatcctctcgtctgcacggcgtacaacgcggatttcgacggcgaccagatggccgtgcacgtgccgctttccgccgaggcgcaggcggaggcgcgcctgctgatgcttgccgcgcacaacatcctgaacccgaaggacggcaagccggtcgtgacgccgacgcaggacatggtgctcggatcctactatttgaccatcgagcgcgagggcgcgcccggcgaaggcaaggtctttgcgtccgtgtctgaggtggagtacgcgctccatcagcggctcatcacgctgcagacgcgcatcgcgctgccggccaaggcggtcggcaagacgtcgttcacggagaagcaggcgaatgcgctcctgatcacgacgccgggcaagctcatcttcaacagcatcttcccgtccgacttcccgtatctgaactctgcggcgaagtccaacctgctcggcggtccgccggacgacacgttcatcttcgagaagggcgtggacatccgcgaggcgattctcaagcgcccgatcccgaaggcggtcatcaagaaggatctgggcaacattctggccgaatgcttccgccgctatggcacgacgatgacggccgagatcctcgacaaggtgaagcggctcgggttccactattcgacgctcgccggtatcaccatctcgatcagcgacatcgtggtgcccgaagagaagaagcgcatcatcgccgaggcggaggcgaaggaacacaagctgaagcttcaataccggcgcggtctcatcacggaagaggagcagtacgtgaccttcagccagatctggtcggaggccaaggagcagatctcgtccatcctcatggagagcatggaccagttcaatcccatttatatgatggccacttccggtgcgcgcggttcgaactcgcagatcacgcagctcgcgggcatgcgcgggctcatggcgaacccgtcgggcgagatcatccagctggccatcaagtcgaacttccgcgagggcctgtcggtgttggagtacttcatctcgacccacggcgcgcgcaagggcctcgctgacacggcgctgcgcacggcggactcgggttatctcacgcgccgcctcgtcgacgtggcgcaggacacgattgtgcgtgagcacgactgcggcaccgacaagggcctgcgggtcatggagatccgcgatggcagcgaggtcatcgaagacttgcgcgatcgcctcgaaggtcgtgtcgcgttccaggatgtgtatcacccggagacgggcgagaagatcgtcggcaagaacgagatgatcgacgaggaagccgcggacaagattgtcgcggcgggcatcaaagaggttaccatccgctccgtcctgacctgtcgcacgcgtcacggggtgtgcaatctctgctacggccgcaacttggcgacgggcgatatggtcgaggtgggcgaggcggtcggcatcatcgccgcgcagtccatcggcgagccgggtacgcagctcaccatgcgcacgttccacacgggcggcgtggcgggtgacgacatcacccagggtctgccgcgcgtgcaggaactctttgaggcgcgcaacccgaaaggtcaggccgtgatcgcggagttcgacggcgtcatcaccgacatccgcgagggcaaggacaagcgcgaaatcgagctcacgggcgagagcgagacgaagacgtatcagatcccgtacgggtcgcggattcgggtgagcgtgggccagcagttggaggccggcgaggagctcacggagggctcggtcgatccgaaggagatgctgcgcgtcaagggcctgcagggcgtgcaaaactacctgctgcgcgaggtgcagcgcgtttaccgcctgcagggcgtggacatcaacgacaagcacatcgaggtcatgatccggcagatgttgcgcaaagttcgcatcctcgacgctggagacacggatctcctgccggggacgtacgtggatctcttcgagtacgaagccgccaaccgggaggcacttctctcgggcaaggagcctgcggtggcgcgcccggcgctgcttgggatcaccaaggcgtcgcttgagacggattcgttcctctcggccgcgtcattccaagagacgacccgcgtgctcaccgaggcggccatcaagggcaaggtagatcgcctgctcggcctgaaggagaacgtgatcatcggcaagttgatcccggcgggcacgggcatggtgaggtaccgcaacgtggagccggaggtcgtgcgcccgggcgacgcagaggcggctgcgacaggcgaagaggttgccgaaaccgaggctgtgtcgagcgcggagtga

SEQ ID NO: 477 - protein, 1179 aa, Alicyclobacillus acidocaldarius
MTVLQGHMVKYGWAERRSYARIREVLDLPNLIEIQQKSYEWFLREGLRETFADISPITDFTGNLVLEFVDYSLGEPKYDVEESKERDVTYAAPLRVKVRLLNKETGEVKEQEVFLGDFPLMTETGTFIINGAERVIVSQLVRSPSVYYSSKIDKNGKRTFAATVIPNRGAWLEFETDAKDVVYVRIDRTRKLPITVLLRALGLSSDAEIIELLGEDEYLQNTLDKDTTDSTERALIEIYERLRPGEPPTVENARALLASRFFDPKRYDLAAVGRYKINKKLHLKNRLLNQRLAETLVDEETGEIIAEAGTVLDRRTLDRIIPRLSGKVGRFTIRGTRDLFEQDEIPLQMVKIFSPAEDGKVLHVISNGELPADVKYITPSDIIAAVSYFFNLLRGVGTTDDIDHLGNRRLRSVGELLQNQFRIGLSRMERVVRERMSIQDASAITPQALINIRPVIAAIKEFFGSSQLSQFMDQTNPLAELTHKRRLSALGPGGLTRERAGFEVRDVHYSHYGRMCPIETPEGPNIGLINSLSTYACVNEYGFIETPYRRVDPETGVVTDQIDYLTADEEENYLIAQANEPLTEDGHFVAEEITVRSREDVITVSRDRIDYMDVSPKQVVSVATALIPFLENDDANRALMGSNMQRQAVPLLVTDSPLVGTGMEYQAAKDSGVCVVSKHNGVVERVTAREIWVREEAVVDGQVVKGNVHKYKLIKFARSNQNTCLNQRPIVREGDRVKVGDILADGPATQNGELALGRNVLVAFMTWEGYNYEDAILISEKMVKEDVYTSIHIEEYEIEARDTKLGPEEITRDIPNVGEDALKNLDERGIIRIGAEITTNDILVGKVTPKGVTELTAEERLLHAIFGEKAREVRDTSLRVPHGGAGIVVDVKVFTRENGDELPAGVNQLVRVYVAQKRKISEGDKMAGRHGNKGVVARILPEEDMPFLEDGTPVEIVLNPLGVPSRMNIGQVLETHLGMAAKVLGLKMATPVFDGAKPEDVFETLREAGLPEDGKQVLYDGRTGEPFENRVTVGYVYMMKLHHLVDDKIHARSTGPYSLVTQQPLGGKAQFGGQRFGEMEVWALEAYGAAYTLQELLTVKSDDVVGRVKTYEAIVKGENVPEPGVPESFKVLIKELQSLGMDVKILSGDEREIEMKEMDDDEDSPDKLNLNLEYNEVGD

SEQ ID NO: 478 - DNA, 3540 bp, Alicyclobacillus acidocaldarius
gtgacggttttgcagggacacatggtcaagtacggatgggcggagcgccgcagctacgcgcgcattcgcgaggtcctcgatctcccaaacctcatcgagatccaacagaaatcgtacgagtggttcctgcgggagggcctgcgcgagacgttcgcggacatctctcccatcacggacttcaccgggaaccttgtgcttgagttcgtggactacagcctcggcgagcccaagtacgacgtggaagaatccaaggagcgcgatgtgacgtatgcggcgccgcttcgcgtgaaggttcgcctgctcaacaaggagacgggcgaggtcaaagagcaagaggtgtttctcggcgacttcccgctcatgaccgagacgggcaccttcatcatcaacggcgcggagcgcgtcatcgtgagccagctcgtccgctcccccagcgtctattatagcagcaagatcgacaagaatggcaaacgcacgttcgccgcgacggtcattccgaaccgcggcgcttggctcgagtttgagacggacgcgaaggacgtcgtgtacgtccggatcgatcgcacgcgcaagctgcctatcacggtcttgctccgggcgctgggattgtcgtccgacgccgagatcatcgaactgttaggcgaggacgagtacctgcagaacacgctcgacaaggataccacggactcgacggagcgggcgctcatcgagatctacgagcggctgcgcccgggcgaaccgcccacggtggagaacgcgcgggcgttgcttgcgtctcggttcttcgaccccaagcggtacgatctcgccgcggtcggccggtataagatcaacaaaaagctccatctcaagaaccgcctgctgaaccagcggctggcggagacgctcgtcgacgaggagacgggcgagatcatcgccgaagccgggacggtgctggatcgccgcacgctggatcggatcattccgcgcctgtctggcaaggttgggcgattcaccatccgcggcacgcgggatttgtttgaacaagacgagatcccgctgcagatggtgaagattttcagcccggcggaggacggaaaggtcctgcacgtcatctccaatggcgaactgccggcggacgtcaaatacatcacgccgtccgacatcatcgcggcggtctcgtacttcttcaacctcctgcgcggcgtggggacgacggacgacatcgatcacctgggcaaccggcgcctccgctcggtgggcgagctgttgcaaaaccagttccgcatcgggctctcccgcatggagcgcgtggtgcgcgagcgcatgtccattcaggatgcgagcgcgatcacgcctcaggccctgatcaacattcgcccggtgattgcggccatcaaggagttctttgggtccagccagctttcgcagttcatggatcagacgaatccgctcgctgaactcacgcataagcggcgcctctcggcgctcgggccaggcggtcttacgcgcgagcgggccggcttcgaagtgcgcgacgtgcactactcgcactacggccgcatgtgccccatcgagacgccggaagggccgaacatcggcctcatcaactcgctctcgacctacgcgtgcgtcaacgagtacggcttcatcgagacgccgtaccggcgcgtcgatccagagacgggcgtggtgacggatcagattgactatctaacggcggatgaggaggagaactacctcatcgcgcaggcgaacgagccgctgaccgaggacggccatttcgtggccgaggagatcacggtgcgctcgcgcgaagacgtgatcaccgtgagccgcgatcgcatcgactacatggacgtctcgccgaagcaggtcgtgtcggtcgccacggcgctgatcccgttcctcgagaacgacgacgcgaaccgcgcgctcatgggatcgaacatgcagcgccaggcggtgccgctgctcgtgaccgattcgccgctcgtggggacgggcatggagtaccaggcggcgaaggactccggcgtgtgcgtggtttccaagcacaacggcgtcgtggagcgcgtgacggcccgcgagatctgggtgcgcgaggaagccgtcgtggacgggcaggtcgtgaagggcaacgtccacaagtacaagctcatcaagttcgcgcgctcgaaccagaacacctgcctgaaccagaggcccattgtgcgcgagggcgatcgcgtcaaagtgggggatattctcgcggacgggccggcgacgcaaaacggcgagctggcgctcggccggaacgtgctcgtcgcgttcatgacctgggagggctacaactacgaggacgcgattctcatctcggagaagatggtgaaggaggacgtctacacgtccattcacattgaggaatacgagatcgaggcgcgcgacacgaagctcgggcctgaggagatcacgcgcgacatcccgaacgtgggcgaggatgcgctcaaaaacctcgacgagcgcgggatcatccgcatcggcgcggagatcacgaccaacgacattctcgtcggcaaggtgacgccgaagggcgtgacggagctcaccgcggaagagcggctgttgcacgcgattttcggcgagaaggcccgggaggtgcgcgacacgtcgctgcgcgtgccgcacgggggggccgggatcgtcgtggacgtcaaggtgttcacgcgcgagaacggcgacgagctgcccgctggcgtgaaccagttggtgcgggtgtatgtcgcgcaaaagcgcaagatctcggagggcgacaagatggccgggcgccacgggaacaagggcgtcgtggcgcgcatcctgccggaagaggatatgccgttcctggaggatggaacgccggtcgagatcgtgctgaatccgctcggcgtgccgtcgcgtatgaacatcggtcaggtgctcgagacgcacctgggcatggccgcgaaggtgctggggctgaaaatggccacgccggtgtttgacggcgccaagccggaggacgtgtttgagacgcttcgcgaggcgggcttgccggaggacggcaagcaggtgctgtacgacggccggaccggcgagccgttcgaaaaccgcgtcaccgtgggatacgtgtacatgatgaagctgcaccacctggtggacgacaagatccacgcgcgctccacgggtccgtactcgctcgtcacccagcagccgctcggaggcaaggcccagttcggcggtcagcggtttggcgagatggaggtgtgggcgctggaggcgtacggcgcggcctacacgctgcaggagctcctcacggtcaagtcggacgacgtggtggggcgtgtcaagacgtacgaggccatcgtcaagggcgagaacgtgccggagccgggtgtgccggagtcgttcaaggtgctcatcaaagagctccagagcctggggatggacgtgaagatcttgagcggcgacgagcgcgagatcgagatgaaggagatggacgacgacgaggacagccccgacaagctcaatctgaacctggagtacaacgaggtcggcgattga

SEQ ID NO: 479 - protein, 1176 aa, Paenibacillus larvae subsp. larvae BRL-230010
LAGHLVQYGRRKRRTYARINEVLEIPNLIEIQQKSYQWFLDEGLREMFQDISPIQDFTGNLVLEFIDYSLGEPKYTVDDSKERDVTYAAPLRVKVRLINKETGEVKEQEVFMGDFPIMTETGTFIINGAERVIVSQLVRSPSVYYNTKVDKNGKKAFTATVIPNRGAWLELETDAKDIIYVRIDRTRKIPVTVLLRALGFGTDAEILDLLGDDEYIRNTLDKDNTDSTDKALIEIYERLRPGEPPTLDNARSLLYARFFDPKRYDLANVGRYKINKKLHIKNRLFNQRLAETLVHPETGEIIAEAGQLVDRRLLDEILPCLEEGVGFKEYSVPNGVLESDHIPMQTIDVFSPIEDGKVVKVISNGVIDKNVKNITPADIISSINYFINLLHGIGNTDDIDHLGNRRLRSVGELLQNQFRIGLSRMERVVRERMSIQDANVITPQALINIRPVIASIKEFFGSSQLSQFMDQTNPLAELTHKRRLSALGPGGLTRERAGFEVRDVHHSHYGRMCPIETPEGPNIGLINSLSTFARINEYGFIEAPYRRVDPKTGVVTDEIVYMTADEEDNYVVAQANAELNEDGTFAADNVYVRYKDEILTLPKERVDYMDVSPKQVVSVATALIPFLENDDSNRALMGSNMQRQAVPLLMPKAPLVGTGMEYKAAKDSGVCVVAKHDGIIEKVSGNEIWLRRQEEVDGRLVSGNITKFKLHKFMRSNQGTCINQRPLVLEGQRVKAGDILADGPSTEQGELALGRNVVVAFMTWEGYNYEDAILLSEKLVKEDVYTSIHIEEYESEARDTKLGPEEITRDIPNVGEDALKNLDERGIIRVGAEIGAGDILVGKVTPKGVTELTAEERLLHAIFGEKAREVRDTSLRVPHGTDGIVVDVKVFTHENGDELPPGVNQLVRVYIAQKRKISQGDKMAGRHGNKGVIARILPEEDMPFLPDGTPVEVVLNPLGVPSRMNIGQVLEVHLGMAAKQLGIHVATPVFDGAHEYDVFDTMEEAGMQRNGKTKLYDGRTGEEFEREVTVGVMYMIKLAHMVDDKIHARSTGPYSLVTQQPLGGKAQFGGQRFGEMEVWALEAYGAAYTLQEILTVKSDDVVGRVKTYESIVKGENVPEPGVPESFKVLIKELQSLGMDVKILSGDEEEIEMKELDDEDDAGSDKLNLNLEGAEMG

SEQ ID NO: 480 - protein, 1177 aa, Bacillus halodurans C-125
MTGQLIQYGRHRQRRSYARINEVLELPNLIEIQTASYQWFLDEGLREMFQDISPIQDFTGNLVLEFIDYSLGEPKYPVDESKERDVTYAAPLRVKVRLINKETGEVKEQEVFMGDFPLMTDTGTFIINGAERVIVSQLVRSPSVYYSEKIDKNGKKGYTATVIPNRGAWLELETDAKDIVYVRIDRTRKIPVTVLLRALGFGSDQEIIDLLGEDEYLRNTLEKDNTDSAEKALLEIYERLRPGEPPTVENAKSLLDSRFFDPKRYDLANVGRYKVNKKLHIKNRLFNQRLAETLIDPETGEVIAEEGSIIDRRTLDRILPYLENNVGFRTVRMSGGVVEEDEVRLQSVKIYAPDDQDGEHVIRVIGNGLVEKEIKHITPADIIASINYFFNLLHSVGGTDDIDHLGNRRLRSVGELLQNQFRIGLSRMERVVRERMSIQDPNSITPQALINIRPVIASIKEFFGSSQLSQFMDQTNPLAELTHKRRLSALGPGGLTRERAGFEVRDVHYSHYGRMCPIETPEGPNIGLINSLSTYAKVNEFGFMETPYRRVDPETGKVTAQIDYLTADEEDNYVVAQANMKLAEDGSFIDENIIARFRGENIVVSRDRVDYMDVSPKQVVSAATSCIPFLENDDSNRALMGANMQRQAVPLLVPEAPIVGTGMEHVSAKDSGAAIVSKHRGIVERVTAKEIWVRRLEEVDGKEIKGDLDKYRLQKFIRSNQGTSYNQRPIVKEGDVVEKREILADGPSMEKGEMALGRNVLVGFMTWEGYNYEDAIILSERLVKDDVYTSIHIEEYESEARDTKLGPEEITRDIPNVGEDALRNLDERGIIRVGAEVKDGDILVGKVTPKGVTELTAEERLLHAIFGEKAREVRDTSLRAPHGGDGIVLDVKIFNREDGDELPPGVNQLVRVYIVQKRKIHEGDKMAGRHGNKGVISRILPEEDMPYLPDGTPIDIMLNPLGVPSRMNIGQVLELHLGMAARRLGLHVASPVFDGASEEDVWATLEEAGMARDGKTILYDGRTGEPFDNRVSVGIMYMIKLAHMVDDKLHARSTGPYSLVTQQPLGGKAQFGGQRFGEMEVWALEAYGAAYTLQEILTVKSDDVVGRVKTYEAIVKGENVPEPGVPESFKVLIKELQSLGMDVKMLSSTEEEIEMKELDDEDEQASDKLNLNIDSTE

SEQ ID NO: 481 - protein, 1146 aa, Geobacillus thermodenitrificans NG80-2
MTGRLVQYGRHRQRRSYARISEVLELPNLIEIQTSSYQWFLDEGLREMFKEISPIEDFSGNLSLEFIDYSLGEPKYSVEEAKERDVTYAAPLRVKVRLINKETGEVKEQDVFMGDFPLMTETGTFIINGAERVIVSQLVRSPSVYYSDKVDKNGKRGYSATVIPNRGAWLEYETDAKDVVYVRIDRTRKLPVTVLLRALGFSSDQEIIDLLGDNEYLRNTLEKDNTDSTEKALIEIYERLRPGEPPTLENAKSLLASRFFDPKRYDLASVGRYKINKKLHIKNRLFNQRLAETIADPETGEIIAEAGTMIDRRTLNRLLPYLEKGAGLQTYRPTEGVADGQISVQTVKIYAPNDPDNEKVINIIGNGFIAEDVKHITPADIIASISYFFNLLHGVGDTDDIDHLGNRRLRSVGELLQNQFRIGLSRMERVVRERMSIQDANTITPQQLINIRPVIAAIKEFFGSSQLSQFMDQTNPLAELTHKRRLSALGPGGLTRERAGFEVRDVHYSHYGRMCPIETPEGPNIGLINSLSTYAKVNKFGFIETPYRRVDPETGKVTDQIDYLTADEEDNYVVAQANVPLAEDGTFLEENVIARFRGENIVVKRDRVDYMDVSPKQVVSAATACIPFLENDDSNRALMGANMQRQAVPLLQPEAPIVGTGMEYVSAKDSGAAIICKHRGIVERVEAKEIWVRRLIEVDGKEVKGDLDKYRLLKFVRSNQGTCYNQRPIVKKGDIVEKGEILADGPSMDKGELALGRNVLVAFMTWDGYNYEDAIIMSERLVKEDVYTSIHIEEYEAESRDTKLGPEEITRDIPNVGEDALKNLDERGIVRIGAEVKDGDLLVGKVTPKGMTELTAEERLLHAIFGEKAREVRDTSLRVPHGGGGIVLDVKVFNREDGDELPPGVNQLVRVYIVQKRKISEGDKMAGRHGNKGVISRILPEEDMPFLPDGTPIDIMLNPLGVPSRMNIGQVFELHLGMAAKKLGLHIASPVFDGATEEDVWNILEEAGMARDAKTVLYDGRTGEPFDNRVSVGIMYMIKLAHMVDDKLHARSTGPYSLVTQQPLGGKAQFGGQRFGEMEVWALEAYGAAYTLQEILTVKSDDVVGRVKTYEAIVKGENIPEPGVPESFKVLIKELQSLGMDVTILT

SEQ ID NO: 482 - protein, 1146 aa, Geobacillus kaustophilus HTA426
MTGRLVQYGRHRQRRSYARISEVLELPNLIEIQTSSYQWFLDEGLREMFREISPIEDFSGNLSLEFIDYSLGEPKYTVEEAKERDVTYAAPLRVKVRLINKETGEVKEQDVFMGDFPLMTETGTFIINGAERVIVSQLVRSPSVYYSDKVDKNGKRGYSATVIPNRGAWLEYETDAKDVVYVRIDRTRKLPVTVLLRALGFSSDQEIIDLLGDNEYLRNTLEKDNTDSTEKALIEIYERLRPGEPPTLENAKNLLASRFFDPKRYDLASVGRYKINKKLHIKNRLFNQRLAETIIDPETKEVIAEAGAMIDRRTLNRLLPYLEKGVGLQTYRPAEGVVDGDISVQTIKIYAPNDPDGEKVINVIGNGFIAEDVKHITPADIIASISYFFNLLHGVGDTDDIDHLGNRRLRSVGELLQNQFRIGLSRMERVVRERMSIQDTNTITPQQLINIRPVIAAIKEFFGSSQLSQFMDQTNPLAELTHKRRLSALGPGGLTRERAGFEVRDVHYSHYGRMCPIETPEGPNIGLINSLSTYAKVNKFGFIETPYRRVDPETGRVTDQIDYLTADEEDNYVVAQANVPLAEDGTFLEENVVARFRGENIVVKRDRVDYMDVSPKQVVSAATACIPFLENDDSNRALMGANMQRQAVPLLEPEAPIVGTGMEYVSAKDSGAAVICKHRGIVERVEAKEIWVRRLIEVDGKEVKGDLDKYRLLKFVRSNQGTCYNQRPIVKKGDIVEKGEILADGPSMDKGELALGRNVLVAFMTWDGYNYEDAIIMSERLVKEDVYTSIHIEEYEAESRDTKLGPEEITRDIPNVGEDALKNLDERGIVRIGAEVKDGDLLVGKVTPKGMTELTAEERLLHAIFGEKAREVRDTSLRVPHGGGGIVLDVKVFNREDGDELPPGVNQLVRVYIVQKRKISEGDKMAGRHGNKGVISRILPEEDMPFLPDGTPIDIMLNPLGVPSRMNIGQVFELHLGMAAKKLGLHIASPVFDGATEEDVWNILEEAGLARDAKTVLYDGRTGEPFDNRVSVGIMYMIKLAHMVDDKLHARSTGPYSLVTQQPLGGKAQFGGQRFGEMEVWALEAYGAAYTLQEILTVKSDDVVGRVKTYEAIVKGENIPEPGVPESFKVLIKELQSLGMDVTILT

SEQ ID NO: 483 - protein, 1177 aa, Bacillus clausii KSM-K16
MTGQLIQYGRHRQRRSYARINEVLELPNLIEIQTASYQWFLDEGLREMFQDISPIQDFTGNLVLEFIDYSLGEPKYPVDESKERDVTFAAPLRVKVRLINKETGEVKEQEVFMGDFPLMTETGTFIINGAERVIVSQLVRSPSVYYSQKLDKNGKKGFTATVIPNRGAWLELETDAKDIVYVRIDRTRKIPVTVLLRALGFGSDQEIVDLLGENEYLRNTLEKDNTDSTDKALLEIYERLRPGEPPTVENAKSLLESRFFDPKRYDLANVGRYKINKKLHIKNRLFNQRLAEKLVDPETGEVLAEEGTLLDRRTLDKLIPHLEKNVGFRTARTSGGVLEESDVEIQSVKIYVADDYEGERVISVISNGMVERDVKHIAPADIIASISYFFNLLHGVGDTDDIDHLGNRRLRSVGELLQNQFRIGLSRMERVVRERMSIQDPNVITPQALINIRPVIASIKEFFGSSQLSQFMDQTNPLAELTHKRRLSALGPGGLTRERAGMEVRDVHYSHYGRMCPIETPEGPNIGLINTLSSYAKVNEFGFMETPYRRVDPETGKVTSRIDYLTADEEDNYVVAQANAKLNDDGSFVDDNIIARFRGENTVVPCDRVDYMDVSPKQVVSAATSCIPFLENDDSNRALMGANMQRQAVPLLVPEAPLVGTGMEHVSAKDSGAAVVSKYAGIVERVTAKEIWVRRIEEVDGKETKGDLDKYKLQKFVRSNQGTSYNQRPIVREGDRIEKREILADGPSMEMGEMALGRNVLVAFMTWDGYNYEDAIILSERLVKDDVYTSIHIEEYESDARDTKLGPEEITRDIPNVGEDALRNLDERGIIRIGAEVKDGDILVGKVTPKGVTELTAEERLLHAIFGEKAREVRDTSLRAPHGGDGIVLDVKIFNREDGDELPPGVNQLVRVYIVQKRKINQGDKMAGRHGNKGVISRILPEEDMPFLPDGTPVDIMLNPLGVPSRMNIGQVLELHLGMAARKLGIHVASPVFDGASEEDVWGTLEEAGMARDGKTILYDGRTGEPFDNRVSVGIMYMIKLAHMVDDKLHARSTGPYSLVTQQPLGGKAQFGGQRFGEMEVWALEAYGAAYTLQEILTVKSDDVVGRVKTYEAIVKGENVPEPGVPESFKVLIKELQSLGMDVKMLSSNEEEIEMRELDDEEDQTSEKLNLNLETNE

SEQ ID NO: 484 - protein, 1179 aa, Artificial
  Substituion in SEQ ID NO 477
MTVLQGHMVKYGWAERRSYARIREVLDLPNLIEIQQKSYEWFLREGLRETFADISPITDFTGNLVLEFVDYSLGEPKYDVEESKERDVTYAAPLRVKVRLLNKETGEVKEQEVFLGDFPLMTETGTFIINGAERVIVSQLVRSPSVYYSSKIDKNGKRTFAATVIPNRGAWLEFETDAKDVVYVRIDRTRKLPITVLLRALGLSSDAEIIELLGEDEYLQNTLDKDTTDSTERALIEIYERLRPGEPPTVENARALLASRFFDPKRYDLAAVGRYKINKKLHLKNRLLNQRLAETLVDEETGEIIAEAGTVLDRRTLDRIIPRLSGKVGRFTIRGTRDLFEQDEIPLQMVKIFSPAEDGKVLHVISNGELPADVKYITPSDIIAAVSYFFNLLRGVGTTDDIDHLGNRRLRSVGELLQNQFRIGLSRMERVVRERMSIQDASAITPQALINIRPVIAAIKEFFGSSQLSQFMDQTNPLAELTHKRRLSALGPGGLTRERAGFEVRDVHYSHYGRMCPIETPEGPNIGLINSLSTYACVNEYGFIETPYRRVDPETGVVTDQIDYLTADEEENYLIAQANEPLTEDGHFVAEEITVRSREDVITVSRDRIDYMDVSPKQVVSVATALIPFLENDDANRALMGSNMQRQAVPLLVTDSPLVGTGMEYQAAKDSGVCVVSKHNGVVERVTAREIWVREEAVVDGQVVKGNVHKYKLIKFARSNQNTCLNQRPIVREGDRVKVGDILADGPATQNGELALGRNVLVAFMTWEGYNYEDAILISEKMVKEDVYTSIHIEEYEIEARDTKLGPEEITRDIPNVGEDALKNLDERGIIRIGAEITTNDILVGKVTPKGVTELTAEERLLHAIFGEKAREVRDTSLRVPHGGAGIVVDVKVFTRENGDELPAGVNQLVRVYVAQKRKISEGDKMAGRHGNKGVVARILPEEDMPFLEDGTPVEIVLNPLGVPSRMNIGQVLETHLGMAAKVLGLKMATPVFDGAKPEDVFETLREAGLPEDGKQVLYDGRTGEPFENRVTVGYVYMMKLHHLVDDKIHARSTGPYSLVTQQPLGGKAQFGGQRFGEMEVWALEAYGAAYTLQELLTVKSDDVVGRVKTYEAIVKGENVPEPGVPESFKVLIKELQSLGMDVKILSGDERELEMKEMDDDEDSPDKLNLNLEYNEVGD

SEQ ID NO: 485 - protein, 1179 aa, Artificial
  Substituion in SEQ ID NO 477
MTVLQGHMVKYGWAERRSYARIREVLDLPNLIEIQQKSYEWFLREGLRETFADISPITDFTGNLVLEFVDYSLGEPKYDVEESKERDVTYAAPLRVKVRLLNKETGEVKEQEVFLGDFPLMTETGTFIINGAERVIVSQLVRSPSVYYSSKIDKNGKRTFAATVIPNRGAWLEFETDAKDVVYVRIDRTRKLPITVLLRALGLSSDAEIIELLGEDEYLQNTLDKDTTDSTERALIEIYERLRPGEPPTVENARALLASRFFDPKRYDLAAVGRYKINKKLHLKNRLLNQRLAETLVDEETGEIIAEAGTVLDRRTLDRIIPRLSGKVGRFTIRGTRDLFEQDEIPLQMVKIFSPADDGKVLHVISNGELPADVKYITPSDIIAAVSYFFNLLRGVGTTDDIDHLGNRRLRSVGELLQNQFRIGLSRMERVVRERMSIQDASAITPQALINIRPVIAAIKEFFGSSQLSQFMDQTNPLAELTHKRRLSALGPGGLTRERAGFEVRDVHYSHYGRMCPIETPEGPNIGLINSLSTYACVNEYGFIETPYRRVDPETGVVTDQIDYLTADEEENYLIAQANEPLTEDGHFVAEEITVRSREDVITVSRDRIDYMDVSPKQVVSVATALIPFLENDDANRALMGSNMQRQAVPLLVTDSPLVGTGMEYQAAKDSGVCVVSKHNGVVERVTAREIWVREEAVVDGQVVKGNVHKYKLIKFARSNQNTCLNQRPIVREGDRVKVGDILADGPATQNGELALGRNVLVAFMTWEGYNYEDAILISEKMVKEDVYTSIHIEEYEIEARDTKLGPEEITRDIPNVGEDALKNLDERGIIRIGAEITTNDILVGKVTPKGVTELTAEERLLHAIFGEKAREVRDTSLRVPHGGAGIVVDVKVFTRENGDELPAGVNQLVRVYVAQKRKISEGDKMAGRHGNKGVVARILPEEDMPFLEDGTPVEIVLNPLGVPSRMNIGQVLETHLGMAAKVLGLKMATPVFDGAKPEDVFETLREAGLPEDGKQVLYDGRTGEPFENRVTVGYVYMMKLHHLVDDKIHARSTGPYSLVTQQPLGGKAQFGGQRFGEMEVWALEAYGAAYTLQELLTVKSDDVVGRVKTYEAIVKGENVPEPGVPESFKVLIKELQSLGMDVKILSGDEREIEMKEMDDDEDSPDKLNLNLEYNEVGD

SEQ ID NO: 486 - protein, 1179 aa, Artificial
  Substituion in SEQ ID NO 477
MTVLQGHMVKYGWAERRSYARIREVLDLPNLIEIQQKSYEWFLREGLRETFADISPITDFTGNLVLEFVDYSLGEPKYDVEESKERDVTYAAPLRVKVRLLNKETGEVKEQEVFLGDFPLMTETGTFIINGAERVIVSQLVRSPSVYYSSKIDKNGKRTFAATVIPNRGAWLEFETDAKDVVYVRIDRTRKLPITVLLRALGLSSDAEIIELLGEDEYLQNTLDKDTTDSTERALIEIYERLRPGEPPTVENARALLASRFFDPKRYDLAAVGRYKINKKLHLKNRLLNQRLAETLVDEETGEIIAEAGTVLDRRTLDRIIPRLSGKVGRFTIRGTRDLFEQDEIPLQMVKIFSPAEDGKVLHVISNGELPADVKYITPSDIIAAVSYFFNLLRGVGTTDDIDHLGNRRLRSVGELLQNQFRIGLSRMERVVRERMSIQDASAITPQALINIRPVIAAIKEFFGSSQLSQFMDQTNPLAELTHKRRLSALGPGGLTRERAGFEVRDVHYSHYGRMCPIETPEGPNIGLINSLSTYACVNEYGFIETPYRRVDPETGVVTDQIDYLTADEEENYLIAQANEPLTEDGHFVAEEITVRSREDVITVSRDRIDYMDVSPKQVVSVATALIPFLENDDANRALMGSNMQRQAVPLLVTDSPLVGTGMEYQAAKDSGVCVVSKHNGVVERVTAREIWVREEAVVDGQVVKGNVHKYKLIKFARSNQNTCLNQRPIVREGDRVKVGDILADGPATQNGELALGRNVLVAFMTWEGYNYEDAILISEKMVKEDVYTSIHIEEYEIEARDTKLGPEEITRDIPNVGEDALKNLDERGIIRIGAEITTNDILVGKVTPKGVTELTAEERLLHAIFGEKAREVRDTSLRVPHGGAGIVVDVKVFTRENGDELPAGVNQLVRVYVAQKRKISEGDKMAGRHGNKGVVARILPEEDMPFLEDGTPVEIILNPLGVPSRMNIGQVLETHLGMAAKVLGLKMATPVFDGAKPEDVFETLREAGLPEDGKQVLYDGRTGEPFENRVTVGYVYMMKLHHLVDDKIHARSTGPYSLVTQQPLGGKAQFGGQRFGEMEVWALEAYGAAYTLQELLTVKSDDVVGRVKTYEAIVKGENVPEPGVPESFKVLIKELQSLGMDVKILSGDEREIEMKEMDDDEDSPDKLNLNLEYNEVGD

SEQ ID NO: 487 - protein, 1179 aa, Artificial
  Substituion in SEQ ID NO 477
MTVLQGHMVKYGWAERRSYARIREVLDLPNLIEIQQKSYEWFLREGLRETFADISPITDFTGNLVLEFVDYSLGEPKYDVEESKERDVTYAAPLRVKVRLLNKETGEVKEQEVFLGDFPIMTETGTFIINGAERVIVSQLVRSPSVYYSSKIDKNGKRTFAATVIPNRGAWLEFETDAKDVVYVRIDRTRKLPITVLLRALGLSSDAEIIELLGEDEYLQNTLDKDTTDSTERALIEIYERLRPGEPPTVENARALLASRFFDPKRYDLAAVGRYKINKKLHLKNRLLNQRLAETLVDEETGEIIAEAGTVLDRRTLDRIIPRLSGKVGRFTIRGTRDLFEQDEIPLQMVKIFSPAEDGKVLHVISNGELPADVKYITPSDIIAAVSYFFNLLRGVGTTDDIDHLGNRRLRSVGELLQNQFRIGLSRMERVVRERMSIQDASAITPQALINIRPVIAAIKEFFGSSQLSQFMDQTNPLAELTHKRRLSALGPGGLTRERAGFEVRDVHYSHYGRMCPIETPEGPNIGLINSLSTYACVNEYGFIETPYRRVDPETGVVTDQIDYLTADEEENYLIAQANEPLTEDGHFVAEEITVRSREDVITVSRDRIDYMDVSPKQVVSVATALIPFLENDDANRALMGSNMQRQAVPLLVTDSPLVGTGMEYQAAKDSGVCVVSKHNGVVERVTAREIWVREEAVVDGQVVKGNVHKYKLIKFARSNQNTCLNQRPIVREGDRVKVGDILADGPATQNGELALGRNVLVAFMTWEGYNYEDAILISEKMVKEDVYTSIHIEEYEIEARDTKLGPEEITRDIPNVGEDALKNLDERGIIRIGAEITTNDILVGKVTPKGVTELTAEERLLHAIFGEKAREVRDTSLRVPHGGAGIVVDVKVFTRENGDELPAGVNQLVRVYVAQKRKISEGDKMAGRHGNKGVVARILPEEDMPFLEDGTPVEIVLNPLGVPSRMNIGQVLETHLGMAAKVLGLKMATPVFDGAKPEDVFETLREAGLPEDGKQVLYDGRTGEPFENRVTVGYVYMMKLHHLVDDKIHARSTGPYSLVTQQPLGGKAQFGGQRFGEMEVWALEAYGAAYTLQELLTVKSDDVVGRVKTYEAIVKGENVPEPGVPESFKVLIKELQSLGMDVKILSGDEREIEMKEMDDDEDSPDKLNLNLEYNEVGD

SEQ ID NO: 488 - protein, 1179 aa, Artificial
  Substituion in SEQ ID NO 477
MTVLQGHMVKYGWAERRSYARIREVLDLPNLIEIQQKSYEWFLREGLRETFADISPITDFTGNLVLEFVDYSLGEPKYDVEESKERDVTYAAPLRVKVRLLNKETGEVKEQEVFLGDFPLMTETGTFIINGAERVIVSQLVRSPSVYYSSKIDKNGKRTFAATVIPNRGAWLEFETDAKDVVYVRIDRTRKLPITVLLRALGLSSDAEIIELLGEDEYLQNTLDKDTTDSTERALIEIYERLRPGEPPTVENARALLASRFFDPKRYDLAAVGRYKINKKLHLKNRLLNQRLAETLVDEETGEIIAEAGTVLDRRTLDRIIPRLSGKVGRFTIRGTRDLFEQDEIPLQMVKIFSPAEDGKVLHVISNGELPADVKYITPSDIIAAVSYFFNLLRGVGTTDDIDHLGNRRLRSVGELLQNQFRIGLSRMERVVRERMSIQDASAITPQALINIRPVIAAIKEFFGSSQLSQFMDQTNPLAELTHKRRLSALGPGGLTRERAGFEVRDVHYSHYGRMCPIETPEGPNIGLINSLSTYACVNEYGFIETPYRRVDPETGVVTDQIDYLTADEEENYLIAQANEPLTEDGHFVAEEITVRSREDVITVSRDRIDYMDVSPKQVVSVATALIPFLENDDANRALMGSNMQRQAVPLLVTDSPLVGTGMEYQAAKDSGVCVVSKHNGVVERVTAREIWVREEAVVDGQVIKGNVHKYKLIKFARSNQNTCLNQRPIVREGDRVKVGDILADGPATQNGELALGRNVLVAFMTWEGYNYEDAILISEKMVKEDVYTSIHIEEYEIEARDTKLGPEEITRDIPNVGEDALKNLDERGIIRIGAEITTNDILVGKVTPKGVTELTAEERLLHAIFGEKAREVRDTSLRVPHGGAGIVVDVKVFTRENGDELPAGVNQLVRVYVAQKRKISEGDKMAGRHGNKGVVARILPEEDMPFLEDGTPVEIVLNPLGVPSRMNIGQVLETHLGMAAKVLGLKMATPVFDGAKPEDVFETLREAGLPEDGKQVLYDGRTGEPFENRVTVGYVYMMKLHHLVDDKIHARSTGPYSLVTQQPLGGKAQFGGQRFGEMEVWALEAYGAAYTLQELLTVKSDDVVGRVKTYEAIVKGENVPEPGVPESFKVLIKELQSLGMDVKILSGDEREIEMKEMDDDEDSPDKLNLNLEYNEVGD

SEQ ID NO: 489 - DNA, 3540 bp, Artificial
  Substituion in SEQ ID NO 478
gtgacggttttgcagggacacatggtcaagtacggatgggcggagcgccgcagctacgcgcgcattcgcgaggtcctcgatctcccaaacctcatcgagatccaacagaaatcgtacgagtggttcctgcgggagggcctgcgcgagacgttcgcggacatctctcccatcacggacttcaccgggaaccttgtgcttgagttcgtggactacagcctcggcgagcccaagtacgacgtggaagaatccaaggagcgcgatgtgacgtatgcggcgccgcttcgcgtgaaggttcgcctgctcaacaaggagacgggcgaggtcaaagagcaagaggtgtttctcggcgacttcccgctcatgaccgagacgggcaccttcatcatcaacggcgcggagcgcgtcatcgtgagccagctcgtccgctcccccagcgtctattatagcagcaagatcgacaagaatggcaaacgcacgttcgccgcgacggtcattccgaaccgcggcgcttggctcgagtttgagacggacgcgaaggacgtcgtgtacgtccggatcgatcgcacgcgcaagctgcctatcacggtcttgctccgggcgctgggattgtcgtccgacgccgagatcatcgaactgttaggcgaggacgagtacctgcagaacacgctcgacaaggataccacggactcgacggagcgggcgctcatcgagatctacgagcggctgcgcccgggcgaaccgcccacggtggagaacgcgcgggcgttgcttgcgtctcggttcttcgaccccaagcggtacgatctcgccgcggtcggccggtataagatcaacaaaaagctccatctcaagaaccgcctgctgaaccagcggctggcggagacgctcgtcgacgaggagacgggcgagatcatcgccgaagccgggacggtgctggatcgccgcacgctggatcggatcattccgcgcctgtctggcaaggttgggcgattcaccatccgcggcacgcgggatttgtttgaacaagacgagatcccgctgcagatggtgaagattttcagcccggcggaggacggaaaggtcctgcacgtcatctccaatggcgaactgccggcggacgtcaaatacatcacgccgtccgacatcatcgcggcggtctcgtacttcttcaacctcctgcgcggcgtggggacgacggacgacatcgatcacctgggcaaccggcgcctccgctcggtgggcgagctgttgcaaaaccagttccgcatcgggctctcccgcatggagcgcgtggtgcgcgagcgcatgtccattcaggatgcgagcgcgatcacgcctcaggccctgatcaacattcgcccggtgattgcggccatcaaggagttctttgggtccagccagctttcgcagttcatggatcagacgaatccgctcgctgaactcacgcataagcggcgcctctcggcgctcgggccaggcggtcttacgcgcgagcgggccggcttcgaagtgcgcgacgtgcactactcgcactacggccgcatgtgccccatcgagacgccggaagggccgaacatcggcctcatcaactcgctctcgacctacgcgtgcgtcaacgagtacggcttcatcgagacgccgtaccggcgcgtcgatccagagacgggcgtggtgacggatcagattgactatctaacggcggatgaggaggagaactacctcatcgcgcaggcgaacgagccgctgaccgaggacggccatttcgtggccgaggagatcacggtgcgctcgcgcgaagacgtgatcaccgtgagccgcgatcgcatcgactacatggacgtctcgccgaagcaggtcgtgtcggtcgccacggcgctgatcccgttcctcgagaacgacgacgcgaaccgcgcgctcatgggatcgaacatgcagcgccaggcggtgccgctgctcgtgaccgattcgccgctcgtggggacgggcatggagtaccaggcggcgaaggactccggcgtgtgcgtggtttccaagcacaacggcgtcgtggagcgcgtgacggcccgcgagatctgggtgcgcgaggaagccgtcgtggacgggcaggtcgtgaagggcaacgtccacaagtacaagctcatcaagttcgcgcgctcgaaccagaacacctgcctgaaccagaggcccattgtgcgcgagggcgatcgcgtcaaagtgggggatattctcgcggacgggccggcgacgcaaaacggcgagctggcgctcggccggaacgtgctcgtcgcgttcatgacctgggagggctacaactacgaggacgcgattctcatctcggagaagatggtgaaggaggacgtctacacgtccattcacattgaggaatacgagatcgaggcgcgcgacacgaagctcgggcctgaggagatcacgcgcgacatcccgaacgtgggcgaggatgcgctcaaaaacctcgacgagcgcgggatcatccgcatcggcgcggagatcacgaccaacgacattctcgtcggcaaggtgacgccgaagggcgtgacggagctcaccgcggaagagcggctgttgcacgcgattttcggcgagaaggcccgggaggtgcgcgacacgtcgctgcgcgtgccgcacgggggggccgggatcgtcgtggacgtcaaggtgttcacgcgcgagaacggcgacgagctgcccgctggcgtgaaccagttggtgcgggtgtatgtcgcgcaaaagcgcaagatctcggagggcgacaagatggccgggcgccacgggaacaagggcgtcgtggcgcgcatcctgccggaagaggatatgccgttcctggaggatggaacgccggtcgagatcgtgctgaatccgctcggcgtgccgtcgcgtatgaacatcggtcaggtgctcgagacgcacctgggcatggccgcgaaggtgctggggctgaaaatggccacgccggtgtttgacggcgccaagccggaggacgtgtttgagacgcttcgcgaggcgggcttgccggaggacggcaagcaggtgctgtacgacggccggaccggcgagccgttcgaaaaccgcgtcaccgtgggatacgtgtacatgatgaagctgcaccacctggtggacgacaagatccacgcgcgctccacgggtccgtactcgctcgtcacccagcagccgctcggaggcaaggcccagttcggcggtcagcggtttggcgagatggaggtgtgggcgctggaggcgtacggcgcggcctacacgctgcaggagctcctcacggtcaagtcggacgacgtggtggggcgtgtcaagacgtacgaggccatcgtcaagggcgagaacgtgccggagccgggtgtgccggagtcgttcaaggtgctcatcaaagagctccagagcctggggatggacgtgaagatcttgagcggcgacgagcgcgagttagagatgaaggagatggacgacgacgaggacagccccgacaagctcaatctgaacctggagtacaacgaggtcggcgattga

SEQ ID NO: 490 - DNA, 3540 bp, Artificial
  Substituion in SEQ ID NO 478
gtgacggttttgcagggacacatggtcaagtacggatgggcggagcgccgcagctacgcgcgcattcgcgaggtcctcgatctcccaaacctcatcgagatccaacagaaatcgtacgagtggttcctgcgggagggcctgcgcgagacgttcgcggacatctctcccatcacggacttcaccgggaaccttgtgcttgagttcgtggactacagcctcggcgagcccaagtacgacgtggaagaatccaaggagcgcgatgtgacgtatgcggcgccgcttcgcgtgaaggttcgcctgctcaacaaggagacgggcgaggtcaaagagcaagaggtgtttctcggcgacttcccgctcatgaccgagacgggcaccttcatcatcaacggcgcggagcgcgtcatcgtgagccagctcgtccgctcccccagcgtctattatagcagcaagatcgacaagaatggcaaacgcacgttcgccgcgacggtcattccgaaccgcggcgcttggctcgagtttgagacggacgcgaaggacgtcgtgtacgtccggatcgatcgcacgcgcaagctgcctatcacggtcttgctccgggcgctgggattgtcgtccgacgccgagatcatcgaactgttaggcgaggacgagtacctgcagaacacgctcgacaaggataccacggactcgacggagcgggcgctcatcgagatctacgagcggctgcgcccgggcgaaccgcccacggtggagaacgcgcgggcgttgcttgcgtctcggttcttcgaccccaagcggtacgatctcgccgcggtcggccggtataagatcaacaaaaagctccatctcaagaaccgcctgctgaaccagcggctggcggagacgctcgtcgacgaggagacgggcgagatcatcgccgaagccgggacggtgctggatcgccgcacgctggatcggatcattccgcgcctgtctggcaaggttgggcgattcaccatccgcggcacgcgggatttgtttgaacaagacgagatcccgctgcagatggtgaagattttcagcccggcggatgacggaaaggtcctgcacgtcatctccaatggcgaactgccggcggacgtcaaatacatcacgccgtccgacatcatcgcggcggtctcgtacttcttcaacctcctgcgcggcgtggggacgacggacgacatcgatcacctgggcaaccggcgcctccgctcggtgggcgagctgttgcaaaaccagttccgcatcgggctctcccgcatggagcgcgtggtgcgcgagcgcatgtccattcaggatgcgagcgcgatcacgcctcaggccctgatcaacattcgcccggtgattgcggccatcaaggagttctttgggtccagccagctttcgcagttcatggatcagacgaatccgctcgctgaactcacgcataagcggcgcctctcggcgctcgggccaggcggtcttacgcgcgagcgggccggcttcgaagtgcgcgacgtgcactactcgcactacggccgcatgtgccccatcgagacgccggaagggccgaacatcggcctcatcaactcgctctcgacctacgcgtgcgtcaacgagtacggcttcatcgagacgccgtaccggcgcgtcgatccagagacgggcgtggtgacggatcagattgactatctaacggcggatgaggaggagaactacctcatcgcgcaggcgaacgagccgctgaccgaggacggccatttcgtggccgaggagatcacggtgcgctcgcgcgaagacgtgatcaccgtgagccgcgatcgcatcgactacatggacgtctcgccgaagcaggtcgtgtcggtcgccacggcgctgatcccgttcctcgagaacgacgacgcgaaccgcgcgctcatgggatcgaacatgcagcgccaggcggtgccgctgctcgtgaccgattcgccgctcgtggggacgggcatggagtaccaggcggcgaaggactccggcgtgtgcgtggtttccaagcacaacggcgtcgtggagcgcgtgacggcccgcgagatctgggtgcgcgaggaagccgtcgtggacgggcaggtcgtgaagggcaacgtccacaagtacaagctcatcaagttcgcgcgctcgaaccagaacacctgcctgaaccagaggcccattgtgcgcgagggcgatcgcgtcaaagtgggggatattctcgcggacgggccggcgacgcaaaacggcgagctggcgctcggccggaacgtgctcgtcgcgttcatgacctgggagggctacaactacgaggacgcgattctcatctcggagaagatggtgaaggaggacgtctacacgtccattcacattgaggaatacgagatcgaggcgcgcgacacgaagctcgggcctgaggagatcacgcgcgacatcccgaacgtgggcgaggatgcgctcaaaaacctcgacgagcgcgggatcatccgcatcggcgcggagatcacgaccaacgacattctcgtcggcaaggtgacgccgaagggcgtgacggagctcaccgcggaagagcggctgttgcacgcgattttcggcgagaaggcccgggaggtgcgcgacacgtcgctgcgcgtgccgcacgggggggccgggatcgtcgtggacgtcaaggtgttcacgcgcgagaacggcgacgagctgcccgctggcgtgaaccagttggtgcgggtgtatgtcgcgcaaaagcgcaagatctcggagggcgacaagatggccgggcgccacgggaacaagggcgtcgtggcgcgcatcctgccggaagaggatatgccgttcctggaggatggaacgccggtcgagatcgtgctgaatccgctcggcgtgccgtcgcgtatgaacatcggtcaggtgctcgagacgcacctgggcatggccgcgaaggtgctggggctgaaaatggccacgccggtgtttgacggcgccaagccggaggacgtgtttgagacgcttcgcgaggcgggcttgccggaggacggcaagcaggtgctgtacgacggccggaccggcgagccgttcgaaaaccgcgtcaccgtgggatacgtgtacatgatgaagctgcaccacctggtggacgacaagatccacgcgcgctccacgggtccgtactcgctcgtcacccagcagccgctcggaggcaaggcccagttcggcggtcagcggtttggcgagatggaggtgtgggcgctggaggcgtacggcgcggcctacacgctgcaggagctcctcacggtcaagtcggacgacgtggtggggcgtgtcaagacgtacgaggccatcgtcaagggcgagaacgtgccggagccgggtgtgccggagtcgttcaaggtgctcatcaaagagctccagagcctggggatggacgtgaagatcttgagcggcgacgagcgcgagatcgagatgaaggagatggacgacgacgaggacagccccgacaagctcaatctgaacctggagtacaacgaggtcggcgattga

SEQ ID NO: 491 - DNA, 3540 bp, Artificial
  Substituion in SEQ ID NO 478
gtgacggttttgcagggacacatggtcaagtacggatgggcggagcgccgcagctacgcgcgcattcgcgaggtcctcgatctcccaaacctcatcgagatccaacagaaatcgtacgagtggttcctgcgggagggcctgcgcgagacgttcgcggacatctctcccatcacggacttcaccgggaaccttgtgcttgagttcgtggactacagcctcggcgagcccaagtacgacgtggaagaatccaaggagcgcgatgtgacgtatgcggcgccgcttcgcgtgaaggttcgcctgctcaacaaggagacgggcgaggtcaaagagcaagaggtgtttctcggcgacttcccgctcatgaccgagacgggcaccttcatcatcaacggcgcggagcgcgtcatcgtgagccagctcgtccgctcccccagcgtctattatagcagcaagatcgacaagaatggcaaacgcacgttcgccgcgacggtcattccgaaccgcggcgcttggctcgagtttgagacggacgcgaaggacgtcgtgtacgtccggatcgatcgcacgcgcaagctgcctatcacggtcttgctccgggcgctgggattgtcgtccgacgccgagatcatcgaactgttaggcgaggacgagtacctgcagaacacgctcgacaaggataccacggactcgacggagcgggcgctcatcgagatctacgagcggctgcgcccgggcgaaccgcccacggtggagaacgcgcgggcgttgcttgcgtctcggttcttcgaccccaagcggtacgatctcgccgcggtcggccggtataagatcaacaaaaagctccatctcaagaaccgcctgctgaaccagcggctggcggagacgctcgtcgacgaggagacgggcgagatcatcgccgaagccgggacggtgctggatcgccgcacgctggatcggatcattccgcgcctgtctggcaaggttgggcgattcaccatccgcggcacgcgggatttgtttgaacaagacgagatcccgctgcagatggtgaagattttcagcccggcggaggacggaaaggtcctgcacgtcatctccaatggcgaactgccggcggacgtcaaatacatcacgccgtccgacatcatcgcggcggtctcgtacttcttcaacctcctgcgcggcgtggggacgacggacgacatcgatcacctgggcaaccggcgcctccgctcggtgggcgagctgttgcaaaaccagttccgcatcgggctctcccgcatggagcgcgtggtgcgcgagcgcatgtccattcaggatgcgagcgcgatcacgcctcaggccctgatcaacattcgcccggtgattgcggccatcaaggagttctttgggtccagccagctttcgcagttcatggatcagacgaatccgctcgctgaactcacgcataagcggcgcctctcggcgctcgggccaggcggtcttacgcgcgagcgggccggcttcgaagtgcgcgacgtgcactactcgcactacggccgcatgtgccccatcgagacgccggaagggccgaacatcggcctcatcaactcgctctcgacctacgcgtgcgtcaacgagtacggcttcatcgagacgccgtaccggcgcgtcgatccagagacgggcgtggtgacggatcagattgactatctaacggcggatgaggaggagaactacctcatcgcgcaggcgaacgagccgctgaccgaggacggccatttcgtggccgaggagatcacggtgcgctcgcgcgaagacgtgatcaccgtgagccgcgatcgcatcgactacatggacgtctcgccgaagcaggtcgtgtcggtcgccacggcgctgatcccgttcctcgagaacgacgacgcgaaccgcgcgctcatgggatcgaacatgcagcgccaggcggtgccgctgctcgtgaccgattcgccgctcgtggggacgggcatggagtaccaggcggcgaaggactccggcgtgtgcgtggtttccaagcacaacggcgtcgtggagcgcgtgacggcccgcgagatctgggtgcgcgaggaagccgtcgtggacgggcaggtcgtgaagggcaacgtccacaagtacaagctcatcaagttcgcgcgctcgaaccagaacacctgcctgaaccagaggcccattgtgcgcgagggcgatcgcgtcaaagtgggggatattctcgcggacgggccggcgacgcaaaacggcgagctggcgctcggccggaacgtgctcgtcgcgttcatgacctgggagggctacaactacgaggacgcgattctcatctcggagaagatggtgaaggaggacgtctacacgtccattcacattgaggaatacgagatcgaggcgcgcgacacgaagctcgggcctgaggagatcacgcgcgacatcccgaacgtgggcgaggatgcgctcaaaaacctcgacgagcgcgggatcatccgcatcggcgcggagatcacgaccaacgacattctcgtcggcaaggtgacgccgaagggcgtgacggagctcaccgcggaagagcggctgttgcacgcgattttcggcgagaaggcccgggaggtgcgcgacacgtcgctgcgcgtgccgcacgggggggccgggatcgtcgtggacgtcaaggtgttcacgcgcgagaacggcgacgagctgcccgctggcgtgaaccagttggtgcgggtgtatgtcgcgcaaaagcgcaagatctcggagggcgacaagatggccgggcgccacgggaacaagggcgtcgtggcgcgcatcctgccggaagaggatatgccgttcctggaggatggaacgccggtcgagatcattctgaatccgctcggcgtgccgtcgcgtatgaacatcggtcaggtgctcgagacgcacctgggcatggccgcgaaggtgctggggctgaaaatggccacgccggtgtttgacggcgccaagccggaggacgtgtttgagacgcttcgcgaggcgggcttgccggaggacggcaagcaggtgctgtacgacggccggaccggcgagccgttcgaaaaccgcgtcaccgtgggatacgtgtacatgatgaagctgcaccacctggtggacgacaagatccacgcgcgctccacgggtccgtactcgctcgtcacccagcagccgctcggaggcaaggcccagttcggcggtcagcggtttggcgagatggaggtgtgggcgctggaggcgtacggcgcggcctacacgctgcaggagctcctcacggtcaagtcggacgacgtggtggggcgtgtcaagacgtacgaggccatcgtcaagggcgagaacgtgccggagccgggtgtgccggagtcgttcaaggtgctcatcaaagagctccagagcctggggatggacgtgaagatcttgagcggcgacgagcgcgagatcgagatgaaggagatggacgacgacgaggacagccccgacaagctcaatctgaacctggagtacaacgaggtcggcgattga

SEQ ID NO: 492 - DNA, 3540 bp, Artificial
  Substituion in SEQ ID NO 478
gtgacggttttgcagggacacatggtcaagtacggatgggcggagcgccgcagctacgcgcgcattcgcgaggtcctcgatctcccaaacctcatcgagatccaacagaaatcgtacgagtggttcctgcgggagggcctgcgcgagacgttcgcggacatctctcccatcacggacttcaccgggaaccttgtgcttgagttcgtggactacagcctcggcgagcccaagtacgacgtggaagaatccaaggagcgcgatgtgacgtatgcggcgccgcttcgcgtgaaggttcgcctgctcaacaaggagacgggcgaggtcaaagagcaagaggtgtttctcggcgacttcccgattatgaccgagacgggcaccttcatcatcaacggcgcggagcgcgtcatcgtgagccagctcgtccgctcccccagcgtctattatagcagcaagatcgacaagaatggcaaacgcacgttcgccgcgacggtcattccgaaccgcggcgcttggctcgagtttgagacggacgcgaaggacgtcgtgtacgtccggatcgatcgcacgcgcaagctgcctatcacggtcttgctccgggcgctgggattgtcgtccgacgccgagatcatcgaactgttaggcgaggacgagtacctgcagaacacgctcgacaaggataccacggactcgacggagcgggcgctcatcgagatctacgagcggctgcgcccgggcgaaccgcccacggtggagaacgcgcgggcgttgcttgcgtctcggttcttcgaccccaagcggtacgatctcgccgcggtcggccggtataagatcaacaaaaagctccatctcaagaaccgcctgctgaaccagcggctggcggagacgctcgtcgacgaggagacgggcgagatcatcgccgaagccgggacggtgctggatcgccgcacgctggatcggatcattccgcgcctgtctggcaaggttgggcgattcaccatccgcggcacgcgggatttgtttgaacaagacgagatcccgctgcagatggtgaagattttcagcccggcggaggacggaaaggtcctgcacgtcatctccaatggcgaactgccggcggacgtcaaatacatcacgccgtccgacatcatcgcggcggtctcgtacttcttcaacctcctgcgcggcgtggggacgacggacgacatcgatcacctgggcaaccggcgcctccgctcggtgggcgagctgttgcaaaaccagttccgcatcgggctctcccgcatggagcgcgtggtgcgcgagcgcatgtccattcaggatgcgagcgcgatcacgcctcaggccctgatcaacattcgcccggtgattgcggccatcaaggagttctttgggtccagccagctttcgcagttcatggatcagacgaatccgctcgctgaactcacgcataagcggcgcctctcggcgctcgggccaggcggtcttacgcgcgagcgggccggcttcgaagtgcgcgacgtgcactactcgcactacggccgcatgtgccccatcgagacgccggaagggccgaacatcggcctcatcaactcgctctcgacctacgcgtgcgtcaacgagtacggcttcatcgagacgccgtaccggcgcgtcgatccagagacgggcgtggtgacggatcagattgactatctaacggcggatgaggaggagaactacctcatcgcgcaggcgaacgagccgctgaccgaggacggccatttcgtggccgaggagatcacggtgcgctcgcgcgaagacgtgatcaccgtgagccgcgatcgcatcgactacatggacgtctcgccgaagcaggtcgtgtcggtcgccacggcgctgatcccgttcctcgagaacgacgacgcgaaccgcgcgctcatgggatcgaacatgcagcgccaggcggtgccgctgctcgtgaccgattcgccgctcgtggggacgggcatggagtaccaggcggcgaaggactccggcgtgtgcgtggtttccaagcacaacggcgtcgtggagcgcgtgacggcccgcgagatctgggtgcgcgaggaagccgtcgtggacgggcaggtcgtgaagggcaacgtccacaagtacaagctcatcaagttcgcgcgctcgaaccagaacacctgcctgaaccagaggcccattgtgcgcgagggcgatcgcgtcaaagtgggggatattctcgcggacgggccggcgacgcaaaacggcgagctggcgctcggccggaacgtgctcgtcgcgttcatgacctgggagggctacaactacgaggacgcgattctcatctcggagaagatggtgaaggaggacgtctacacgtccattcacattgaggaatacgagatcgaggcgcgcgacacgaagctcgggcctgaggagatcacgcgcgacatcccgaacgtgggcgaggatgcgctcaaaaacctcgacgagcgcgggatcatccgcatcggcgcggagatcacgaccaacgacattctcgtcggcaaggtgacgccgaagggcgtgacggagctcaccgcggaagagcggctgttgcacgcgattttcggcgagaaggcccgggaggtgcgcgacacgtcgctgcgcgtgccgcacgggggggccgggatcgtcgtggacgtcaaggtgttcacgcgcgagaacggcgacgagctgcccgctggcgtgaaccagttggtgcgggtgtatgtcgcgcaaaagcgcaagatctcggagggcgacaagatggccgggcgccacgggaacaagggcgtcgtggcgcgcatcctgccggaagaggatatgccgttcctggaggatggaacgccggtcgagatcgtgctgaatccgctcggcgtgccgtcgcgtatgaacatcggtcaggtgctcgagacgcacctgggcatggccgcgaaggtgctggggctgaaaatggccacgccggtgtttgacggcgccaagccggaggacgtgtttgagacgcttcgcgaggcgggcttgccggaggacggcaagcaggtgctgtacgacggccggaccggcgagccgttcgaaaaccgcgtcaccgtgggatacgtgtacatgatgaagctgcaccacctggtggacgacaagatccacgcgcgctccacgggtccgtactcgctcgtcacccagcagccgctcggaggcaaggcccagttcggcggtcagcggtttggcgagatggaggtgtgggcgctggaggcgtacggcgcggcctacacgctgcaggagctcctcacggtcaagtcggacgacgtggtggggcgtgtcaagacgtacgaggccatcgtcaagggcgagaacgtgccggagccgggtgtgccggagtcgttcaaggtgctcatcaaagagctccagagcctggggatggacgtgaagatcttgagcggcgacgagcgcgagatcgagatgaaggagatggacgacgacgaggacagccccgacaagctcaatctgaacctggagtacaacgaggtcggcgattga

SEQ ID NO: 493 - DNA, 3540 bp, Artificial
  Substituion in SEQ ID NO 478
gtgacggttttgcagggacacatggtcaagtacggatgggcggagcgccgcagctacgcgcgcattcgcgaggtcctcgatctcccaaacctcatcgagatccaacagaaatcgtacgagtggttcctgcgggagggcctgcgcgagacgttcgcggacatctctcccatcacggacttcaccgggaaccttgtgcttgagttcgtggactacagcctcggcgagcccaagtacgacgtggaagaatccaaggagcgcgatgtgacgtatgcggcgccgcttcgcgtgaaggttcgcctgctcaacaaggagacgggcgaggtcaaagagcaagaggtgtttctcggcgacttcccgctcatgaccgagacgggcaccttcatcatcaacggcgcggagcgcgtcatcgtgagccagctcgtccgctcccccagcgtctattatagcagcaagatcgacaagaatggcaaacgcacgttcgccgcgacggtcattccgaaccgcggcgcttggctcgagtttgagacggacgcgaaggacgtcgtgtacgtccggatcgatcgcacgcgcaagctgcctatcacggtcttgctccgggcgctgggattgtcgtccgacgccgagatcatcgaactgttaggcgaggacgagtacctgcagaacacgctcgacaaggataccacggactcgacggagcgggcgctcatcgagatctacgagcggctgcgcccgggcgaaccgcccacggtggagaacgcgcgggcgttgcttgcgtctcggttcttcgaccccaagcggtacgatctcgccgcggtcggccggtataagatcaacaaaaagctccatctcaagaaccgcctgctgaaccagcggctggcggagacgctcgtcgacgaggagacgggcgagatcatcgccgaagccgggacggtgctggatcgccgcacgctggatcggatcattccgcgcctgtctggcaaggttgggcgattcaccatccgcggcacgcgggatttgtttgaacaagacgagatcccgctgcagatggtgaagattttcagcccggcggaggacggaaaggtcctgcacgtcatctccaatggcgaactgccggcggacgtcaaatacatcacgccgtccgacatcatcgcggcggtctcgtacttcttcaacctcctgcgcggcgtggggacgacggacgacatcgatcacctgggcaaccggcgcctccgctcggtgggcgagctgttgcaaaaccagttccgcatcgggctctcccgcatggagcgcgtggtgcgcgagcgcatgtccattcaggatgcgagcgcgatcacgcctcaggccctgatcaacattcgcccggtgattgcggccatcaaggagttctttgggtccagccagctttcgcagttcatggatcagacgaatccgctcgctgaactcacgcataagcggcgcctctcggcgctcgggccaggcggtcttacgcgcgagcgggccggcttcgaagtgcgcgacgtgcactactcgcactacggccgcatgtgccccatcgagacgccggaagggccgaacatcggcctcatcaactcgctctcgacctacgcgtgcgtcaacgagtacggcttcatcgagacgccgtaccggcgcgtcgatccagagacgggcgtggtgacggatcagattgactatctaacggcggatgaggaggagaactacctcatcgcgcaggcgaacgagccgctgaccgaggacggccatttcgtggccgaggagatcacggtgcgctcgcgcgaagacgtgatcaccgtgagccgcgatcgcatcgactacatggacgtctcgccgaagcaggtcgtgtcggtcgccacggcgctgatcccgttcctcgagaacgacgacgcgaaccgcgcgctcatgggatcgaacatgcagcgccaggcggtgccgctgctcgtgaccgattcgccgctcgtggggacgggcatggagtaccaggcggcgaaggactccggcgtgtgcgtggtttccaagcacaacggcgtcgtggagcgcgtgacggcccgcgagatctgggtgcgcgaggaagccgtcgtggacgggcaggtcattaagggcaacgtccacaagtacaagctcatcaagttcgcgcgctcgaaccagaacacctgcctgaaccagaggcccattgtgcgcgagggcgatcgcgtcaaagtgggggatattctcgcggacgggccggcgacgcaaaacggcgagctggcgctcggccggaacgtgctcgtcgcgttcatgacctgggagggctacaactacgaggacgcgattctcatctcggagaagatggtgaaggaggacgtctacacgtccattcacattgaggaatacgagatcgaggcgcgcgacacgaagctcgggcctgaggagatcacgcgcgacatcccgaacgtgggcgaggatgcgctcaaaaacctcgacgagcgcgggatcatccgcatcggcgcggagatcacgaccaacgacattctcgtcggcaaggtgacgccgaagggcgtgacggagctcaccgcggaagagcggctgttgcacgcgattttcggcgagaaggcccgggaggtgcgcgacacgtcgctgcgcgtgccgcacgggggggccgggatcgtcgtggacgtcaaggtgttcacgcgcgagaacggcgacgagctgcccgctggcgtgaaccagttggtgcgggtgtatgtcgcgcaaaagcgcaagatctcggagggcgacaagatggccgggcgccacgggaacaagggcgtcgtggcgcgcatcctgccggaagaggatatgccgttcctggaggatggaacgccggtcgagatcgtgctgaatccgctcggcgtgccgtcgcgtatgaacatcggtcaggtgctcgagacgcacctgggcatggccgcgaaggtgctggggctgaaaatggccacgccggtgtttgacggcgccaagccggaggacgtgtttgagacgcttcgcgaggcgggcttgccggaggacggcaagcaggtgctgtacgacggccggaccggcgagccgttcgaaaaccgcgtcaccgtgggatacgtgtacatgatgaagctgcaccacctggtggacgacaagatccacgcgcgctccacgggtccgtactcgctcgtcacccagcagccgctcggaggcaaggcccagttcggcggtcagcggtttggcgagatggaggtgtgggcgctggaggcgtacggcgcggcctacacgctgcaggagctcctcacggtcaagtcggacgacgtggtggggcgtgtcaagacgtacgaggccatcgtcaagggcgagaacgtgccggagccgggtgtgccggagtcgttcaaggtgctcatcaaagagctccagagcctggggatggacgtgaagatcttgagcggcgacgagcgcgagatcgagatgaaggagatggacgacgacgaggacagccccgacaagctcaatctgaacctggagtacaacgaggtcggcgattga

SEQ ID NO: 494 - protein, 191 aa, Alicyclobacillus acidocaldarius
MGVAGCSPCSMENLEKQWYVIHTYSGYENKVKSNLESRVQTMGMEDRIFRVVVPTEEAVEIKNGKKRVVQRKTYPGYVLVEMIMTDDSWYVVRNTPGVTGFVGSPGAGSKPVPLMPHEVEQILSSMGVNEAKPVAQFKVGDVVRLTSGPFADMVGTVEEVHPEHQKLKVLVSMFGRETPLEADFTQVEHLP

SEQ ID NO: 495 - DNA, 576 bp, Alicyclobacillus acidocaldarius
atgggggtggcgggctgctcgccctgctcaatggagaatcttgagaagcagtggtatgtgattcacacatactccggctacgagaacaaggtgaagagcaacctcgaaagccgcgtgcagaccatgggcatggaggaccggattttccgcgtcgtcgtgcccacggaagaggctgtcgagatcaaaaacgggaaaaagcgcgtggtgcagcgcaagacgtaccccggttacgtccttgtggagatgatcatgacggacgactcttggtatgtcgtgcgcaacacgccgggggtgaccggtttcgtgggctcgcccggcgccggatcgaaacctgtgccgctcatgcctcacgaggtcgagcagatcttgagttccatgggtgtgaacgaagcgaagcctgtggcgcagttcaaggtcggcgacgtcgtgcgcctgaccagcgggccgttcgcggacatggtcgggacggtcgaggaggttcatccggagcaccagaagctcaaggttctcgtctccatgttcgggcgcgagacgccgctggaggccgactttacccaggtggagcacctgccttga

SEQ ID NO: 496 - protein, 177 aa, Bacillus sp. NRRL B-14911
MEKNWYVVHTYSGYENKVKANLEKRVETMAMQDKIFRVIVPEEEETDIKNGKKKVVKRKVFPGYVLVEIVMTDDSWYVVRNTPGVTGFVGSAGSGSKPTPLLPEEVNVILKRMGVDEKRVDIDFEIGETVKVNEGPFANFTGSIEEIDKDKAKIKVLVNMFGRETPVELDFTQIEKL

SEQ ID NO: 497 - protein, 177 aa, Bacillus clausii KSM-K16
MEKNWFVVHTYSGYENKVKANLEKRVESMEMTDHIFRVLVPVEEETEIKNGKTKQVSRKVFPGYVLVEMVMTDDSWYVVRNTPGVTGFVGSAGAGSKPTPLMPDEVERILKQMGVVEAQEEVDFELKESVKVKSGPFADFVGTIEEIQVEKRKLKVHVNMFGRETPVELEFGQVEKI

SEQ ID NO: 498 - protein, 177 aa, Bacillus licheniformis ATCC 14580
MEKKWYVVHTYSGYENKVKANLEKRVESMGMQDKIFRVVVPEEEETDIKNGKKKVVKKKVFPGYVLVELVMTDDSWYVVRNTPGVTGFVGSAGSGSKPTALLPGEAEKILKRMGLEERKTEIDFELKETVKVIDGPFADFTGTIEEIDHDKNKVKVFVNMFGRETPVELEFTQVDKL

SEQ ID NO: 499 - protein, 177 aa, Listeria welshimeri serovar 6b str. SLCC5334
MEKNWYVVHTYSGYENKVKANLEKRVESMGMSDKIFRVIVPEEEETEVKNGKTKTIKRKVFPGYVLVEIVMTDDSWYVVRNTPGVTGFVGSSGSGSKPTPLLPEEAERILKSMGMVEKRAEADFEIGETVMVKEGPFADFSGKVDEMDNDKGKAKVMVNMFGRETPVEVDFNQIEKL

SEQ ID NO: 500 - protein, 177 aa, Oceanobacillus iheyensis HTE831
MEKNWYVVHTYSGYENKVKMNLEKRVESMGMEDKIFRVIVPEDEEAEIKNGKKKMVKKKSFPGYVLTEMVMTDDSWYVVRNTPGVTGFVGSSGHGAKPTPLMPGEIDVVLKRMGVSEPTVQVDFEIKENVRVTDGPFTDFTGSIEHIDTDKQKIKVHVNMFGRETPVELDFSQVEKL

SEQ ID NO: 501 - protein, 191 aa, Artificial
  Substituion in SEQ ID NO 494
MGVAGCSPCSMENLEKQWYVIHTYSGYENKVKSNLESRVQTMGMEDRIFRVVVPTEEAVEIKNGKKRVVQRKTYPGYVLVEMIMTDDSWYVVRNTPGVTGFVGSPGAGSKPVPLMPHEVEQILSSMGVQEAKPVAQFKVGDVVRLTSGPFADMVGTVEEVHPEHQKLKVLVSMFGRETPLEADFTQVEHLP

SEQ ID NO: 502 - protein, 191 aa, Artificial
  Substituion in SEQ ID NO 494
MGVAGCSPCSMENLEKQWYVIHTYSGYENKVKSNLESRVQTMGMEDRIFRVVVPTEEAVEIKNGKKRVVQRKTYPGYVLVEMIMTDDSWYVVRNTPGVTGFVGSPGAGSKPVPLMPHEVEQLLSSMGVNEAKPVAQFKVGDVVRLTSGPFADMVGTVEEVHPEHQKLKVLVSMFGRETPLEADFTQVEHLP

SEQ ID NO: 503 - protein, 191 aa, Artificial
  Substituion in SEQ ID NO 494
MGVAGCSPCSMENLEKQWYVIHTYSGYENKVKSNLESRVQTMGMEDRIFRVVVPTEEAVEIKNGKKRVVQRKTYPGYVLVEMIMTDDSWYVVRNTPGVTGFVGSPGAGSKPVPLMPHEVEQILSSMGVNEAKPVAQFKVGDVVRLTSGPFADMVGTVEEVHPEHQKIKVLVSMFGRETPLEADFTQVEHLP

SEQ ID NO: 504 - protein, 191 aa, Artificial
  Substituion in SEQ ID NO 494
MGVAGCSPCSMENLEKNWYVIHTYSGYENKVKSNLESRVQTMGMEDRIFRVVVPTEEAVEIKNGKKRVVQRKTYPGYVLVEMIMTDDSWYVVRNTPGVTGFVGSPGAGSKPVPLMPHEVEQILSSMGVNEAKPVAQFKVGDVVRLTSGPFADMVGTVEEVHPEHQKLKVLVSMFGRETPLEADFTQVEHLP

SEQ ID NO: 505 - protein, 191 aa, Artificial
  Substituion in SEQ ID NO 494
MGVAGCSPCSMENLEKQWYVIHTYSGYENKVKSNLESRVQTMGMEDRIFRVVVPTEEAVEIKNGKKRVVQRKTYPGYVLVEMIMTDDSWYVVRNTPGVTGFVGSPGAGSKPVPLMPHEVEQILSSMGVNEAKPVAQFKVGDVVRLTSGPFADMVGTVEEVHPDHQKLKVLVSMFGRETPLEADFTQVEHLP

SEQ ID NO: 506 - DNA, 576 bp, Artificial
  Substituion in SEQ ID NO 495
atgggggtggcgggctgctcgccctgctcaatggagaatcttgagaagcagtggtatgtgattcacacatactccggctacgagaacaaggtgaagagcaacctcgaaagccgcgtgcagaccatgggcatggaggaccggattttccgcgtcgtcgtgcccacggaagaggctgtcgagatcaaaaacgggaaaaagcgcgtggtgcagcgcaagacgtaccccggttacgtccttgtggagatgatcatgacggacgactcttggtatgtcgtgcgcaacacgccgggggtgaccggtttcgtgggctcgcccggcgccggatcgaaacctgtgccgctcatgcctcacgaggtcgagcagatcttgagttccatgggtgtgcaagaagcgaagcctgtggcgcagttcaaggtcggcgacgtcgtgcgcctgaccagcgggccgttcgcggacatggtcgggacggtcgaggaggttcatccggagcaccagaagctcaaggttctcgtctccatgttcgggcgcgagacgccgctggaggccgactttacccaggtggagcacctgccttga

SEQ ID NO: 507 - DNA, 576 bp, Artificial
  Substituion in SEQ ID NO 495
atgggggtggcgggctgctcgccctgctcaatggagaatcttgagaagcagtggtatgtgattcacacatactccggctacgagaacaaggtgaagagcaacctcgaaagccgcgtgcagaccatgggcatggaggaccggattttccgcgtcgtcgtgcccacggaagaggctgtcgagatcaaaaacgggaaaaagcgcgtggtgcagcgcaagacgtaccccggttacgtccttgtggagatgatcatgacggacgactcttggtatgtcgtgcgcaacacgccgggggtgaccggtttcgtgggctcgcccggcgccggatcgaaacctgtgccgctcatgcctcacgaggtcgagcagttattgagttccatgggtgtgaacgaagcgaagcctgtggcgcagttcaaggtcggcgacgtcgtgcgcctgaccagcgggccgttcgcggacatggtcgggacggtcgaggaggttcatccggagcaccagaagctcaaggttctcgtctccatgttcgggcgcgagacgccgctggaggccgactttacccaggtggagcacctgccttga

SEQ ID NO: 508 - DNA, 576 bp, Artificial
  Substituion in SEQ ID NO 495
atgggggtggcgggctgctcgccctgctcaatggagaatcttgagaagcagtggtatgtgattcacacatactccggctacgagaacaaggtgaagagcaacctcgaaagccgcgtgcagaccatgggcatggaggaccggattttccgcgtcgtcgtgcccacggaagaggctgtcgagatcaaaaacgggaaaaagcgcgtggtgcagcgcaagacgtaccccggttacgtccttgtggagatgatcatgacggacgactcttggtatgtcgtgcgcaacacgccgggggtgaccggtttcgtgggctcgcccggcgccggatcgaaacctgtgccgctcatgcctcacgaggtcgagcagatcttgagttccatgggtgtgaacgaagcgaagcctgtggcgcagttcaaggtcggcgacgtcgtgcgcctgaccagcgggccgttcgcggacatggtcgggacggtcgaggaggttcatccggagcaccagaagattaaggttctcgtctccatgttcgggcgcgagacgccgctggaggccgactttacccaggtggagcacctgccttga

SEQ ID NO: 509 - DNA, 576 bp, Artificial
  Substituion in SEQ ID NO 495
atgggggtggcgggctgctcgccctgctcaatggagaatcttgagaagaattggtatgtgattcacacatactccggctacgagaacaaggtgaagagcaacctcgaaagccgcgtgcagaccatgggcatggaggaccggattttccgcgtcgtcgtgcccacggaagaggctgtcgagatcaaaaacgggaaaaagcgcgtggtgcagcgcaagacgtaccccggttacgtccttgtggagatgatcatgacggacgactcttggtatgtcgtgcgcaacacgccgggggtgaccggtttcgtgggctcgcccggcgccggatcgaaacctgtgccgctcatgcctcacgaggtcgagcagatcttgagttccatgggtgtgaacgaagcgaagcctgtggcgcagttcaaggtcggcgacgtcgtgcgcctgaccagcgggccgttcgcggacatggtcgggacggtcgaggaggttcatccggagcaccagaagctcaaggttctcgtctccatgttcgggcgcgagacgccgctggaggccgactttacccaggtggagcacctgccttga

SEQ ID NO: 510 - DNA, 576 bp, Artificial
  Substituion in SEQ ID NO 495
atgggggtggcgggctgctcgccctgctcaatggagaatcttgagaagcagtggtatgtgattcacacatactccggctacgagaacaaggtgaagagcaacctcgaaagccgcgtgcagaccatgggcatggaggaccggattttccgcgtcgtcgtgcccacggaagaggctgtcgagatcaaaaacgggaaaaagcgcgtggtgcagcgcaagacgtaccccggttacgtccttgtggagatgatcatgacggacgactcttggtatgtcgtgcgcaacacgccgggggtgaccggtttcgtgggctcgcccggcgccggatcgaaacctgtgccgctcatgcctcacgaggtcgagcagatcttgagttccatgggtgtgaacgaagcgaagcctgtggcgcagttcaaggtcggcgacgtcgtgcgcctgaccagcgggccgttcgcggacatggtcgggacggtcgaggaggttcatccggatcaccagaagctcaaggttctcgtctccatgttcgggcgcgagacgccgctggaggccgactttacccaggtggagcacctgccttga

SEQ ID NO: 511 - protein, 223 aa, Alicyclobacillus acidocaldarius
MSTQPTPRDADAAPPYDTAPYENMTDEELVEAVHRGDTDALDYLIHKYKNFVRAKARSYFLIGADREDIVQEGMIGLYKSIRDFRGDKLSSFKAFAELCITRQIITAIKTATRQKHIPLNSYVSLDKPIYDEDSDRTLLDVICTVRVADPEELIINQEEFDDIEGKMSELLSDLERQVLMLYLDGRSYQEIAVDLARHVKSIDNALQRVKRKLEKYLTVRNVI

SEQ ID NO: 512 - DNA, 672 bp, Alicyclobacillus acidocaldarius
ttgtcgacgcagccgacaccaagagacgccgacgcggccccgccgtacgacacggcgccctacgagaacatgacggacgaagagctggtcgaggctgttcatcgaggcgacaccgacgcgctcgactatttgattcacaaatacaagaatttcgttcgggccaaggcgcggtcgtactttctcattggggctgatcgggaagacatcgtacaggaaggcatgattgggctgtacaagtccatccgcgattttcgcggagacaagctctcctccttcaaggcgttcgccgaactgtgcatcacgcgtcagattatcaccgctatcaaaacagccacgagacaaaagcatattccgctcaattcctacgtttcgctggacaagcccatttacgatgaggactcggatcgcacgctgctcgacgtcatctgtaccgtgcgcgtcgcggatccggaagagctgattataaaccaggaagagtttgacgatattgagggtaagatgtccgaattgctgagcgatctggagcgccaggtcttgatgctgtatctcgacgggcgttcgtatcaggagattgcggtggatctcgctcggcatgtcaaatccatcgacaacgcccttcagcgggtcaagcggaagctggagaaatacttgacggtgcgcaacgtgatatga

SEQ ID NO: 513 - protein, 199 aa, Bacillus licheniformis ATCC 14580
LEDEQVIEMVHVGDSDALDYLITKYRNFVRAKARSYFLIGADREDIVQEGMIGLYKSIRDFREDKLTSFKAFAELCITRQIITAIKTATRQKHIPLNSYVSLDKPIYDEESDRTLLDVISGAKVMNPEELIINQEEFDDIELKMGELLSDLERKVLALYLDGRSYQEISEELNRHVKSIDNALQRVKRKLEKYLELREI

SEQ ID NO: 514 - protein, 199 aa, Bacillus amyloliquefaciens FZB42
LEDEQVIEKVHVGDSDALDYLITKYRNFVRAKARSYFLIGADREDIVQEGMIGLYKSIRDFREDKLTSFKAFAELCITRQIITAIKTATRQKHIPLNSYVSLDKPIFDEESDRTLLDVISGAKTLNPEEMIINQEEFDDIEMKMGELLSDLERKVLVLYLDGRSYQEISDDLNRHVKSIDNALQRVKRKLEKYLEIREI

SEQ ID NO: 515 - protein, 201 aa, Bacillus megaterium
EQQEDETVVDLVHKGDIDALEYLIHKYKNFVRAKARSYFLIGADREDIVQEGMIGLYKAIRDFREDKLTSFKAFAELCITRQIITAIKTATRQKHIPLNSYVSLDKPIYDEESDRTLMDVISGTKVANPEELLINREKFDDIELKMAELLSDLERKVLVLYLDGQSYQEISEELNRHVKSIDNALQRVKRKLERYLEIREI

SEQ ID NO: 516 - protein, 197 aa, Bacillus sp. NRRL B-14911
LEDEEIIELVHRGESEALDYLIQKYRNFVRAKARSYFLIGADKEDIVQEGMIGLYKAIRDFKEDKLSSFKAFAELCITRQIITAIKTATRQKHIPLNSYVSLDKPIYDEESDRTLMDVISGAKVMDPEELIINQEEFDNIEVKMSELLSDLERKVLALYLDGQSYQEISEELNRHVKSIDNALQRVKRKLERYLEVR

SEQ ID NO: 517 - protein, 197 aa, Bacillus halodurans C-125
DVGLVNRVRNGDGAALEYLIHKYKNFVRAKARSYFLIGADHEDIVQEGMIGLYKAIRDFKGDKLSSFKAFAELCITRQIITAIKTATRQKHIPLNSYVSLDKPLYDEESDRTLLDVVCGSRVTDPEELLINQEEFDDIEVKMGELLSDLERKVLMLYLDGRSYQEISAELNRHVKSIDNALQRVKRKLERYMELKGV

SEQ ID NO: 518 - protein, 223 aa, Artificial
  Substituion in SEQ ID NO 511
MSTQPTPRDADAAPPYDTAPYENMTDEELIEAVHRGDTDALDYLIHKYKNFVRAKARSYFLIGADREDIVQEGMIGLYKSIRDFRGDKLSSFKAFAELCITRQIITAIKTATRQKHIPLNSYVSLDKPIYDEDSDRTLLDVICTVRVADPEELIINQEEFDDIEGKMSELLSDLERQVLMLYLDGRSYQEIAVDLARHVKSIDNALQRVKRKLEKYLTVRNVI

SEQ ID NO: 519 - protein, 223 aa, Artificial
  Substituion in SEQ ID NO 511
MSTQPTPRDADAAPPYDTAPYENMTDEEIVEAVHRGDTDALDYLIHKYKNFVRAKARSYFLIGADREDIVQEGMIGLYKSIRDFRGDKLSSFKAFAELCITRQIITAIKTATRQKHIPLNSYVSLDKPIYDEDSDRTLLDVICTVRVADPEELIINQEEFDDIEGKMSELLSDLERQVLMLYLDGRSYQEIAVDLARHVKSIDNALQRVKRKLEKYLTVRNVI

SEQ ID NO: 520 - protein, 223 aa, Artificial
  Substituion in SEQ ID NO 511
MSTQPTPRDADAAPPYDTAPYENMTDEELVEAVHRGDTDALDYLIHKYKNFVRAKARSYFLIGADREDIVQEGMIGLYKSIRDFRGDKLSSFKAFAELCITRQIITAIKTATRQKHIPLNSYVSLDKPIYDEDSDRTLLDVICTVRVADPEELIINQEEFDDIEGKMSELLSDLERQVLMLYLDGRSYQEIAVDLARHVKSIDNALQRVKRKLEKYLTVRNVL

SEQ ID NO: 521 - protein, 223 aa, Artificial
  Substituion in SEQ ID NO 511
MSTQPTPRDADAAPPYDTAPYENMTDEELVEAVHRGDTDALDYLIHKYKNFVRAKARSYFLIGADREDIVQEGMIGLYKSIRDFRGDKLSSFKAFAELCITRQIITAIKTATRQKHIPLNSYVSLDKPIYDEDSDRTLLDVICTVRVADPEELIINQEEFDDIEGKMSELLSDLERQVLMLYLDGRSYQEIAVDLARHVKSIDNALQRVKRKLEKYLTVRQVI

SEQ ID NO: 522 - protein, 223 aa, Artificial
  Substituion in SEQ ID NO 511
MSTQPTPRDADAAPPYDTAPYENMTDEELVEAVHRGDTDALDYLIHKYKNFVRAKARSYFLIGADREDIVQEGMIGLYKSIRDFRGDKLSSFKAFAELCITRQIITAIKTATRQKHIPLNSYVSLDKPIYDEDSDRTLLDVICTVRVADPEELIINQEEFDDIEGKMSELLSDLERQVLMLYLDGRSYQEIAVELARHVKSIDNALQRVKRKLEKYLTVRNVI

SEQ ID NO: 523 - DNA, 672 bp, Artificial
  Substituion in SEQ ID NO 512
ttgtcgacgcagccgacaccaagagacgccgacgcggccccgccgtacgacacggcgccctacgagaacatgacggacgaagagctgattgaggctgttcatcgaggcgacaccgacgcgctcgactatttgattcacaaatacaagaatttcgttcgggccaaggcgcggtcgtactttctcattggggctgatcgggaagacatcgtacaggaaggcatgattgggctgtacaagtccatccgcgattttcgcggagacaagctctcctccttcaaggcgttcgccgaactgtgcatcacgcgtcagattatcaccgctatcaaaacagccacgagacaaaagcatattccgctcaattcctacgtttcgctggacaagcccatttacgatgaggactcggatcgcacgctgctcgacgtcatctgtaccgtgcgcgtcgcggatccggaagagctgattataaaccaggaagagtttgacgatattgagggtaagatgtccgaattgctgagcgatctggagcgccaggtcttgatgctgtatctcgacgggcgttcgtatcaggagattgcggtggatctcgctcggcatgtcaaatccatcgacaacgcccttcagcgggtcaagcggaagctggagaaatacttgacggtgcgcaacgtgatatga

SEQ ID NO: 524 - DNA, 672 bp, Artificial
  Substituion in SEQ ID NO 512
ttgtcgacgcagccgacaccaagagacgccgacgcggccccgccgtacgacacggcgccctacgagaacatgacggacgaagagattgtcgaggctgttcatcgaggcgacaccgacgcgctcgactatttgattcacaaatacaagaatttcgttcgggccaaggcgcggtcgtactttctcattggggctgatcgggaagacatcgtacaggaaggcatgattgggctgtacaagtccatccgcgattttcgcggagacaagctctcctccttcaaggcgttcgccgaactgtgcatcacgcgtcagattatcaccgctatcaaaacagccacgagacaaaagcatattccgctcaattcctacgtttcgctggacaagcccatttacgatgaggactcggatcgcacgctgctcgacgtcatctgtaccgtgcgcgtcgcggatccggaagagctgattataaaccaggaagagtttgacgatattgagggtaagatgtccgaattgctgagcgatctggagcgccaggtcttgatgctgtatctcgacgggcgttcgtatcaggagattgcggtggatctcgctcggcatgtcaaatccatcgacaacgcccttcagcgggtcaagcggaagctggagaaatacttgacggtgcgcaacgtgatatga

SEQ ID NO: 525 - DNA, 672 bp, Artificial
  Substituion in SEQ ID NO 512
ttgtcgacgcagccgacaccaagagacgccgacgcggccccgccgtacgacacggcgccctacgagaacatgacggacgaagagctggtcgaggctgttcatcgaggcgacaccgacgcgctcgactatttgattcacaaatacaagaatttcgttcgggccaaggcgcggtcgtactttctcattggggctgatcgggaagacatcgtacaggaaggcatgattgggctgtacaagtccatccgcgattttcgcggagacaagctctcctccttcaaggcgttcgccgaactgtgcatcacgcgtcagattatcaccgctatcaaaacagccacgagacaaaagcatattccgctcaattcctacgtttcgctggacaagcccatttacgatgaggactcggatcgcacgctgctcgacgtcatctgtaccgtgcgcgtcgcggatccggaagagctgattataaaccaggaagagtttgacgatattgagggtaagatgtccgaattgctgagcgatctggagcgccaggtcttgatgctgtatctcgacgggcgttcgtatcaggagattgcggtggatctcgctcggcatgtcaaatccatcgacaacgcccttcagcgggtcaagcggaagctggagaaatacttgacggtgcgcaacgtgttatga

SEQ ID NO: 526 - DNA, 672 bp, Artificial
  Substituion in SEQ ID NO 512
ttgtcgacgcagccgacaccaagagacgccgacgcggccccgccgtacgacacggcgccctacgagaacatgacggacgaagagctggtcgaggctgttcatcgaggcgacaccgacgcgctcgactatttgattcacaaatacaagaatttcgttcgggccaaggcgcggtcgtactttctcattggggctgatcgggaagacatcgtacaggaaggcatgattgggctgtacaagtccatccgcgattttcgcggagacaagctctcctccttcaaggcgttcgccgaactgtgcatcacgcgtcagattatcaccgctatcaaaacagccacgagacaaaagcatattccgctcaattcctacgtttcgctggacaagcccatttacgatgaggactcggatcgcacgctgctcgacgtcatctgtaccgtgcgcgtcgcggatccggaagagctgattataaaccaggaagagtttgacgatattgagggtaagatgtccgaattgctgagcgatctggagcgccaggtcttgatgctgtatctcgacgggcgttcgtatcaggagattgcggtggatctcgctcggcatgtcaaatccatcgacaacgcccttcagcgggtcaagcggaagctggagaaatacttgacggtgcgccaagtgatatga

SEQ ID NO: 527 - DNA, 672 bp, Artificial
  Substituion in SEQ ID NO 512
ttgtcgacgcagccgacaccaagagacgccgacgcggccccgccgtacgacacggcgccctacgagaacatgacggacgaagagctggtcgaggctgttcatcgaggcgacaccgacgcgctcgactatttgattcacaaatacaagaatttcgttcgggccaaggcgcggtcgtactttctcattggggctgatcgggaagacatcgtacaggaaggcatgattgggctgtacaagtccatccgcgattttcgcggagacaagctctcctccttcaaggcgttcgccgaactgtgcatcacgcgtcagattatcaccgctatcaaaacagccacgagacaaaagcatattccgctcaattcctacgtttcgctggacaagcccatttacgatgaggactcggatcgcacgctgctcgacgtcatctgtaccgtgcgcgtcgcggatccggaagagctgattataaaccaggaagagtttgacgatattgagggtaagatgtccgaattgctgagcgatctggagcgccaggtcttgatgctgtatctcgacgggcgttcgtatcaggagattgcggtggaactcgctcggcatgtcaaatccatcgacaacgcccttcagcgggtcaagcggaagctggagaaatacttgacggtgcgcaacgtgatatga

SEQ ID NO: 528 - protein, 359 aa, Alicyclobacillus acidocaldarius
MKDDAKREAAINKILRMVAPGTVLREGIENILRAKTGGLIVVGATETVLSMMDGGFAIQCDLTPSHLYELAKMDGAIIISEDAKKVHYANTTLNPDHTIPTSETGTRHRTAERVARQSGQLVICISQRRNVITLYQGNLKYVLRDISVILAKANQALQTLEKYKTVLEQELTDLSALEFEEAVTLEDVTRVLQRFETVLRVTNEIRRYIIELGNEGRLVSMQLEELVSDVDEQAYLLIKDFAHPECPHTPHQIMSQIHNLSSEELLDGALLARILGYPPSVNQLEESVPSRGYRILNKISRLPQPVIENLVEHFGVLSNILKASMADLDKVEGVGPVRARMIQNGLGRIQEQVLIDRQI

SEQ ID NO: 529 - DNA, 1080 bp, Alicyclobacillus acidocaldarius
gtgaaggacgacgccaagcgggaagctgccatcaataaaatcttgcgcatggttgcgccagggaccgttctccgagagggaatcgagaacattctgcgcgccaagacgggcgggctcatcgtcgtcggcgcgacggaaaccgtgctctccatgatggacggcggtttcgccatccagtgcgatctgaccccgtcccatctgtacgagctcgcgaagatggacggcgccatcatcatcagtgaggacgcgaagaaggtccactacgccaacacgacgctgaacccggaccacaccatacccacatcggaaaccgggacgcggcatcgcaccgcggagcgcgtggctcgccagagcggccagttggtcatctgcatttcgcagcgccgaaacgtgatcacgctataccaaggcaatttgaaatacgtgctgcgcgacatcagcgtaattttggccaaagccaatcaggcgctgcagacgcttgaaaaatacaagacggtcctggagcaggaactcacggatctcagcgcgctggaatttgaggaggccgtgacgctggaggacgtcacgcgcgttcttcagcggttcgagacggtgctgcgcgtgaccaacgagatccgccgctacatcatcgagctcggcaacgaggggcgattggtcagcatgcagctggaggaactcgtctcggacgtcgacgagcaggcgtacctgctcatcaaggacttcgcccatcccgagtgtcctcacacgccgcatcagatcatgtcgcagatccacaacctctcttccgaggaactgctcgacggggcgctgctggcgcgcattcttgggtatccgccgagcgtcaaccagcttgaggagagcgttccgtcgcgcggttaccggattttgaacaagatcagccggttgccccagcccgtgatcgaaaacctcgtcgagcacttcggcgttctgtccaacattctcaaggcgtcgatggcggacctggataaagtggagggcgtcggcccggtccgcgcccgcatgattcaaaacggactcggacgcattcaggagcaagtgctgattgatcgtcagatttga

SEQ ID NO: 530 - protein, 354 aa, Pelotomaculum thermopropionicum SI
EEKVDGNLLKVLRSLAPGTHLREGLENILRAKAGALIVIGDTPEVMEIAEGGFAINADFTPSSLYELAKMDGAIILSKDAKKILAANTQLVPNQNIPSAETGIRHRTAERVAKQTGALVIAISQRRGVITIYKGASKYVLRDIGVILSKANQAIQTLEKYRTVLDKVLVELSVLEFEEVVTLFDVAKAIQRVEMVLRVVKEIERYTSELGAEGRLITMQMEELVANVESEGLLVIQDYATTIGEKTPSSILGVIGSWPAEDILDLSLIARALGYPGSASILEQHVSPRGYRILEKIPRLPLPVIDNLVKTFGTLNRILVATIEELDDVEGIGEVRARSIKEGLNRYREQLLQER

SEQ ID NO: 531 - protein, 357 aa, Desulfotomaculum reducens MI-1
MVKDEKIEDKLIKLLRLVAPGTPLREGLENILRAKTGALIVIGDIPEVMELAEGGFAINADFTPAGLYELAKMDGAIILSEDAKKIIAANTQLIPDLIIPSSETGIRHRTAERVAKQCDMPVISISQRRSVITVYKGSIKYFLRDISVILAKANQAVQTLEKYRSVSDRVINELSMMELQEVVTLFDVTKAIQRIEMVLRVKKEIDRYISELGTEGRLIAMQMEELVANVEEEGLLIIQDYATTLGEKTPESILKVIGSWPAEDLLDLVLIARALGYPGSASVLDQSVSPRGYRALRKIPRLPLPVIENLVSTFQYLRTILAASIAELDEVEGIGEVRARSIKDGLTRYGEMLLQDR

SEQ ID NO: 532 - protein, 351 aa, Bacillus pumilus SAFR-032
RELDLLDIVQFVAPGTPLRAGIENVLRANTGGLIVVGYNDKVKSVVDGGFHINSAFSPAHLYELAKMDGAIILSDSGQKILYANTQLMPDATIHSSETGMRHRTAERVAKQTGCLIIAISERRNVITLYQGNRRYTLKDIGFILTKANQAIQTLEKYKTILDHAISALSALEFEELVTFGDVLSVLHRYEMVLRIKNEINMYIKELGTEGHLIRLQVNELITDMEQEAALFIKDYVKEKIKDPYVLLKQLQDMSSFELLDDSILYKLLGYPASTNIDEYVYTRGYRLLHKIPRLPMPIVENVVEAFGVLDRIMEADVQDLDEVEGIGEVRAKKIKKGLKRLQEKHYIDRQL

SEQ ID NO: 533 - protein, 356 aa, Bacillus halodurans C-125
DSEVKERFARNILKMVAPGTALRTGIDNVLRAKTGGLIVLGYNENMKGIVDGGFYLDCPFSPASLYELAKMDGAIILNEDGTKILYANTQLNPDNAISSNETGIRHRTAERVAKQTGNLVISISQRRNVITLYHGHLRYALRDIGVILTKANQAIQTLDKYKSVLDQDITDLGALEFEELVTFHEVSQVMQRIHMVLNIKGEILNYVNELGSEGRLITMQLNELVSNLEKEVLLLIQDYAKEDDVDPEDVLEQMMKCSNEELLDDSNILKLLGYHKAFNVQEQQATPRGYRILHKIPRLPATIVRNLVHSFENINDMLRADLKELDEVEGIGEARAKLIKDGLSRIQEQLFMDRNI

SEQ ID NO: 534 - protein, 356 aa, Bacillus subtilis subsp. subtilis str. 168
KKGAKHELDLSSILQFVAPGTPLRAGMENVLRANTGGLIVVGYNDKVKEVVDGGFHINTAFSPAHLYELAKMDGAIILSDSGQKILYANTQLMPDATISSSETGMRHRTAERVAKQTGCLVIAISERRNVITLYQENMKYTLKDIGFILTKANQAIQTLEKYKTILDKTINALNALEFEELVTFSDVLSVMHRYEMVLRIKNEINMYIKELGTEGHLIKLQVIELITDMEEEAALFIKDYVKEKIKDPFVLLKELQDMSSYDLLDDSIVYKLLGYPASTNLDDYVLPRGYRLLNKIPRLPMPIVENVVEAFGVLPRIIEASAEELDEVEGIGEVRAQKIKKGLKRLQEKHYLDRQL

SEQ ID NO: 535 - protein, 359 aa, Artificial
  Substituion in SEQ ID NO 528
MKDDAKREAAINKILRMVAPGTVLREGIENILRAKTGGLIVVGATETVLSMMDGGFAIQCDLTPSHLYELAKMDGAIIISEDAKKVHYANTTLNPDHTIPTSETGTRHRTAERVARQSGQLVICISQRRNVITLYQGNLKYVLRDISVILAKANQALQTLEKYKTVLDQELTDLSALEFEEAVTLEDVTRVLQRFETVLRVTNEIRRYIIELGNEGRLVSMQLEELVSDVDEQAYLLIKDFAHPECPHTPHQIMSQIHNLSSEELLDGALLARILGYPPSVNQLEESVPSRGYRILNKISRLPQPVIENLVEHFGVLSNILKASMADLDKVEGVGPVRARMIQNGLGRIQEQVLIDRQI

SEQ ID NO: 536 - protein, 359 aa, Artificial
  Substituion in SEQ ID NO 528
MKDDAKREAAINKILRMVAPGTVLREGIENILRAKTGGLIVVGATETVLSMMDGGFAIQCDLTPSHLYELAKMDGAIIISEDAKKVHYANTTLNPDHTIPTSETGTRHRTAERVARQSGQLVICISQRRNVITLYQGNLKYVLRDISVILAKANQALQTLEKYKTVLEQELTDLSALEFEEAVTLEDVTRVLQRFETVLRVTNEIRRYIIELGNEGRLVSMQLEELVSDVDEQAYLLIKDFAHPECPHTPHQIMSQIHNLSSEELLDGALLARILGYPPSVNQLEESVPSRGYRILNKISRLPQPVIENLVEHFGVLSNILKASMADLDKVEGVGPVRARMIQNGLGRIQEQVLIDRNI

SEQ ID NO: 537 - protein, 359 aa, Artificial
  Substituion in SEQ ID NO 528
MKDDAKREAAINKILRMIAPGTVLREGIENILRAKTGGLIVVGATETVLSMMDGGFAIQCDLTPSHLYELAKMDGAIIISEDAKKVHYANTTLNPDHTIPTSETGTRHRTAERVARQSGQLVICISQRRNVITLYQGNLKYVLRDISVILAKANQALQTLEKYKTVLEQELTDLSALEFEEAVTLEDVTRVLQRFETVLRVTNEIRRYIIELGNEGRLVSMQLEELVSDVDEQAYLLIKDFAHPECPHTPHQIMSQIHNLSSEELLDGALLARILGYPPSVNQLEESVPSRGYRILNKISRLPQPVIENLVEHFGVLSNILKASMADLDKVEGVGPVRARMIQNGLGRIQEQVLIDRQI

SEQ ID NO: 538 - protein, 359 aa, Artificial
  Substituion in SEQ ID NO 528
MKDDAKREAAINKILRMVAPGTVLREGIENILRAKTGGLIVVGATETVLSMMDGGFAIQCDLTPSHLYELAKMDGAIIISEDAKKVHYANTTLNPDHTIPTSETGTRHRTAERVARQSGQLVICISQRRNVITLYQGNLKYVLRDISVILAKANQALQTLEKYKTVLEQELTDLSALEFEEAVTLEDVTRVLQRFETVLRITNEIRRYIIELGNEGRLVSMQLEELVSDVDEQAYLLIKDFAHPECPHTPHQIMSQIHNLSSEELLDGALLARILGYPPSVNQLEESVPSRGYRILNKISRLPQPVIENLVEHFGVLSNILKASMADLDKVEGVGPVRARMIQNGLGRIQEQVLIDRQI

SEQ ID NO: 539 - protein, 359 aa, Artificial
  Substituion in SEQ ID NO 528
MKDDAKREAAINKILRMVAPGTVLREGIENILRAKTGGLIVVGATETVLSMMDGGFAIQCDLTPSHLYELAKMDGAIIISEDAKKVHYANTTLNPDHTIPTSETGTRHRTAERVARQSGQLVICISQRRNVITLYQGNLKYVLRDISVILAKANQALQTLEKYKTVLEQELTDLSALEFEEAVTLEDVTRVLQRFETVLRVTNEIRRYIIELGNEGRLVSMQLEELVSDVDEQAYLLIKDFAHPECPHTPHQIMSQIHNLSSEELLDGALLARILGYPPSVNQLEESVPSRGYRILNKISRLPQPVIENLVEHFGVLSNILKASMADLDRVEGVGPVRARMIQNGLGRIQEQVLIDRQI

SEQ ID NO: 540 - DNA, 1080 bp, Artificial
  Substituion in SEQ ID NO 529
gtgaaggacgacgccaagcgggaagctgccatcaataaaatcttgcgcatggttgcgccagggaccgttctccgagagggaatcgagaacattctgcgcgccaagacgggcgggctcatcgtcgtcggcgcgacggaaaccgtgctctccatgatggacggcggtttcgccatccagtgcgatctgaccccgtcccatctgtacgagctcgcgaagatggacggcgccatcatcatcagtgaggacgcgaagaaggtccactacgccaacacgacgctgaacccggaccacaccatacccacatcggaaaccgggacgcggcatcgcaccgcggagcgcgtggctcgccagagcggccagttggtcatctgcatttcgcagcgccgaaacgtgatcacgctataccaaggcaatttgaaatacgtgctgcgcgacatcagcgtaattttggccaaagccaatcaggcgctgcagacgcttgaaaaatacaagacggtcctggatcaggaactcacggatctcagcgcgctggaatttgaggaggccgtgacgctggaggacgtcacgcgcgttcttcagcggttcgagacggtgctgcgcgtgaccaacgagatccgccgctacatcatcgagctcggcaacgaggggcgattggtcagcatgcagctggaggaactcgtctcggacgtcgacgagcaggcgtacctgctcatcaaggacttcgcccatcccgagtgtcctcacacgccgcatcagatcatgtcgcagatccacaacctctcttccgaggaactgctcgacggggcgctgctggcgcgcattcttgggtatccgccgagcgtcaaccagcttgaggagagcgttccgtcgcgcggttaccggattttgaacaagatcagccggttgccccagcccgtgatcgaaaacctcgtcgagcacttcggcgttctgtccaacattctcaaggcgtcgatggcggacctggataaagtggagggcgtcggcccggtccgcgcccgcatgattcaaaacggactcggacgcattcaggagcaagtgctgattgatcgtcagatttga

SEQ ID NO: 541 - DNA, 1080 bp, Artificial
  Substituion in SEQ ID NO 529
gtgaaggacgacgccaagcgggaagctgccatcaataaaatcttgcgcatggttgcgccagggaccgttctccgagagggaatcgagaacattctgcgcgccaagacgggcgggctcatcgtcgtcggcgcgacggaaaccgtgctctccatgatggacggcggtttcgccatccagtgcgatctgaccccgtcccatctgtacgagctcgcgaagatggacggcgccatcatcatcagtgaggacgcgaagaaggtccactacgccaacacgacgctgaacccggaccacaccatacccacatcggaaaccgggacgcggcatcgcaccgcggagcgcgtggctcgccagagcggccagttggtcatctgcatttcgcagcgccgaaacgtgatcacgctataccaaggcaatttgaaatacgtgctgcgcgacatcagcgtaattttggccaaagccaatcaggcgctgcagacgcttgaaaaatacaagacggtcctggagcaggaactcacggatctcagcgcgctggaatttgaggaggccgtgacgctggaggacgtcacgcgcgttcttcagcggttcgagacggtgctgcgcgtgaccaacgagatccgccgctacatcatcgagctcggcaacgaggggcgattggtcagcatgcagctggaggaactcgtctcggacgtcgacgagcaggcgtacctgctcatcaaggacttcgcccatcccgagtgtcctcacacgccgcatcagatcatgtcgcagatccacaacctctcttccgaggaactgctcgacggggcgctgctggcgcgcattcttgggtatccgccgagcgtcaaccagcttgaggagagcgttccgtcgcgcggttaccggattttgaacaagatcagccggttgccccagcccgtgatcgaaaacctcgtcgagcacttcggcgttctgtccaacattctcaaggcgtcgatggcggacctggataaagtggagggcgtcggcccggtccgcgcccgcatgattcaaaacggactcggacgcattcaggagcaagtgctgattgatcgtaatatttga

SEQ ID NO: 542 - DNA, 1080 bp, Artificial
  Substituion in SEQ ID NO 529
gtgaaggacgacgccaagcgggaagctgccatcaataaaatcttgcgcatgattgcgccagggaccgttctccgagagggaatcgagaacattctgcgcgccaagacgggcgggctcatcgtcgtcggcgcgacggaaaccgtgctctccatgatggacggcggtttcgccatccagtgcgatctgaccccgtcccatctgtacgagctcgcgaagatggacggcgccatcatcatcagtgaggacgcgaagaaggtccactacgccaacacgacgctgaacccggaccacaccatacccacatcggaaaccgggacgcggcatcgcaccgcggagcgcgtggctcgccagagcggccagttggtcatctgcatttcgcagcgccgaaacgtgatcacgctataccaaggcaatttgaaatacgtgctgcgcgacatcagcgtaattttggccaaagccaatcaggcgctgcagacgcttgaaaaatacaagacggtcctggagcaggaactcacggatctcagcgcgctggaatttgaggaggccgtgacgctggaggacgtcacgcgcgttcttcagcggttcgagacggtgctgcgcgtgaccaacgagatccgccgctacatcatcgagctcggcaacgaggggcgattggtcagcatgcagctggaggaactcgtctcggacgtcgacgagcaggcgtacctgctcatcaaggacttcgcccatcccgagtgtcctcacacgccgcatcagatcatgtcgcagatccacaacctctcttccgaggaactgctcgacggggcgctgctggcgcgcattcttgggtatccgccgagcgtcaaccagcttgaggagagcgttccgtcgcgcggttaccggattttgaacaagatcagccggttgccccagcccgtgatcgaaaacctcgtcgagcacttcggcgttctgtccaacattctcaaggcgtcgatggcggacctggataaagtggagggcgtcggcccggtccgcgcccgcatgattcaaaacggactcggacgcattcaggagcaagtgctgattgatcgtcagatttga

SEQ ID NO: 543 - DNA, 1080 bp, Artificial
  Substituion in SEQ ID NO 529
gtgaaggacgacgccaagcgggaagctgccatcaataaaatcttgcgcatggttgcgccagggaccgttctccgagagggaatcgagaacattctgcgcgccaagacgggcgggctcatcgtcgtcggcgcgacggaaaccgtgctctccatgatggacggcggtttcgccatccagtgcgatctgaccccgtcccatctgtacgagctcgcgaagatggacggcgccatcatcatcagtgaggacgcgaagaaggtccactacgccaacacgacgctgaacccggaccacaccatacccacatcggaaaccgggacgcggcatcgcaccgcggagcgcgtggctcgccagagcggccagttggtcatctgcatttcgcagcgccgaaacgtgatcacgctataccaaggcaatttgaaatacgtgctgcgcgacatcagcgtaattttggccaaagccaatcaggcgctgcagacgcttgaaaaatacaagacggtcctggagcaggaactcacggatctcagcgcgctggaatttgaggaggccgtgacgctggaggacgtcacgcgcgttcttcagcggttcgagacggtgctgcgcattaccaacgagatccgccgctacatcatcgagctcggcaacgaggggcgattggtcagcatgcagctggaggaactcgtctcggacgtcgacgagcaggcgtacctgctcatcaaggacttcgcccatcccgagtgtcctcacacgccgcatcagatcatgtcgcagatccacaacctctcttccgaggaactgctcgacggggcgctgctggcgcgcattcttgggtatccgccgagcgtcaaccagcttgaggagagcgttccgtcgcgcggttaccggattttgaacaagatcagccggttgccccagcccgtgatcgaaaacctcgtcgagcacttcggcgttctgtccaacattctcaaggcgtcgatggcggacctggataaagtggagggcgtcggcccggtccgcgcccgcatgattcaaaacggactcggacgcattcaggagcaagtgctgattgatcgtcagatttga

SEQ ID NO: 544 - DNA, 1080 bp, Artificial
  Substituion in SEQ ID NO 529
gtgaaggacgacgccaagcgggaagctgccatcaataaaatcttgcgcatggttgcgccagggaccgttctccgagagggaatcgagaacattctgcgcgccaagacgggcgggctcatcgtcgtcggcgcgacggaaaccgtgctctccatgatggacggcggtttcgccatccagtgcgatctgaccccgtcccatctgtacgagctcgcgaagatggacggcgccatcatcatcagtgaggacgcgaagaaggtccactacgccaacacgacgctgaacccggaccacaccatacccacatcggaaaccgggacgcggcatcgcaccgcggagcgcgtggctcgccagagcggccagttggtcatctgcatttcgcagcgccgaaacgtgatcacgctataccaaggcaatttgaaatacgtgctgcgcgacatcagcgtaattttggccaaagccaatcaggcgctgcagacgcttgaaaaatacaagacggtcctggagcaggaactcacggatctcagcgcgctggaatttgaggaggccgtgacgctggaggacgtcacgcgcgttcttcagcggttcgagacggtgctgcgcgtgaccaacgagatccgccgctacatcatcgagctcggcaacgaggggcgattggtcagcatgcagctggaggaactcgtctcggacgtcgacgagcaggcgtacctgctcatcaaggacttcgcccatcccgagtgtcctcacacgccgcatcagatcatgtcgcagatccacaacctctcttccgaggaactgctcgacggggcgctgctggcgcgcattcttgggtatccgccgagcgtcaaccagcttgaggagagcgttccgtcgcgcggttaccggattttgaacaagatcagccggttgccccagcccgtgatcgaaaacctcgtcgagcacttcggcgttctgtccaacattctcaaggcgtcgatggcggacctggatcgtgtggagggcgtcggcccggtccgcgcccgcatgattcaaaacggactcggacgcattcaggagcaagtgctgattgatcgtcagatttga

SEQ ID NO: 545 - protein, 156 aa, Alicyclobacillus acidocaldarius
MASNISDIIEAYLKRLMEESGLDVIEIQRNELAEQFHCVPSQINYVISTRFTTDHGYIVESKRGGGGYIRIRRVKLDKDHLLWDVLRSLGDEVSQSASEALIERLHRDGWLTDREAALISAMLRREVLALGLPYRDRLRAKLLASALQALAAHRKP

SEQ ID NO: 546 - DNA, 471 bp, Alicyclobacillus acidocaldarius
atggcaagcaacatctcggacatcatcgaggcgtatctgaaacgactcatggaggaaagcgggctcgacgtgatcgagattcagcgcaatgagctcgcggagcagtttcactgcgtcccgtctcagatcaactacgtcatcagcacgcgcttcacgacggatcacgggtacatcgtcgagtcgaagcgcggcggcggcggttacatccgcatccggcgcgtcaaactcgacaaggatcacctgctgtgggacgtgctgagatcgctcggggacgaggtgagccagtccgccagcgaggcgctgatcgaacgcctgcaccgggacgggtggctgacggatcgcgaagccgcgttgatttccgccatgttgcggcgggaagtgcttgcgctgggccttccataccgagaccggctgcgggcgaagttgctggcgagtgcgctgcaggcgttggcggcgcaccgaaaaccttga

SEQ ID NO: 547 - protein, 132 aa, Bacillus selenitireducens MLS10
NISDVIEGYLKQIIEKNDQELIEVKRSELAEQFDCVPSQINYVIRTRFTVEKGYMVQSKRGGGGYIRITRVTPDNHLQLYDQLIDLSGDEISQTAAMHLIGRLLEEEAITKREANLMESVMNREVLSIRLPY

SEQ ID NO: 548 - protein, 134 aa, Bacillus licheniformis ATCC 14580
MGKNISDIIEQYLKQILEQNGKEILEIKRSEIADKFQCVPSQINYVINTRFTSERGYIVESKRGGGGYIRIIKIKMNDKIDLINNIMNQIYTRLSQAASDDIILRLLENGVITESEAKLMVSVMDRSVLYIDLP

SEQ ID NO: 549 - protein, 134 aa, Bacillus pumilus SAFR-032
MAQNISDIIEQYLKEVLDQNGREILEIKRNEIADKFQCVPSQINYVINTRFTSERGYIVESKRGGGGYIRIIKVKMNDEVDLLNNIISQIYHRLSQAASDHIIMRLVENNILSEREAKMMISVMDRSVLHIDLP

SEQ ID NO: 550 - protein, 131 aa, Paenibacillus larvae subsp. larvae BRL-230010
NVSEIIEHYLKHILQQSPNGAIEIQRNELADQFQCVPSQINYVISTRFTLEKGYLVESKRGGGGYVRIQKIELNSHGSILDYILTTINQSIDQSTSEGLIYRLEEGEFLTAREAKLIRAAISRDVLQFKLP

SEQ ID NO: 551 - protein, 134 aa, Bacillus amyloliquefaciens FZB42
MGHNISDIIEQYLKQVLDQNGKEILEIKRSEIADKFQCVPSQINYVINTRFTSERGYIVESKRGGGGYIRIIKIKMNNEVVLINNIISQIHTHLSQAASDDIILRLLEDGVISEREAKMMVSVMDRSVLYIDLP

SEQ ID NO: 552 - protein, 156 aa, Artificial
  Substituion in SEQ ID NO 545
MASNISDIIEAYLKRLMEESGLDVIEIQRNELAEQFHCVPSQINYVISTRFTTDHGYIVESKRGGGGYIRIRRVKLDKDHLLWDVLRSLGDEVSQSASEALIERLHRDGWLTDKEAALISAMLRREVLALGLPYRDRLRAKLLASALQALAAHRKP

SEQ ID NO: 553 - protein, 156 aa, Artificial
  Substituion in SEQ ID NO 545
MASNISDIIEAYLKRLMEESGLDVIEIQRNELAEQFHCVPSQINYVISTRFTTDHGYIVESKRGGGGYIRIRRVKLDKDHLLWDVLRSLGDEVSQSASEALIERLHRDGWLTDREAALISAMLRREVLALGLPYRDRLRAKLLASALQALAAHRRP

SEQ ID NO: 554 - protein, 156 aa, Artificial
  Substituion in SEQ ID NO 545
MASNISDIIEAYLKRLMEESGLDVIEIQRNELAEQFHCVPSQINYVISTRFTTDHGYIVESKRGGGGYIRIRRVKLDKDHLLWDVLRSLGDEVSQSASEALIERLHRDGWLTDREAALISAMLRREVLALGLPYRDKLRAKLLASALQALAAHRKP

SEQ ID NO: 555 - protein, 156 aa, Artificial
  Substituion in SEQ ID NO 545
MASNISDIIEAYLKRLMEESGLDVIEIQRNELAEQFHCVPSQINYVISTRFTTDHGYIVESKRGGGGYIRIRRVKLDKDHLLWDVLRSLGDEVSQSASEALIERLHRDGWLTDREAALISAMLRREVLALGLPYRERLRAKLLASALQALAAHRKP

SEQ ID NO: 556 - protein, 156 aa, Artificial
  Substituion in SEQ ID NO 545
MASNISDIIEAYLKRLMEESGLDVIEIQRNELAEQFHCVPSQINYVISTRFTTDHGYIVESKRGGGGYIRIRRVKLDKDHLLWDVLRSLGDEVSQSASEALIERLHRDGWLTDREAALISAMLRREVLALGLPYRDRLRAKLLASALNALAAHRKP

SEQ ID NO: 557 - DNA, 471 bp, Artificial
  Substituion in SEQ ID NO 546
atggcaagcaacatctcggacatcatcgaggcgtatctgaaacgactcatggaggaaagcgggctcgacgtgatcgagattcagcgcaatgagctcgcggagcagtttcactgcgtcccgtctcagatcaactacgtcatcagcacgcgcttcacgacggatcacgggtacatcgtcgagtcgaagcgcggcggcggcggttacatccgcatccggcgcgtcaaactcgacaaggatcacctgctgtgggacgtgctgagatcgctcggggacgaggtgagccagtccgccagcgaggcgctgatcgaacgcctgcaccgggacgggtggctgacggataaagaagccgcgttgatttccgccatgttgcggcgggaagtgcttgcgctgggccttccataccgagaccggctgcgggcgaagttgctggcgagtgcgctgcaggcgttggcggcgcaccgaaaaccttga

SEQ ID NO: 558 - DNA, 471 bp, Artificial
  Substituion in SEQ ID NO 546
atggcaagcaacatctcggacatcatcgaggcgtatctgaaacgactcatggaggaaagcgggctcgacgtgatcgagattcagcgcaatgagctcgcggagcagtttcactgcgtcccgtctcagatcaactacgtcatcagcacgcgcttcacgacggatcacgggtacatcgtcgagtcgaagcgcggcggcggcggttacatccgcatccggcgcgtcaaactcgacaaggatcacctgctgtgggacgtgctgagatcgctcggggacgaggtgagccagtccgccagcgaggcgctgatcgaacgcctgcaccgggacgggtggctgacggatcgcgaagccgcgttgatttccgccatgttgcggcgggaagtgcttgcgctgggccttccataccgagaccggctgcgggcgaagttgctggcgagtgcgctgcaggcgttggcggcgcaccgacgtccttga

SEQ ID NO: 559 - DNA, 471 bp, Artificial
  Substituion in SEQ ID NO 546
atggcaagcaacatctcggacatcatcgaggcgtatctgaaacgactcatggaggaaagcgggctcgacgtgatcgagattcagcgcaatgagctcgcggagcagtttcactgcgtcccgtctcagatcaactacgtcatcagcacgcgcttcacgacggatcacgggtacatcgtcgagtcgaagcgcggcggcggcggttacatccgcatccggcgcgtcaaactcgacaaggatcacctgctgtgggacgtgctgagatcgctcggggacgaggtgagccagtccgccagcgaggcgctgatcgaacgcctgcaccgggacgggtggctgacggatcgcgaagccgcgttgatttccgccatgttgcggcgggaagtgcttgcgctgggccttccataccgagacaaactgcgggcgaagttgctggcgagtgcgctgcaggcgttggcggcgcaccgaaaaccttga

SEQ ID NO: 560 - DNA, 471 bp, Artificial
  Substituion in SEQ ID NO 546
atggcaagcaacatctcggacatcatcgaggcgtatctgaaacgactcatggaggaaagcgggctcgacgtgatcgagattcagcgcaatgagctcgcggagcagtttcactgcgtcccgtctcagatcaactacgtcatcagcacgcgcttcacgacggatcacgggtacatcgtcgagtcgaagcgcggcggcggcggttacatccgcatccggcgcgtcaaactcgacaaggatcacctgctgtgggacgtgctgagatcgctcggggacgaggtgagccagtccgccagcgaggcgctgatcgaacgcctgcaccgggacgggtggctgacggatcgcgaagccgcgttgatttccgccatgttgcggcgggaagtgcttgcgctgggccttccataccgagaacggctgcgggcgaagttgctggcgagtgcgctgcaggcgttggcggcgcaccgaaaaccttga

SEQ ID NO: 561 - DNA, 471 bp, Artificial
  Substituion in SEQ ID NO 546
atggcaagcaacatctcggacatcatcgaggcgtatctgaaacgactcatggaggaaagcgggctcgacgtgatcgagattcagcgcaatgagctcgcggagcagtttcactgcgtcccgtctcagatcaactacgtcatcagcacgcgcttcacgacggatcacgggtacatcgtcgagtcgaagcgcggcggcggcggttacatccgcatccggcgcgtcaaactcgacaaggatcacctgctgtgggacgtgctgagatcgctcggggacgaggtgagccagtccgccagcgaggcgctgatcgaacgcctgcaccgggacgggtggctgacggatcgcgaagccgcgttgatttccgccatgttgcggcgggaagtgcttgcgctgggccttccataccgagaccggctgcgggcgaagttgctggcgagtgcgctgaatgcgttggcggcgcaccgaaaaccttga

SEQ ID NO: 562 - protein, 445 aa, Alicyclobacillus acidocaldarius
MPPGHECEGRCLDIRELEEKKLTELYKYAREFQIPHYGSMKKKELIFAILKAQAERDGLMFAEGVLEIMPEGYGFLRPVGYLPSQEDIYVAASQIRRFDLRTGDLVSGKVRPPKENERYFGLLHVEAVNGYSPEVAAERLHFAALTPLFPSKRIVLETTPENLATRLIDLFAPIGFGQRGMIVAPPKAGKTVLLKEIAHSIATNYPDVHLFVLLIDERPEEVTDMQRSVKGEVIASTFDEVPENHIKVSELVLERALRLVEHKQDVVILLDSLTRLTRAYNLVVPPSGRTLSGGIDPAAFHRPKRFFGAARNVEEGGSLTILATALIDTGSRMDDVIYEEFKGTGNMELHLDRRLAEKRVFPSIDIRRSGTRREEALMPKEELEKVWAIRKSMGDNQDFTEMFLRKFRHYKTNKEFLDSLSLNRVERKPVASAEKPAAQPVTSET

SEQ ID NO: 563 - DNA, 1338 bp, Alicyclobacillus acidocaldarius
gtgccgccgggacacgaatgtgagggacgatgcttggacattcgagaacttgaagaaaagaaattaacagagctatacaaatatgcccgagaatttcagatcccgcactacggatcgatgaaaaagaaagagctgatttttgccattctcaaagcccaggccgagcgggacggcctgatgttcgccgaaggcgtgctcgaaatcatgccggaagggtacggatttctccggcccgtggggtatctgccgagtcaggaggacatctacgtcgcggcatcccagattcggcgcttcgatctccgtacgggcgatctcgtcagcggaaaagtccgaccgcccaaggagaacgagcggtacttcggccttttgcacgtggaggcggtcaacggttacagtcccgaggtagctgccgaacggcttcatttcgcagcgctcactccgctctttccttccaaacgcatcgtgctcgagaccacacctgaaaacttggccacgcgcctcatcgacctgttcgcgcccatcggcttcgggcagcgcggcatgattgtggcgcctccgaaagcgggcaagacggtgctcttgaaggagattgcccacagcattgccacaaattatcccgatgtgcacctgtttgtcctgctcatcgacgagcgccccgaagaggtgaccgacatgcagcgctcggtcaagggagaggtgattgcgtccacgtttgacgaggtgcccgagaatcacatcaaggtatccgagctggtgctggaacgggcgctgcgcctcgttgagcacaagcaggacgtggtcatcctcctggacagcctgacgcggctcacgcgcgcctacaacctcgtcgttcccccgtccgggcgcacactctcgggtggtatcgatccggctgcatttcaccgcccgaagcggttcttcggagcggcgcgcaacgtcgaagagggcggaagcctgaccatcctcgccacggcgctcatcgacacgggttcgcgcatggacgacgtgatctacgaggagttcaagggcacgggcaacatggaactgcatctcgaccgcaggctcgccgagaagcgcgtgttcccctcgattgacatccgccgttccgggacgcgccgagaggaagcgctcatgcccaaggaagagctcgaaaaggtgtgggcgattcgcaaatccatgggcgacaatcaggacttcaccgagatgttcctgcgcaagttccgccattataagaccaacaaggagttcctcgacagcctgagtctcaaccgggtcgagcggaagcctgttgcgagtgcggagaagccagccgcgcagcctgtcacgagcgaaacctga

SEQ ID NO: 564 - protein, 389 aa, Geobacillus kaustophilus HTA426
AKQYKISYYSKLTKKELIFAILKARAEQDGLFFMEGILEIIPSEGFGFLRPINYSPSSEDIYISASQIRRFDLRNGDKVSGKVRPPKENERYFGLLHVEAVNGEDPEVAKERVHFPALTPLYPNRQMKLETTPDKLSTRIIDLIAPVGFGQRGLIVAPPKAGKTMLLKEIANSITTNHPDVELIVLLIDERPEEVTDIERSVQGDVVSSTFDEVPENHIKVAELVLERAMRLVEHKRDVVILMDSITRLARAYNLVIPPSGRTLSGGIDPAAFHRPKRFFGAARNIEEGGSLTILATALIDTGSRMDDVIYEEFKGTGNMELHLDRSLAERRIFPAIDIRRSGTRKEELLIPKEHLEKLWAIRKTMADSPDFIERFLNKLRRTKSNEEF

SEQ ID NO: 565 - protein, 389 aa, Geobacillus thermodenitrificans NG80-2
ARQYKISYYSKLTKKELIFAILKARAEQDGLFFMEGVLEIIPSEGFGFLRPINYSPSSEDIYISASQIRRFDLRNGDKVSGKVRKPKENERYFGLLHVEAVNGEDPEIAKERVHFPALTPLYPNRQMKLETTPDKLSTRIIDLIAPVGFGQRGLIVAPPKAGKTMLLKEIANSITANHPDVELIVLLIDERPEEVTDIERSVQGDVVSSTFDEVPENHIKVAELVLERAMRLVEHKRDVVILMDSITRLARAYNLVIPPSGRTLSGGIDPAAFHRPKRFFGAARNIEEGGSLTILATALVDTGSRMDDVIYEEFKGTGNMELHLDRSLAERRIFPAIDIRRSGTRKEELLIPKEHLDKLWAIRKTMADSPDFIERFLNKLRRTKSNEEF

SEQ ID NO: 566 - protein, 393 aa, Bacillus cereus subsp. cytotoxis NVH 391-98
AKEYKISYYSKLTKKELIFAILKARAEKEGFFFMEGVLEIIQSEGFGFLRPINYSPSSEDIYISASQIRRFDLRNGDKVSGKVRPPKENERYFGLLQVEAVNGDDPESAKERVHFPALTPLYPNRQMKLETEPKKLSTRIMDLIAPVGFGQRGLIVAPPKAGKTILLKEIAHSITTNHPEAELIVLLIDERPEEVTDIERSVKGDVVSSTFDEVPENHIKVAELVLERAMRLVEHKKDVVILMDSITRLARAYNLVIPPSGRTLSGGIDPAAFHRPKRFFGAARNIEEGGSLTILATALVDTGSRMDDVIYEEFKGTGNMELHLDRSLAERRIFPAIDIRRSGTRKEDLLIPKEHLDKLWGIRKTMRDTPDFVESFLRKLRQTKTNEEFLQNI

SEQ ID NO: 567 - protein, 394 aa, Bacillus megaterium
AREYKVSYYSKLTKKELVFAILKAQAEQDGLLFMEGVLEIIQSEGFGFLRPINYSPSSEDIYISASQIRRFDLRNGDKVSGKVRPPKENERYYGLLHVEAVNGEDPETSKDRVHFPALTPIYPNEQMLLETQPRSFSTRIIDLISPIGFGQRGLIVAPPKAGKTMLLKEIANSITTNHPDAELIVLLIDERPEEVTDIERSVDGDVVSSTFDEVPENHIKVAELVLERAMRLVEHKKDVVILMDSITRLARAYNLVIPPSGRTLSGGIDPAAFHRPKRFFGAARNIEDGGSLTILATALIDTGSRMDDVIYEEFKGTGNMELHLDRSLAEKRIFPAIDIRRSGTRKEELLIPKEHLDHLWAIRKSMADAPDFAEKFLKRLRQTKTNEEFFSMLT

SEQ ID NO: 568 - protein, 393 aa, Bacillus thuringiensis serovar konkukian str. 97-27
AKEFKISYYSKLTKKELIFAILKARAEKEGFFFMEGVLEIIQSEGFGFLRPINYSPSSEDIYISASQIRRFDLRNGDKVSGKVRPPKENERYFGLLQVEAVNGDDPESAKERVHFPALTPLYPDRQMKLETEPKKLPTRIMDLIAPVGFGQRGLIVAPPKAGKTSLLKEIAHSVTTNHPEAELIVLLIDERPEEVTDIERSVKGDVVSSTFDEVPENHIKVAELVLERAMRLVEHKKDVIILMDSITRLARAYNLVIPPSGRTLSGGIDPAAFHRPKRFFGAARNIEEGGSLTILATALVDTGSRMDDVIYEEFKGTGNMELHLDRSLAERRIFPAIDIRRSGTRKEDLLIPKEHLDKLWGIRKTMRDTPDFVESFLRKLRQTKTNEEFLQNI

SEQ ID NO: 569 - protein, 445 aa, Artificial
  Substituion in SEQ ID NO 562
MPPGHECEGRCLDIRELEEKKLTELYKYAREFQIPHYGSMKKKELIFAILKAQAERDGLMFAEGVLEIMPEGYGFLRPVGYLPSQEDIYVAASQIRRFDLRTGDLVSGKVRPPKENERYFGLLHVEAVNGYSPEVAAERLHFAALTPLFPSKRIVLETTPENLATRLIDLFAPIGFGQRGMIVAPPKAGKTILLKEIAHSIATNYPDVHLFVLLIDERPEEVTDMQRSVKGEVIASTFDEVPENHIKVSELVLERALRLVEHKQDVVILLDSLTRLTRAYNLVVPPSGRTLSGGIDPAAFHRPKRFFGAARNVEEGGSLTILATALIDTGSRMDDVIYEEFKGTGNMELHLDRRLAEKRVFPSIDIRRSGTRREEALMPKEELEKVWAIRKSMGDNQDFTEMFLRKFRHYKTNKEFLDSLSLNRVERKPVASAEKPAAQPVTSET

SEQ ID NO: 570 - protein, 445 aa, Artificial
  Substituion in SEQ ID NO 562
MPPGHECEGRCLDIRELEEKKLTELYKYAREFQIPHYGSMKKKELIFAILKAQAERDGLMFAEGVLEIMPEGYGFLRPVGYLPSQEDIYVAASQIRRFDLRTGDLVSGKVRPPKENERYFGLLHVEAVNGYSPEVAAERLHFAALTPLFPSKRIVLETTPENLATRLIDLFAPLGFGQRGMIVAPPKAGKTVLLKEIAHSIATNYPDVHLFVLLIDERPEEVTDMQRSVKGEVIASTFDEVPENHIKVSELVLERALRLVEHKQDVVILLDSLTRLTRAYNLVVPPSGRTLSGGIDPAAFHRPKRFFGAARNVEEGGSLTILATALIDTGSRMDDVIYEEFKGTGNMELHLDRRLAEKRVFPSIDIRRSGTRREEALMPKEELEKVWAIRKSMGDNQDFTEMFLRKFRHYKTNKEFLDSLSLNRVERKPVASAEKPAAQPVTSET

SEQ ID NO: 571 - protein, 445 aa, Artificial
  Substituion in SEQ ID NO 562
MPPGHECEGRCLDIRELEEKKLTELYKYAREFQIPHYGSMKKKELIFAILKAQAERDGLMFAEGVLEIMPEGYGFLRPVGYLPSQEDIYVAASQIRRFDLRTGDLVSGKVRPPKENERYFGLLHVEAVNGYSPEVAAERLHFAALTPLFPSKRIVLETTPENLATRLIDLFAPIGFGQRGMIVAPPKAGKTVLLKEIAHSIATNYPDVHLFVLLIDERPEEVTDMQRSVKGEVIASTFDEVPENHIKVSELVLERALRLVEHKQDVVILLDSLTRLTRAYNLVVPPSGRTLSGGIDPAAFHRPKRFFGAARNVEEGGSLTILATALIDTGSRMDDVIYEEFKGTGNMELHLDRRLAEKRVFPSIDIRRSGTRREEALMPKEELEKVWAIRKSMGDQQDFTEMFLRKFRHYKTNKEFLDSLSLNRVERKPVASAEKPAAQPVTSET

SEQ ID NO: 572 - protein, 445 aa, Artificial
  Substituion in SEQ ID NO 562
MPPGHECEGRCLDIRDLEEKKLTELYKYAREFQIPHYGSMKKKELIFAILKAQAERDGLMFAEGVLEIMPEGYGFLRPVGYLPSQEDIYVAASQIRRFDLRTGDLVSGKVRPPKENERYFGLLHVEAVNGYSPEVAAERLHFAALTPLFPSKRIVLETTPENLATRLIDLFAPIGFGQRGMIVAPPKAGKTVLLKEIAHSIATNYPDVHLFVLLIDERPEEVTDMQRSVKGEVIASTFDEVPENHIKVSELVLERALRLVEHKQDVVILLDSLTRLTRAYNLVVPPSGRTLSGGIDPAAFHRPKRFFGAARNVEEGGSLTILATALIDTGSRMDDVIYEEFKGTGNMELHLDRRLAEKRVFPSIDIRRSGTRREEALMPKEELEKVWAIRKSMGDNQDFTEMFLRKFRHYKTNKEFLDSLSLNRVERKPVASAEKPAAQPVTSET

SEQ ID NO: 573 - protein, 445 aa, Artificial
  Substituion in SEQ ID NO 562
MPPGHECEGRCLDIRELEEKKLTELYRYAREFQIPHYGSMKKKELIFAILKAQAERDGLMFAEGVLEIMPEGYGFLRPVGYLPSQEDIYVAASQIRRFDLRTGDLVSGKVRPPKENERYFGLLHVEAVNGYSPEVAAERLHFAALTPLFPSKRIVLETTPENLATRLIDLFAPIGFGQRGMIVAPPKAGKTVLLKEIAHSIATNYPDVHLFVLLIDERPEEVTDMQRSVKGEVIASTFDEVPENHIKVSELVLERALRLVEHKQDVVILLDSLTRLTRAYNLVVPPSGRTLSGGIDPAAFHRPKRFFGAARNVEEGGSLTILATALIDTGSRMDDVIYEEFKGTGNMELHLDRRLAEKRVFPSIDIRRSGTRREEALMPKEELEKVWAIRKSMGDNQDFTEMFLRKFRHYKTNKEFLDSLSLNRVERKPVASAEKPAAQPVTSET

SEQ ID NO: 574 - DNA, 1338 bp, Artificial
  Substituion in SEQ ID NO 563
gtgccgccgggacacgaatgtgagggacgatgcttggacattcgagaacttgaagaaaagaaattaacagagctatacaaatatgcccgagaatttcagatcccgcactacggatcgatgaaaaagaaagagctgatttttgccattctcaaagcccaggccgagcgggacggcctgatgttcgccgaaggcgtgctcgaaatcatgccggaagggtacggatttctccggcccgtggggtatctgccgagtcaggaggacatctacgtcgcggcatcccagattcggcgcttcgatctccgtacgggcgatctcgtcagcggaaaagtccgaccgcccaaggagaacgagcggtacttcggccttttgcacgtggaggcggtcaacggttacagtcccgaggtagctgccgaacggcttcatttcgcagcgctcactccgctctttccttccaaacgcatcgtgctcgagaccacacctgaaaacttggccacgcgcctcatcgacctgttcgcgcccatcggcttcgggcagcgcggcatgattgtggcgcctccgaaagcgggcaagacgattctcttgaaggagattgcccacagcattgccacaaattatcccgatgtgcacctgtttgtcctgctcatcgacgagcgccccgaagaggtgaccgacatgcagcgctcggtcaagggagaggtgattgcgtccacgtttgacgaggtgcccgagaatcacatcaaggtatccgagctggtgctggaacgggcgctgcgcctcgttgagcacaagcaggacgtggtcatcctcctggacagcctgacgcggctcacgcgcgcctacaacctcgtcgttcccccgtccgggcgcacactctcgggtggtatcgatccggctgcatttcaccgcccgaagcggttcttcggagcggcgcgcaacgtcgaagagggcggaagcctgaccatcctcgccacggcgctcatcgacacgggttcgcgcatggacgacgtgatctacgaggagttcaagggcacgggcaacatggaactgcatctcgaccgcaggctcgccgagaagcgcgtgttcccctcgattgacatccgccgttccgggacgcgccgagaggaagcgctcatgcccaaggaagagctcgaaaaggtgtgggcgattcgcaaatccatgggcgacaatcaggacttcaccgagatgttcctgcgcaagttccgccattataagaccaacaaggagttcctcgacagcctgagtctcaaccgggtcgagcggaagcctgttgcgagtgcggagaagccagccgcgcagcctgtcacgagcgaaacctga

SEQ ID NO: 575 - DNA, 1338 bp, Artificial
  Substituion in SEQ ID NO 563
gtgccgccgggacacgaatgtgagggacgatgcttggacattcgagaacttgaagaaaagaaattaacagagctatacaaatatgcccgagaatttcagatcccgcactacggatcgatgaaaaagaaagagctgatttttgccattctcaaagcccaggccgagcgggacggcctgatgttcgccgaaggcgtgctcgaaatcatgccggaagggtacggatttctccggcccgtggggtatctgccgagtcaggaggacatctacgtcgcggcatcccagattcggcgcttcgatctccgtacgggcgatctcgtcagcggaaaagtccgaccgcccaaggagaacgagcggtacttcggccttttgcacgtggaggcggtcaacggttacagtcccgaggtagctgccgaacggcttcatttcgcagcgctcactccgctctttccttccaaacgcatcgtgctcgagaccacacctgaaaacttggccacgcgcctcatcgacctgttcgcgcccttaggcttcgggcagcgcggcatgattgtggcgcctccgaaagcgggcaagacggtgctcttgaaggagattgcccacagcattgccacaaattatcccgatgtgcacctgtttgtcctgctcatcgacgagcgccccgaagaggtgaccgacatgcagcgctcggtcaagggagaggtgattgcgtccacgtttgacgaggtgcccgagaatcacatcaaggtatccgagctggtgctggaacgggcgctgcgcctcgttgagcacaagcaggacgtggtcatcctcctggacagcctgacgcggctcacgcgcgcctacaacctcgtcgttcccccgtccgggcgcacactctcgggtggtatcgatccggctgcatttcaccgcccgaagcggttcttcggagcggcgcgcaacgtcgaagagggcggaagcctgaccatcctcgccacggcgctcatcgacacgggttcgcgcatggacgacgtgatctacgaggagttcaagggcacgggcaacatggaactgcatctcgaccgcaggctcgccgagaagcgcgtgttcccctcgattgacatccgccgttccgggacgcgccgagaggaagcgctcatgcccaaggaagagctcgaaaaggtgtgggcgattcgcaaatccatgggcgacaatcaggacttcaccgagatgttcctgcgcaagttccgccattataagaccaacaaggagttcctcgacagcctgagtctcaaccgggtcgagcggaagcctgttgcgagtgcggagaagccagccgcgcagcctgtcacgagcgaaacctga

SEQ ID NO: 576 - DNA, 1338 bp, Artificial
  Substituion in SEQ ID NO 563
gtgccgccgggacacgaatgtgagggacgatgcttggacattcgagaacttgaagaaaagaaattaacagagctatacaaatatgcccgagaatttcagatcccgcactacggatcgatgaaaaagaaagagctgatttttgccattctcaaagcccaggccgagcgggacggcctgatgttcgccgaaggcgtgctcgaaatcatgccggaagggtacggatttctccggcccgtggggtatctgccgagtcaggaggacatctacgtcgcggcatcccagattcggcgcttcgatctccgtacgggcgatctcgtcagcggaaaagtccgaccgcccaaggagaacgagcggtacttcggccttttgcacgtggaggcggtcaacggttacagtcccgaggtagctgccgaacggcttcatttcgcagcgctcactccgctctttccttccaaacgcatcgtgctcgagaccacacctgaaaacttggccacgcgcctcatcgacctgttcgcgcccatcggcttcgggcagcgcggcatgattgtggcgcctccgaaagcgggcaagacggtgctcttgaaggagattgcccacagcattgccacaaattatcccgatgtgcacctgtttgtcctgctcatcgacgagcgccccgaagaggtgaccgacatgcagcgctcggtcaagggagaggtgattgcgtccacgtttgacgaggtgcccgagaatcacatcaaggtatccgagctggtgctggaacgggcgctgcgcctcgttgagcacaagcaggacgtggtcatcctcctggacagcctgacgcggctcacgcgcgcctacaacctcgtcgttcccccgtccgggcgcacactctcgggtggtatcgatccggctgcatttcaccgcccgaagcggttcttcggagcggcgcgcaacgtcgaagagggcggaagcctgaccatcctcgccacggcgctcatcgacacgggttcgcgcatggacgacgtgatctacgaggagttcaagggcacgggcaacatggaactgcatctcgaccgcaggctcgccgagaagcgcgtgttcccctcgattgacatccgccgttccgggacgcgccgagaggaagcgctcatgcccaaggaagagctcgaaaaggtgtgggcgattcgcaaatccatgggcgaccaacaggacttcaccgagatgttcctgcgcaagttccgccattataagaccaacaaggagttcctcgacagcctgagtctcaaccgggtcgagcggaagcctgttgcgagtgcggagaagccagccgcgcagcctgtcacgagcgaaacctga

SEQ ID NO: 577 - DNA, 1338 bp, Artificial
  Substituion in SEQ ID NO 563
gtgccgccgggacacgaatgtgagggacgatgcttggacattcgagatcttgaagaaaagaaattaacagagctatacaaatatgcccgagaatttcagatcccgcactacggatcgatgaaaaagaaagagctgatttttgccattctcaaagcccaggccgagcgggacggcctgatgttcgccgaaggcgtgctcgaaatcatgccggaagggtacggatttctccggcccgtggggtatctgccgagtcaggaggacatctacgtcgcggcatcccagattcggcgcttcgatctccgtacgggcgatctcgtcagcggaaaagtccgaccgcccaaggagaacgagcggtacttcggccttttgcacgtggaggcggtcaacggttacagtcccgaggtagctgccgaacggcttcatttcgcagcgctcactccgctctttccttccaaacgcatcgtgctcgagaccacacctgaaaacttggccacgcgcctcatcgacctgttcgcgcccatcggcttcgggcagcgcggcatgattgtggcgcctccgaaagcgggcaagacggtgctcttgaaggagattgcccacagcattgccacaaattatcccgatgtgcacctgtttgtcctgctcatcgacgagcgccccgaagaggtgaccgacatgcagcgctcggtcaagggagaggtgattgcgtccacgtttgacgaggtgcccgagaatcacatcaaggtatccgagctggtgctggaacgggcgctgcgcctcgttgagcacaagcaggacgtggtcatcctcctggacagcctgacgcggctcacgcgcgcctacaacctcgtcgttcccccgtccgggcgcacactctcgggtggtatcgatccggctgcatttcaccgcccgaagcggttcttcggagcggcgcgcaacgtcgaagagggcggaagcctgaccatcctcgccacggcgctcatcgacacgggttcgcgcatggacgacgtgatctacgaggagttcaagggcacgggcaacatggaactgcatctcgaccgcaggctcgccgagaagcgcgtgttcccctcgattgacatccgccgttccgggacgcgccgagaggaagcgctcatgcccaaggaagagctcgaaaaggtgtgggcgattcgcaaatccatgggcgacaatcaggacttcaccgagatgttcctgcgcaagttccgccattataagaccaacaaggagttcctcgacagcctgagtctcaaccgggtcgagcggaagcctgttgcgagtgcggagaagccagccgcgcagcctgtcacgagcgaaacctga

SEQ ID NO: 578 - DNA, 1338 bp, Artificial
  Substituion in SEQ ID NO 563
gtgccgccgggacacgaatgtgagggacgatgcttggacattcgagaacttgaagaaaagaaattaacagagctataccgttatgcccgagaatttcagatcccgcactacggatcgatgaaaaagaaagagctgatttttgccattctcaaagcccaggccgagcgggacggcctgatgttcgccgaaggcgtgctcgaaatcatgccggaagggtacggatttctccggcccgtggggtatctgccgagtcaggaggacatctacgtcgcggcatcccagattcggcgcttcgatctccgtacgggcgatctcgtcagcggaaaagtccgaccgcccaaggagaacgagcggtacttcggccttttgcacgtggaggcggtcaacggttacagtcccgaggtagctgccgaacggcttcatttcgcagcgctcactccgctctttccttccaaacgcatcgtgctcgagaccacacctgaaaacttggccacgcgcctcatcgacctgttcgcgcccatcggcttcgggcagcgcggcatgattgtggcgcctccgaaagcgggcaagacggtgctcttgaaggagattgcccacagcattgccacaaattatcccgatgtgcacctgtttgtcctgctcatcgacgagcgccccgaagaggtgaccgacatgcagcgctcggtcaagggagaggtgattgcgtccacgtttgacgaggtgcccgagaatcacatcaaggtatccgagctggtgctggaacgggcgctgcgcctcgttgagcacaagcaggacgtggtcatcctcctggacagcctgacgcggctcacgcgcgcctacaacctcgtcgttcccccgtccgggcgcacactctcgggtggtatcgatccggctgcatttcaccgcccgaagcggttcttcggagcggcgcgcaacgtcgaagagggcggaagcctgaccatcctcgccacggcgctcatcgacacgggttcgcgcatggacgacgtgatctacgaggagttcaagggcacgggcaacatggaactgcatctcgaccgcaggctcgccgagaagcgcgtgttcccctcgattgacatccgccgttccgggacgcgccgagaggaagcgctcatgcccaaggaagagctcgaaaaggtgtgggcgattcgcaaatccatgggcgacaatcaggacttcaccgagatgttcctgcgcaagttccgccattataagaccaacaaggagttcctcgacagcctgagtctcaaccgggtcgagcggaagcctgttgcgagtgcggagaagccagccgcgcagcctgtcacgagcgaaacctga

SEQ ID NO: 579 - protein, 125 aa, Alicyclobacillus acidocaldarius
MAYKVLVVDDQFGIRVLLHEVLQREGYEVFQASNGPSALSIVEREQPDLVLLDMKIPGMDGLEILRNLRKLGVDAKVIMMTAYGELDLIHEAMEMGAVAHFTKPFDIDELRRTVREHLEARAQAE

SEQ ID NO: 580 - DNA, 378 bp, Alicyclobacillus acidocaldarius
atggcatacaaggtgctcgtggtcgacgatcaattcgggatccgcgtgttgctgcacgaagtcctgcagcgggaaggctatgaggtgtttcaggcttcgaacgggccgagcgccctcagcatcgtcgaacgtgagcagcccgatctcgtccttttggacatgaagataccgggaatggatgggttggaaatcctgcgcaatctccgcaaactgggcgttgacgcgaaggtcatcatgatgaccgcgtacggcgaactggatctgattcacgaggcgatggagatgggcgcggtggcccatttcaccaagccctttgacatcgatgagctgcggcggacagtgcgtgagcacctcgaggcgcgtgcacaggccgagtga

SEQ ID NO: 581 - protein, 118 aa, Bacillus cereus subsp. cytotoxis NVH 391-98
MEGKILIVDDQYGIRVLLHEVFQKEGYQTFQAANGFQALDIVKKDNPDLVILDMKIPGMDGIEILKHVKEINADIKVILMTAYGELDMIQEAKDLGALMHFAKPFDIDEIRQAVRNEI

SEQ ID NO: 582 - protein, 117 aa, Bacillus halodurans C-125
KILVVDDQYGIRVLLNEILQKDGYQMFQAANGIQALAIVEEETPDLVLLDMKIPGMDGLEILRRIKDMNPNIEVIMMTAYGELNMINEAMQLGAVTHFAKPFDIDDVRAVIAENMKS

SEQ ID NO: 583 - protein, 122 aa, Bacillus weihenstephanensis KBAB4
MEGKILIVDDQYGIRVLLHEVFQKEGYQTFQAANGFQALDIVKKDNPDLVVLDMKIPGMDGIEILKHVKEIDESIKVILMTAYGELDMIQEAKDLGALMHFAKPFDIDEIRQAVRDQLAVEA

SEQ ID NO: 584 - protein, 122 aa, Bacillus thuringiensis str. Al Hakam
MEGKILIVDDQYGIRVLLHEVFQKEGYQTFQAANGFQALDIVKKDNPDLVVLDMKIPGMDGIEILKHVKEIDESIKVILMTAYGELDMIQEAKDLGALMHFAKPFDIDEIRQAVRNELAVEA

SEQ ID NO: 585 - protein, 122 aa, Bacillus thuringiensis serovar israelensis ATCC 35646; identical to SEQ ID NO: 584

SEQ ID NO: 586 - protein, 125 aa, Artificial
  Substituion in SEQ ID NO 579
MAYKVLVVDDQFGIRVLLHEVLQREGYEVFQASNGPSALSIVEREQPDLVLLDMKIPGMDGLEILRNLRKLGVDAKVIMMTAYGELDLIHEAMEMGAVAHFTKPFDIDDLRRTVREHLEARAQAE

SEQ ID NO: 587 - protein, 125 aa, Artificial
  Substituion in SEQ ID NO 579
MAYKVLVVDDQFGIRVLLHEVLQREGYEIFQASNGPSALSIVEREQPDLVLLDMKIPGMDGLEILRNLRKLGVDAKVIMMTAYGELDLIHEAMEMGAVAHFTKPFDIDELRRTVREHLEARAQAE

SEQ ID NO: 588 - protein, 125 aa, Artificial
  Substituion in SEQ ID NO 579
MAYKVLVVDDQFGIRVLLHEVLQREGYEVFQASNGPSALSIVEREQPDLVLLDMKIPGMDGLEILRNLRKLGVDAKVIMMTAYGELDLIHEAMEMGAVAHFTKPFDIDELRRTVREHLEARAQAD

SEQ ID NO: 589 - protein, 125 aa, Artificial
  Substituion in SEQ ID NO 579
MAYKVLVVDDQFGIRVLLHEVLQREGYEVFQASNGPSALSIVEREQPDLVLLDMKIPGMDGLEILKNLRKLGVDAKVIMMTAYGELDLIHEAMEMGAVAHFTKPFDIDELRRTVREHLEARAQAE

SEQ ID NO: 590 - protein, 125 aa, Artificial
  Substituion in SEQ ID NO 579
MAYKVLVVDDQFGIRVLLHEVLQREGYEVFQASNGPSALSIVEREQPDLVLLDMKIPGMDGIEILRNLRKLGVDAKVIMMTAYGELDLIHEAMEMGAVAHFTKPFDIDELRRTVREHLEARAQAE

SEQ ID NO: 591 - DNA, 378 bp, Artificial
  Substituion in SEQ ID NO 580
atggcatacaaggtgctcgtggtcgacgatcaattcgggatccgcgtgttgctgcacgaagtcctgcagcgggaaggctatgaggtgtttcaggcttcgaacgggccgagcgccctcagcatcgtcgaacgtgagcagcccgatctcgtccttttggacatgaagataccgggaatggatgggttggaaatcctgcgcaatctccgcaaactgggcgttgacgcgaaggtcatcatgatgaccgcgtacggcgaactggatctgattcacgaggcgatggagatgggcgcggtggcccatttcaccaagccctttgacatcgatgatctgcggcggacagtgcgtgagcacctcgaggcgcgtgcacaggccgagtga

SEQ ID NO: 592 - DNA, 378 bp, Artificial
  Substituion in SEQ ID NO 580
atggcatacaaggtgctcgtggtcgacgatcaattcgggatccgcgtgttgctgcacgaagtcctgcagcgggaaggctatgagatttttcaggcttcgaacgggccgagcgccctcagcatcgtcgaacgtgagcagcccgatctcgtccttttggacatgaagataccgggaatggatgggttggaaatcctgcgcaatctccgcaaactgggcgttgacgcgaaggtcatcatgatgaccgcgtacggcgaactggatctgattcacgaggcgatggagatgggcgcggtggcccatttcaccaagccctttgacatcgatgagctgcggcggacagtgcgtgagcacctcgaggcgcgtgcacaggccgagtga

SEQ ID NO: 593 - DNA, 378 bp, Artificial
  Substituion in SEQ ID NO 580
atggcatacaaggtgctcgtggtcgacgatcaattcgggatccgcgtgttgctgcacgaagtcctgcagcgggaaggctatgaggtgtttcaggcttcgaacgggccgagcgccctcagcatcgtcgaacgtgagcagcccgatctcgtccttttggacatgaagataccgggaatggatgggttggaaatcctgcgcaatctccgcaaactgggcgttgacgcgaaggtcatcatgatgaccgcgtacggcgaactggatctgattcacgaggcgatggagatgggcgcggtggcccatttcaccaagccctttgacatcgatgagctgcggcggacagtgcgtgagcacctcgaggcgcgtgcacaggccgattga

SEQ ID NO: 594 - DNA, 378 bp, Artificial
  Substituion in SEQ ID NO 580
atggcatacaaggtgctcgtggtcgacgatcaattcgggatccgcgtgttgctgcacgaagtcctgcagcgggaaggctatgaggtgtttcaggcttcgaacgggccgagcgccctcagcatcgtcgaacgtgagcagcccgatctcgtccttttggacatgaagataccgggaatggatgggttggaaatcctgaaaaatctccgcaaactgggcgttgacgcgaaggtcatcatgatgaccgcgtacggcgaactggatctgattcacgaggcgatggagatgggcgcggtggcccatttcaccaagccctttgacatcgatgagctgcggcggacagtgcgtgagcacctcgaggcgcgtgcacaggccgagtga

SEQ ID NO: 595 - DNA, 378 bp, Artificial
  Substituion in SEQ ID NO 580
atggcatacaaggtgctcgtggtcgacgatcaattcgggatccgcgtgttgctgcacgaagtcctgcagcgggaaggctatgaggtgtttcaggcttcgaacgggccgagcgccctcagcatcgtcgaacgtgagcagcccgatctcgtccttttggacatgaagataccgggaatggatgggattgaaatcctgcgcaatctccgcaaactgggcgttgacgcgaaggtcatcatgatgaccgcgtacggcgaactggatctgattcacgaggcgatggagatgggcgcggtggcccatttcaccaagccctttgacatcgatgagctgcggcggacagtgcgtgagcacctcgaggcgcgtgcacaggccgagtga

SEQ ID NO: 596 - protein, 191 aa, Alicyclobacillus acidocaldarius
MATGLSRAGREDSKMAISLARTEHEIQEMPLVELVYEILKARKEPMYFRDIMKEIQELRHMTDEQVADVIARVFTEINVDGRFVCIGHNVWGLNRWYPTDRNAERLSGGKKFIRKTGDAFGDEEDDEEEYEEEDVLEDDELDYDEVEAVDEEPEFDDVEVVEDEDEILPEDEYDDAPLFDEEEEVEEDEED

SEQ ID NO: 597 - DNA, 576 bp, Alicyclobacillus acidocaldarius
ttggccaccggcctatcccgagctggaagggaagattccaagatggccatctcattggcacgaacggaacacgagatacaggaaatgcctctcgtggagctcgtgtacgagatcttgaaagcccggaaagagcccatgtacttccgcgatatcatgaaggaaatccaggagctccgccacatgaccgacgagcaggtggcggacgtcatcgcgcgggtattcacagagatcaacgtcgatggccggttcgtctgtattggtcacaatgtgtgggggttgaatcgttggtatccgacggatcgcaacgccgagcgcttgtcgggcggcaagaagttcatccgcaagacgggcgacgcgtttggcgatgaggaggacgacgaagaggagtacgaggaggaggacgtcctcgaggacgacgagctcgactacgacgaggtcgaggcggtcgacgaggagcccgaattcgacgacgtcgaggtcgtggaagacgaggacgagatcctgccagaagacgaatacgacgatgcgccgctgttcgacgaagaggaggaagtcgaggaagacgaggaggactga

SEQ ID NO: 598 - protein, 90 aa, Bacillus halodurans C-125
SKEEIQELSMVEVAYLVMKETKEPFNYQDLLKKVAELKGMSEEQMLDRIGYLYTDLNIDGRFVTLGDNRWGLRSWYPLEQVEEEITGPTK

SEQ ID NO: 599 - protein, 83 aa, Bacillus sp. NRRL B-14911
TKEELQEMSFIDIAYELLKGTKQQVSFTDIMNEYKTRLEVSDEEIRSRIAQFYTDLNLDGRFIAMGENRWGLRSWYPVDTMEE

SEQ ID NO: 600 - protein, 90 aa, Geobacillus thermodenitrificans NG80-2
MSLQQQYSPEELQEMSFVELANLILLNKREALPFDQIVREAAALTGATEDDIAARLAQYYTDLNIDGRFICVGENVWGLRAWYPFDQTED

SEQ ID NO: 601 - protein, 107 aa, Bacillus sp. SG-1
MSLKQLSTEELRQKSFIELAHELLTEKKQAVTFNDLLKEIGDLLKLSKEEVRSRMVQFYTDLNVDGRFIALGENRWGIRAWYPVDQIEEETVPTIKPRKKKAKKTDD

SEQ ID NO: 602 - protein, 86 aa, Oceanobacillus iheyensis HTE831
THDEIDHLSMIELGVKILKEENKAMNYKVIFNKIAELKDFTDEQKQNMMAQFYTDMNVDGRFLTLGSGMWGLKRWYPVEQAEEEIT

SEQ ID NO: 603 - protein, 191 aa, Artificial
  Substituion in SEQ ID NO 596
MATGLSRAGREDSKMAISLARTEHEIQEMPLVELVYEILKARKEPMYFRDLMKEIQELRHMTDEQVADVIARVFTEINVDGRFVCIGHNVWGLNRWYPTDRNAERLSGGKKFIRKTGDAFGDEEDDEEEYEEEDVLEDDELDYDEVEAVDEEPEFDDVEVVEDEDEILPEDEYDDAPLFDEEEEVEEDEED

SEQ ID NO: 604 - protein, 191 aa, Artificial
  Substituion in SEQ ID NO 596
MATGISRAGREDSKMAISLARTEHEIQEMPLVELVYEILKARKEPMYFRDIMKEIQELRHMTDEQVADVIARVFTEINVDGRFVCIGHNVWGLNRWYPTDRNAERLSGGKKFIRKTGDAFGDEEDDEEEYEEEDVLEDDELDYDEVEAVDEEPEFDDVEVVEDEDEILPEDEYDDAPLFDEEEEVEEDEED

SEQ ID NO: 605 - protein, 191 aa, Artificial
  Substituion in SEQ ID NO 596
MATGLSRAGREDSKMAISLAKTEHEIQEMPLVELVYEILKARKEPMYFRDIMKEIQELRHMTDEQVADVIARVFTEINVDGRFVCIGHNVWGLNRWYPTDRNAERLSGGKKFIRKTGDAFGDEEDDEEEYEEEDVLEDDELDYDEVEAVDEEPEFDDVEVVEDEDEILPEDEYDDAPLFDEEEEVEEDEED

SEQ ID NO: 606 - protein, 191 aa, Artificial
  Substituion in SEQ ID NO 596
MATGLSRAGREDSKMAISLARTEHEIQEMPLIELVYEILKARKEPMYFRDIMKEIQELRHMTDEQVADVIARVFTEINVDGRFVCIGHNVWGLNRWYPTDRNAERLSGGKKFIRKTGDAFGDEEDDEEEYEEEDVLEDDELDYDEVEAVDEEPEFDDVEVVEDEDEILPEDEYDDAPLFDEEEEVEEDEED

SEQ ID NO: 607 - protein, 191 aa, Artificial
  Substituion in SEQ ID NO 596
MATGLSRAGREDSKMAISLARTEHEIQEMPLVELVYEILKARKEPMYFRDIMKEIQELRHMTDEQVADVIARVFTEINVDGRFVCIGHNVWGLNRWYPTDRNAERLSGGKKFIRKTGDAFGDEEDDEEEYEEEDVLEDDELDYDEVEAVDEEPEFDDVEVVEDEDEILPEDEYEDAPLFDEEEEVEEDEED

SEQ ID NO: 608 - DNA, 576 bp, Artificial
  Substituion in SEQ ID NO 597
ttggccaccggcctatcccgagctggaagggaagattccaagatggccatctcattggcacgaacggaacacgagatacaggaaatgcctctcgtggagctcgtgtacgagatcttgaaagcccggaaagagcccatgtacttccgcgatttaatgaaggaaatccaggagctccgccacatgaccgacgagcaggtggcggacgtcatcgcgcgggtattcacagagatcaacgtcgatggccggttcgtctgtattggtcacaatgtgtgggggttgaatcgttggtatccgacggatcgcaacgccgagcgcttgtcgggcggcaagaagttcatccgcaagacgggcgacgcgtttggcgatgaggaggacgacgaagaggagtacgaggaggaggacgtcctcgaggacgacgagctcgactacgacgaggtcgaggcggtcgacgaggagcccgaattcgacgacgtcgaggtcgtggaagacgaggacgagatcctgccagaagacgaatacgacgatgcgccgctgttcgacgaagaggaggaagtcgaggaagacgaggaggactga

SEQ ID NO: 609 - DNA, 576 bp, Artificial
  Substituion in SEQ ID NO 597
ttggccaccggcatttcccgagctggaagggaagattccaagatggccatctcattggcacgaacggaacacgagatacaggaaatgcctctcgtggagctcgtgtacgagatcttgaaagcccggaaagagcccatgtacttccgcgatatcatgaaggaaatccaggagctccgccacatgaccgacgagcaggtggcggacgtcatcgcgcgggtattcacagagatcaacgtcgatggccggttcgtctgtattggtcacaatgtgtgggggttgaatcgttggtatccgacggatcgcaacgccgagcgcttgtcgggcggcaagaagttcatccgcaagacgggcgacgcgtttggcgatgaggaggacgacgaagaggagtacgaggaggaggacgtcctcgaggacgacgagctcgactacgacgaggtcgaggcggtcgacgaggagcccgaattcgacgacgtcgaggtcgtggaagacgaggacgagatcctgccagaagacgaatacgacgatgcgccgctgttcgacgaagaggaggaagtcgaggaagacgaggaggactga

SEQ ID NO: 610 - DNA, 576 bp, Artificial
  Substituion in SEQ ID NO 597
ttggccaccggcctatcccgagctggaagggaagattccaagatggccatctcattggcaaaaacggaacacgagatacaggaaatgcctctcgtggagctcgtgtacgagatcttgaaagcccggaaagagcccatgtacttccgcgatatcatgaaggaaatccaggagctccgccacatgaccgacgagcaggtggcggacgtcatcgcgcgggtattcacagagatcaacgtcgatggccggttcgtctgtattggtcacaatgtgtgggggttgaatcgttggtatccgacggatcgcaacgccgagcgcttgtcgggcggcaagaagttcatccgcaagacgggcgacgcgtttggcgatgaggaggacgacgaagaggagtacgaggaggaggacgtcctcgaggacgacgagctcgactacgacgaggtcgaggcggtcgacgaggagcccgaattcgacgacgtcgaggtcgtggaagacgaggacgagatcctgccagaagacgaatacgacgatgcgccgctgttcgacgaagaggaggaagtcgaggaagacgaggaggactga

SEQ ID NO: 611 - DNA, 576 bp, Artificial
  Substituion in SEQ ID NO 597
ttggccaccggcctatcccgagctggaagggaagattccaagatggccatctcattggcacgaacggaacacgagatacaggaaatgcctctcattgagctcgtgtacgagatcttgaaagcccggaaagagcccatgtacttccgcgatatcatgaaggaaatccaggagctccgccacatgaccgacgagcaggtggcggacgtcatcgcgcgggtattcacagagatcaacgtcgatggccggttcgtctgtattggtcacaatgtgtgggggttgaatcgttggtatccgacggatcgcaacgccgagcgcttgtcgggcggcaagaagttcatccgcaagacgggcgacgcgtttggcgatgaggaggacgacgaagaggagtacgaggaggaggacgtcctcgaggacgacgagctcgactacgacgaggtcgaggcggtcgacgaggagcccgaattcgacgacgtcgaggtcgtggaagacgaggacgagatcctgccagaagacgaatacgacgatgcgccgctgttcgacgaagaggaggaagtcgaggaagacgaggaggactga

SEQ ID NO: 612 - DNA, 576 bp, Artificial
  Substituion in SEQ ID NO 597
ttggccaccggcctatcccgagctggaagggaagattccaagatggccatctcattggcacgaacggaacacgagatacaggaaatgcctctcgtggagctcgtgtacgagatcttgaaagcccggaaagagcccatgtacttccgcgatatcatgaaggaaatccaggagctccgccacatgaccgacgagcaggtggcggacgtcatcgcgcgggtattcacagagatcaacgtcgatggccggttcgtctgtattggtcacaatgtgtgggggttgaatcgttggtatccgacggatcgcaacgccgagcgcttgtcgggcggcaagaagttcatccgcaagacgggcgacgcgtttggcgatgaggaggacgacgaagaggagtacgaggaggaggacgtcctcgaggacgacgagctcgactacgacgaggtcgaggcggtcgacgaggagcccgaattcgacgacgtcgaggtcgtggaagacgaggacgagatcctgccagaagacgaatacgaagatgcgccgctgttcgacgaagaggaggaagtcgaggaagacgaggaggactga

SEQ ID NO: 613 - protein, 345 aa, Alicyclobacillus acidocaldarius
MAALARTHEPGIARVRVLAPGLFTTVQDGGRPHHRHLGVPLGGALDVLAFRSANRLVGNAEDCAALEVTGAGPKLAFEAPAAVALCGADFLAYVDGEPLPVQRPVWLGGGAVLEIRNARRGFRGYLAIRGGFLVEQVLDSRSALPRYGIGKLLAAGDEMTYQPGPAAPPAGFRAISPRAAVAPFQVGGWLDQIEDEIVILRVVRGEQADWFEKGSRRAFFDRTWQVAPRSDRMGLRLRGEPLRAPSRQLASEPVVPGSVQVPQDGLPIVLMRECQTTGGYPKLATVISADLDKLAHLRPGSSVRFVEVSFEEAFRLRRVHDRLARVWLRFVAERARQAWGSEGGD

SEQ ID NO: 614 - DNA, 1038 bp, Alicyclobacillus acidocaldarius
atggccgctttggcgcgtacacatgagccaggtatcgcgcgcgtgcgcgtgttggcgccggggctctttacgaccgtgcaggatggagggcgcccgcatcaccgccacctgggcgtgccgctcgggggcgcgctcgacgtgttggcgttccgctcggccaatcggctggtgggaaacgccgaagattgcgcggcgctcgaggtgacgggcgcggggccgaagctcgcgtttgaggcgcccgccgccgttgcgctctgtggcgcggacttcctggcgtatgtggatggcgagccactgcccgtgcagcgcccggtctggctcggaggcggcgcggtgcttgagattcggaatgcccggcgcggatttcgcggctatttggccatccgcggcgggtttctcgtggagcaagtgctcgacagccggagcgcgctgccccgctacggcatcggcaagctcctggccgcgggagacgagatgacctatcagcctggacccgccgcgccgccggcgggtttccgcgccatctctcctcgcgcggccgtcgcgccgttccaggtcggcgggtggctggatcagatcgaggacgagatcgtcatcctgcgcgtggtgcggggcgagcaggcggattggttcgaaaaaggctcgcggcgcgccttcttcgaccgcacgtggcaggtggcgccgcggtcggatcgcatgggcctcaggcttcgcggcgagcccctgcgcgcgccgtcccggcagctcgcgagcgagccggtcgtgcccggcagcgtccaggtgccgcaggacggcctgcccattgtgctcatgcgcgagtgccagaccacgggcggttatcccaagcttgcgacggtcatctccgccgatctcgacaaattggcgcatctccgaccaggaagttcggtgcgctttgtggaagtgagtttcgaggaagccttcaggctgcggcgcgtgcatgaccgacttgcccgcgtgtggctccggttcgtcgcggagcgagcgcggcaagcgtggggcagcgaaggaggggattga

SEQ ID NO: 615 - protein, 303 aa, Bordetella parapertussis 12822
VIKPGMLSTFQDGGRHGYQHQGIPVAGAMDPRAHRLANLLAGNAADTATLEITVAGPTLRFEAPACVALGGADLGATLGGLPAPVLRPLVARAGDVLSFARPGQGARAYLAVHGGYDLPMVMGSQSTYLRSAFGGYHGRALAKGDQVGLRRPLADDAARLDALAQQLWQLRFYLAATLSSPPRDVLRILPGPHWEAFDAASRQALLDQAFRIGAQSDRMGYRLEGPRLRLSERREMLSEATCFGTVQVPADGAPIVLMADRQTTGGYPKLAQVATVDLPSLAQAMPGQALRFALIELEQAQRL

SEQ ID NO: 616 - protein, 321 aa, Geobacillus kaustophilus HTA426
IDVIEAGLFTTVQDGGRFGYRHAGVPAGGAMDAWAYRLANALVGNNGDEAVLEATMAGPTLRFRVEAVVAVCGGDFPCTLNGQPISLWKPEIVKSGDVLEVGVCRTGFRAYIAVSGGIDVPPVMGSRSTYVPAQLGGLSGRPLQRGDALPVGVTHGRRVIGRMRWGLASAARRYIGGKTKTVRAVPGPEYDEFTPASRRQFFAARYEVTTQSDRIGYRLSGRALALVREREMVSEAVVFGTVQVPASGQPIVLMADSQTTGGYPRIAQVASVDLPILAQARPGDFIQFQPIEPEEAMWLYREQQQRLARWIAAIRRQWEGE

SEQ ID NO: 617 - protein, 319 aa, Geobacillus thermodenitrificans NG80-2
VIDGGFFTTVQDGGRIGYRNAGVPVGGVMDAWAYRLANALVGNEGDEAVLEATMSGPTLRFHVETVIAVCGGDFPCTLNGEPMAMWKPVIIRPGDVLKVGVCQAGWRAYIAVSGGIGVPSVMGSRSTYVPAQLGGLSGRPLQPGDVLPIGTAREHNIRKPFRWGLSSDAGRYIDGKTKTVRAVPGPEYSEFTPESRRQFFAARYHVTPQSDRIGYRLSGPALVLGREREMVSEAVVFGTVQVPTSGQPIVLMADSQTTGGYPRIAQVAAADLPVLAQARPGDRIQFQPVAPEEAVQLYIEQQRRLGCWIAAIRRQWGEK

SEQ ID NO: 618 - protein, 334 aa, Bacillus amyloliquefaciens FZB42
MKVVKPGLLTTVQDTGRTGYQKYGVLGSGAMDTISLRIANLLAGNQEKEAGLEITLMGPGPSFEFSEPAVIAVTGADFALHINGEPAPLWKPVLIKENSVVSFGPCKMGSRAYLAVAGGFDVPAVMESKSTYVRAGIGGFCGRALQKDDELPLGRMTPCSESIAYCLSDSFGQHGFSAPDWSVSSRGFLPLKKNPVIRVLEGAQFHAFTEEAKLRFYQESYTVTPQSDRMGYRLKGAPLELREPLEMVSEAVTFGTVQVPPDGNPIILLADRQTTGGYPRMAHIISADLPLVAQTMPGEHITFRAVSLEEAELLLLEKEQQLKELKARLKMEWL

SEQ ID NO: 619 - protein, 309 aa, Bacillus halodurans C-125
IFRPGLLTTIQDLGRTGYLKYGVIVSGPMDEYAHRMANLLVGNDEKAALLEMTFIGPTIQFTSDQLIAMTGGDLSPTIDGHSVPMYRPVFVKKGAVLSFGRCKTGCRSYLAIGGGIDVPKVMNSRSTYLRAKIGGFQGRALVEGDELICGAPPEQTERLVKTCQKGIVHSFATTKWSVVSSQRSRDGAEKVVRVTVGSHYEQFSEASQHKFFSETFQVTSKSDRMGYRLKGPTLERLEEQELISEPISVGTIQVPADGNPIILMADRQTTGGYPRIAHVIAVDLPIIAQAKPGAAIRFQQASLKEAERL

SEQ ID NO: 620 - protein, 345 aa, Artificial
  Substituion in SEQ ID NO 613
MAALARTHEPGIARVRVLAPGLFTTVQDGGRPHHRHLGVPLGGALDVLAFRSANRLVGNAEDCAALEITGAGPKLAFEAPAAVALCGADFLAYVDGEPLPVQRPVWLGGGAVLEIRNARRGFRGYLAIRGGFLVEQVLDSRSALPRYGIGKLLAAGDEMTYQPGPAAPPAGFRAISPRAAVAPFQVGGWLDQIEDEIVILRVVRGEQADWFEKGSRRAFFDRTWQVAPRSDRMGLRLRGEPLRAPSRQLASEPVVPGSVQVPQDGLPIVLMRECQTTGGYPKLATVISADLDKLAHLRPGSSVRFVEVSFEEAFRLRRVHDRLARVWLRFVAERARQAWGSEGGD

SEQ ID NO: 621 - protein, 345 aa, Artificial
  Substituion in SEQ ID NO 613
MAALARTHEPGIARVRVLAPGLFTTVQDGGRPHHRHLGVPLGGALDVLAFRSANRLVGNAEECAALEVTGAGPKLAFEAPAAVALCGADFLAYVDGEPLPVQRPVWLGGGAVLEIRNARRGFRGYLAIRGGFLVEQVLDSRSALPRYGIGKLLAAGDEMTYQPGPAAPPAGFRAISPRAAVAPFQVGGWLDQIEDEIVILRVVRGEQADWFEKGSRRAFFDRTWQVAPRSDRMGLRLRGEPLRAPSRQLASEPVVPGSVQVPQDGLPIVLMRECQTTGGYPKLATVISADLDKLAHLRPGSSVRFVEVSFEEAFRLRRVHDRLARVWLRFVAERARQAWGSEGGD

SEQ ID NO: 622 - protein, 345 aa, Artificial
  Substituion in SEQ ID NO 613
MAALARTHEPGIARVRVLAPGLFTTVQDGGRPHHRHLGVPLGGALDVLAFRSANRLVGNAEDCAALEVTGAGPKLAFEAPAAVALCGADFLAYVDGEPLPVQRPVWLGGGAVLEIRNARRGFRGYLAIRGGFLVEQVLDSRSALPRYGIGKLLAAGDEMTYQPGPAAPPAGFRAISPRAAVAPFQVGGWLDQIEDEIVILRVVRGEQADWFEKGSRRAFFDRTWQVAPRSDRMGLRLRGEPLRAPSRQLASEPVVPGSVQVPQDGLPIVLMKECQTTGGYPKLATVISADLDKLAHLRPGSSVRFVEVSFEEAFRLRRVHDRLARVWLRFVAERARQAWGSEGGD

SEQ ID NO: 623 - protein, 345 aa, Artificial
  Substituion in SEQ ID NO 613
MAALARTHEPGIARVRVLAPGLFTTVQDGGRPHHRHLGVPLGGALDVLAFRSANRLVGNAEDCAALEVTGAGPKLAFEAPAAVALCGADFLAYVDGEPLPVQRPVWLGGGAVLEIRNARRGFRGYLAIRGGFLVEQVLDSRSALPRYGIGKLLAAGDEMTYQPGPAAPPAGFRAISPRAAVAPFQVGGWLDQIEDEIVILRVVRGEQADWFEKGSRRAFFDRTWQVAPRSDRMGLRLRGEPLRAPSRQLASEPVVPGSVQVPQDGLPIVLMRECQTTGGYPKLATVISADLDKLAHLRPGSSVRFVEVSFEEAFRLRRVHDRLAKVWLRFVAERARQAWGSEGGD

SEQ ID NO: 624 - protein, 345 aa, Artificial
  Substituion in SEQ ID NO 613
MAALARTHEPGIARVRVLAPGLFTTVQDGGRPHHRHLGVPLGGALDVLAFRSANRLVGNAEDCAALEVTGAGPKLAFEAPAAVALCGADFLAYVDGEPLPVQRPVWLGGGAVLEIRNARRGFRGYLAIRGGFLVEQVLDSRSALPRYGIGKLLAAGDEMTYQPGPAAPPAGFRAISPRAAVAPFQVGGWLDQIEDEIVILRVVRGEQADWFERGSRRAFFDRTWQVAPRSDRMGLRLRGEPLRAPSRQLASEPVVPGSVQVPQDGLPIVLMRECQTTGGYPKLATVISADLDKLAHLRPGSSVRFVEVSFEEAFRLRRVHDRLARVWLRFVAERARQAWGSEGGD

SEQ ID NO: 625 - DNA, 1038 bp, Artificial
  Substituion in SEQ ID NO 614
atggccgctttggcgcgtacacatgagccaggtatcgcgcgcgtgcgcgtgttggcgccggggctctttacgaccgtgcaggatggagggcgcccgcatcaccgccacctgggcgtgccgctcgggggcgcgctcgacgtgttggcgttccgctcggccaatcggctggtgggaaacgccgaagattgcgcggcgctcgagattacgggcgcggggccgaagctcgcgtttgaggcgcccgccgccgttgcgctctgtggcgcggacttcctggcgtatgtggatggcgagccactgcccgtgcagcgcccggtctggctcggaggcggcgcggtgcttgagattcggaatgcccggcgcggatttcgcggctatttggccatccgcggcgggtttctcgtggagcaagtgctcgacagccggagcgcgctgccccgctacggcatcggcaagctcctggccgcgggagacgagatgacctatcagcctggacccgccgcgccgccggcgggtttccgcgccatctctcctcgcgcggccgtcgcgccgttccaggtcggcgggtggctggatcagatcgaggacgagatcgtcatcctgcgcgtggtgcggggcgagcaggcggattggttcgaaaaaggctcgcggcgcgccttcttcgaccgcacgtggcaggtggcgccgcggtcggatcgcatgggcctcaggcttcgcggcgagcccctgcgcgcgccgtcccggcagctcgcgagcgagccggtcgtgcccggcagcgtccaggtgccgcaggacggcctgcccattgtgctcatgcgcgagtgccagaccacgggcggttatcccaagcttgcgacggtcatctccgccgatctcgacaaattggcgcatctccgaccaggaagttcggtgcgctttgtggaagtgagtttcgaggaagccttcaggctgcggcgcgtgcatgaccgacttgcccgcgtgtggctccggttcgtcgcggagcgagcgcggcaagcgtggggcagcgaaggaggggattga

SEQ ID NO: 626 - DNA, 1038 bp, Artificial
  Substituion in SEQ ID NO 614
atggccgctttggcgcgtacacatgagccaggtatcgcgcgcgtgcgcgtgttggcgccggggctctttacgaccgtgcaggatggagggcgcccgcatcaccgccacctgggcgtgccgctcgggggcgcgctcgacgtgttggcgttccgctcggccaatcggctggtgggaaacgccgaagaatgcgcggcgctcgaggtgacgggcgcggggccgaagctcgcgtttgaggcgcccgccgccgttgcgctctgtggcgcggacttcctggcgtatgtggatggcgagccactgcccgtgcagcgcccggtctggctcggaggcggcgcggtgcttgagattcggaatgcccggcgcggatttcgcggctatttggccatccgcggcgggtttctcgtggagcaagtgctcgacagccggagcgcgctgccccgctacggcatcggcaagctcctggccgcgggagacgagatgacctatcagcctggacccgccgcgccgccggcgggtttccgcgccatctctcctcgcgcggccgtcgcgccgttccaggtcggcgggtggctggatcagatcgaggacgagatcgtcatcctgcgcgtggtgcggggcgagcaggcggattggttcgaaaaaggctcgcggcgcgccttcttcgaccgcacgtggcaggtggcgccgcggtcggatcgcatgggcctcaggcttcgcggcgagcccctgcgcgcgccgtcccggcagctcgcgagcgagccggtcgtgcccggcagcgtccaggtgccgcaggacggcctgcccattgtgctcatgcgcgagtgccagaccacgggcggttatcccaagcttgcgacggtcatctccgccgatctcgacaaattggcgcatctccgaccaggaagttcggtgcgctttgtggaagtgagtttcgaggaagccttcaggctgcggcgcgtgcatgaccgacttgcccgcgtgtggctccggttcgtcgcggagcgagcgcggcaagcgtggggcagcgaaggaggggattga

SEQ ID NO: 627 - DNA, 1038 bp, Artificial
  Substituion in SEQ ID NO 614
atggccgctttggcgcgtacacatgagccaggtatcgcgcgcgtgcgcgtgttggcgccggggctctttacgaccgtgcaggatggagggcgcccgcatcaccgccacctgggcgtgccgctcgggggcgcgctcgacgtgttggcgttccgctcggccaatcggctggtgggaaacgccgaagattgcgcggcgctcgaggtgacgggcgcggggccgaagctcgcgtttgaggcgcccgccgccgttgcgctctgtggcgcggacttcctggcgtatgtggatggcgagccactgcccgtgcagcgcccggtctggctcggaggcggcgcggtgcttgagattcggaatgcccggcgcggatttcgcggctatttggccatccgcggcgggtttctcgtggagcaagtgctcgacagccggagcgcgctgccccgctacggcatcggcaagctcctggccgcgggagacgagatgacctatcagcctggacccgccgcgccgccggcgggtttccgcgccatctctcctcgcgcggccgtcgcgccgttccaggtcggcgggtggctggatcagatcgaggacgagatcgtcatcctgcgcgtggtgcggggcgagcaggcggattggttcgaaaaaggctcgcggcgcgccttcttcgaccgcacgtggcaggtggcgccgcggtcggatcgcatgggcctcaggcttcgcggcgagcccctgcgcgcgccgtcccggcagctcgcgagcgagccggtcgtgcccggcagcgtccaggtgccgcaggacggcctgcccattgtgctcatgaaagagtgccagaccacgggcggttatcccaagcttgcgacggtcatctccgccgatctcgacaaattggcgcatctccgaccaggaagttcggtgcgctttgtggaagtgagtttcgaggaagccttcaggctgcggcgcgtgcatgaccgacttgcccgcgtgtggctccggttcgtcgcggagcgagcgcggcaagcgtggggcagcgaaggaggggattga

SEQ ID NO: 628 - DNA, 1038 bp, Artificial
  Substituion in SEQ ID NO 614
atggccgctttggcgcgtacacatgagccaggtatcgcgcgcgtgcgcgtgttggcgccggggctctttacgaccgtgcaggatggagggcgcccgcatcaccgccacctgggcgtgccgctcgggggcgcgctcgacgtgttggcgttccgctcggccaatcggctggtgggaaacgccgaagattgcgcggcgctcgaggtgacgggcgcggggccgaagctcgcgtttgaggcgcccgccgccgttgcgctctgtggcgcggacttcctggcgtatgtggatggcgagccactgcccgtgcagcgcccggtctggctcggaggcggcgcggtgcttgagattcggaatgcccggcgcggatttcgcggctatttggccatccgcggcgggtttctcgtggagcaagtgctcgacagccggagcgcgctgccccgctacggcatcggcaagctcctggccgcgggagacgagatgacctatcagcctggacccgccgcgccgccggcgggtttccgcgccatctctcctcgcgcggccgtcgcgccgttccaggtcggcgggtggctggatcagatcgaggacgagatcgtcatcctgcgcgtggtgcggggcgagcaggcggattggttcgaaaaaggctcgcggcgcgccttcttcgaccgcacgtggcaggtggcgccgcggtcggatcgcatgggcctcaggcttcgcggcgagcccctgcgcgcgccgtcccggcagctcgcgagcgagccggtcgtgcccggcagcgtccaggtgccgcaggacggcctgcccattgtgctcatgcgcgagtgccagaccacgggcggttatcccaagcttgcgacggtcatctccgccgatctcgacaaattggcgcatctccgaccaggaagttcggtgcgctttgtggaagtgagtttcgaggaagccttcaggctgcggcgcgtgcatgaccgacttgccaaagtgtggctccggttcgtcgcggagcgagcgcggcaagcgtggggcagcgaaggaggggattga

SEQ ID NO: 629 - DNA, 1038 bp, Artificial
  Substituion in SEQ ID NO 614
atggccgctttggcgcgtacacatgagccaggtatcgcgcgcgtgcgcgtgttggcgccggggctctttacgaccgtgcaggatggagggcgcccgcatcaccgccacctgggcgtgccgctcgggggcgcgctcgacgtgttggcgttccgctcggccaatcggctggtgggaaacgccgaagattgcgcggcgctcgaggtgacgggcgcggggccgaagctcgcgtttgaggcgcccgccgccgttgcgctctgtggcgcggacttcctggcgtatgtggatggcgagccactgcccgtgcagcgcccggtctggctcggaggcggcgcggtgcttgagattcggaatgcccggcgcggatttcgcggctatttggccatccgcggcgggtttctcgtggagcaagtgctcgacagccggagcgcgctgccccgctacggcatcggcaagctcctggccgcgggagacgagatgacctatcagcctggacccgccgcgccgccggcgggtttccgcgccatctctcctcgcgcggccgtcgcgccgttccaggtcggcgggtggctggatcagatcgaggacgagatcgtcatcctgcgcgtggtgcggggcgagcaggcggattggttcgaacgtggctcgcggcgcgccttcttcgaccgcacgtggcaggtggcgccgcggtcggatcgcatgggcctcaggcttcgcggcgagcccctgcgcgcgccgtcccggcagctcgcgagcgagccggtcgtgcccggcagcgtccaggtgccgcaggacggcctgcccattgtgctcatgcgcgagtgccagaccacgggcggttatcccaagcttgcgacggtcatctccgccgatctcgacaaattggcgcatctccgaccaggaagttcggtgcgctttgtggaagtgagtttcgaggaagccttcaggctgcggcgcgtgcatgaccgacttgcccgcgtgtggctccggttcgtcgcggagcgagcgcggcaagcgtggggcagcgaaggaggggattga

SEQ ID NO: 630 - protein, 693 aa, Alicyclobacillus acidocaldarius
MCGEGRECLAGTAGGRVLGLPRYLAPARAGARRRAGAVSNHPRRGEGRALAPDQGRPPALVPGRRGDVRRADGARSRPHGAPRRSLAHTGLRRGQVAGSRPSRLREGAAGPRRDAICPGVCGRGGRPRARDLRPDLRGRRRAVGRSRLSVGPPILSAGGLARDEIGHIEPPLRVRLPHNLVGISPLAHHPLVHRLLDGVEARPLLGPREIRRVQADVVQHAIHVQESADGGELEEDEFVLVVAALAVRIALKTSDAQDGLRAVKARHEIRSVAKNVELVRKRTPAQDVIAHQAAAVFSPVLGVGGGDDRVGGSLVHGGGQFGEGRWREPVVAVQGDEVRRSHVRQRRLQRVAKALVFPERQHAHARVPQVAPRDLARSVRRSVIHDDEIPCRRGLCEHACDGHRQIARPVVHGEHHRHARLSPGAHGEPLLCAEHDAKIRYNECKSSRKAWESAVIEDKVRLEFMGVQALLLRLPEEVPIETGEALDRLLSLRAALLRELEGVDGIEDITIGYRSVAVYARFEDVSPDDVLARARRAIQGSQGSPVPATRPEAVVTLPVVYGGSFGPDLDAVAERAGLSPQDVIRLHQEAVYRVAMIGFSPGFAYLIGLPEPLRVPRRETPRSRVERGSVGIAGFQTGVYSFATPGGWQIIGRTPVALFDVHRPSPSLLSPGDEVRFEAVTEEEYHGRFGAYT

SEQ ID NO: 631 - DNA, 2082 bp, Alicyclobacillus acidocaldarius
ttgtgcggtgaaggccgtgagtgcttggctggaaccgcaggagggcgtgtcctggggctgccacgttacctggcgccggcgcgcgcgggtgcgcgaaggcgggcgggcgcggtatcaaaccacccgcggcgaggcgaaggacgcgcgctggctccagaccaagggcggccacctgctctcgttccaggacggcgaggcgatgtacgccgtgcggatggagcgcgatcgcgtcctcatggtgcgccgcggcgaagtctcgctcacacaggtcttcgccgcgggcaagtcgcaggatctcgtccttcgcgcctacgggaaggagctgccggtccgcgccgagacgcgatctgtccaggtgtctgtgggcgaggcgggaggccgcgcgcacgtgatcttcgacctgatctacgcggacgacgtagagcagtcggtcgatctcgtctttcagtgggtccgccgatcctgagcgccggcggactcgcgcgggacgagatcggccacatcgagccacccctccgggtgcgtcttccacacaatctcgtagggatctccccactcgcgcatcatccgctcgtacatcgccttcttgatggcgttgaggcgcgcccgctcctcgggccgcgtgagattcgccgcgtgcaggcggacgtggtacagcacgcgatccacgtgcaggaatcggccgatggcggcgagcttgaggaggatgagtttgtcctcgtagtagcggccctggccgtgcggatcgcgctcaaaacctccgacgcgcaggacggcctccgtgcggtaaaagcgcggcacgagatacggtccgtagcgaaaaacgtcgaacttgtccgaaaacgcacgcccgcgcaggacgtgatcgcgcatcaggcggccgctgtcttctcgccagtgctgggcgttggcggaggcgacgaccgcgtcggcgggtccctcgtccatggcggcggtcagttcggcgagggccgttggcgcgaaccagtcgtcgctgtccaaggtgacgaagtacggcgttcgcacgtgcggcagcgtcgcctgcagcgcgttgccaaggccctcgttttccccgagcgacaacacgcgcacgcgagggtcccacaggtagcgccgcgcgatctcgcccgatccgtccgtcgatccgtcatccacgacgacgagattccatgccggcgtggtctgtgcgaacacgcttgcgatggccatcggcaaatcgcgcgcccggttgtacacggcgagcaccaccgtcacgcgcggctctcccccggtgcacatggcgaacccctcctttgcgcggaacatgacgcgaagattcgatacaatgagtgtaaatcatcgcggaaggcgtgggaatcggccgtgatcgaagacaaggtgcgactggagttcatgggcgttcaggcgcttctcctgcgcctcccggaggaagtccccatcgagacgggtgaggcgctcgacaggcttctgtctttgcgagcggcgcttttgcgagagctcgaaggcgtagatggaattgaagacatcaccattggctatcgatccgtcgcggtctacgcgcgcttcgaagacgtgtccccggacgatgtgctggcgcgcgcccgccgcgcgattcaggggtcacagggctcgccggtgcctgcgacgaggccggaggcagtcgtcacgctgccggtggtctacggcggttccttcggcccggacctggatgcggtggccgaacgcgccggactttcgccgcaggacgtgatccgccttcatcaggaggcggtctaccgcgtggcgatgatcggattttcgccggggttcgcctatctcatcggcttgccggaaccgctccgcgtgccgcgccgcgagaccccgcgaagccgggtcgaacggggctcggttgggatcgcgggctttcagaccggggtgtattcgttcgcgacacctggggggtggcagatcatcggccgcacgccggtcgcgctgtttgacgtgcaccgcccttcgccgagccttctttcgccgggcgacgaggtgcggtttgaagcggtgacggaggaggaataccatggccgctttggcgcgtacacatga

SEQ ID NO: 632 - protein, 180 aa, Geobacillus thermodenitrificans NG80-2
EGIKEIVPAFSSLTVYYDPVVAGNYADVCAWLRENIGSTGQAARHSTRTIVIPVCYGGEFGPDLADVARFHGMTEDEVVALHSSGRYRVYMIGFSPGFAYLGGLSPRLATPRRPVPRTTVPAGSVGIAGGQTGVYPLATPGGWQLIGRTPLRLFDPHREKPSLLSAGDIVEFRRITAEEF

SEQ ID NO: 633 - protein, 174 aa, Bacillus coagulans 36D1
VTVLYDPFKVYAKFGEYPYRYVSRYFTRLLEKAQPAFIPEPRTVDIPVCYGGEFGPDLENVARINDLTPEEVIRIHASGDYTVYMIGFAPGFPYIGGMPEKIAAPRKKTPRLKIPERSVGIAGKQTGIYPIETPGGWQIIGRTPVKLFRPDRDGPSLLQAGDKIRFRPVSLEEY

SEQ ID NO: 634 - protein, 179 aa, Geobacillus kaustophilus HTA426
EGIEEIVPAFSSLTIYYDPLVIDYIGIGAWLRKNIRRSEQAVRRSARTVVIPVCYGGEFGPDLPDVARFHGMTEDEVIALHSAGRYRVYMIGFSPGFAYLGGLSPRLATPRRSVPRTKVPAGSVGIAGGQTGVYPLATPGGWQLIGRTPLKLFDPHREKPSLLAAGDIVAFQPIGADEF

SEQ ID NO: 635 - protein, 136 aa, Pedobacter sp. BAL39
PTEVVEIPVIYGGEYGPDLDVVAQHTGLSVAEVIRRHSDVEYLVYMIGFTPGFPYLGGMDPALAVPRKDSPRAKIASGAVGIAGQQTGIYPMESPGGWQIIGRTAADLFDRNRNPPALLKAGDRLRFVSITEDNYH

SEQ ID NO: 636 - protein, 186 aa, Bacillus licheniformis ATCC 14580
VPAFTSVTVFYQPFEVYRKMESGKAVDSPYEKVKALLDHHLQELTMEEETDQRTVEIPVCYGGRFGPDLEEVADINGLTAQEVIDIHTSGEYLVYMIGFAPGFPYLGGMSEKIAAPRRSSPRTSIPAGSVGIAGMQTGVYPLSTPGGWQLIGNTPLELFKPYEQPPSLLRAGDIVKFVSVTEEEYH

SEQ ID NO: 637 - protein, 693 aa, Artificial
  Substituion in SEQ ID NO 630
MCGEGRECLAGTAGGRVLGLPRYLAPARAGARRRAGAVSNHPRRGEGRALAPDQGRPPALVPGRRGDVRRADGARSRPHGAPRRSLAHTGLRRGQVAGSRPSRLREGAAGPRRDAICPGVCGRGGRPRARDLRPDLRGRRRAVGRSRLSVGPPILSAGGLARDEIGHIEPPLRVRLPHNLVGISPLAHHPLVHRLLDGVEARPLLGPREIRRVQADVVQHAIHVQESADGGELEEDEFVLVVAALAVRIALKTSDAQDGLRAVKARHEIRSVAKNVELVRKRTPAQDVIAHQAAAVFSPVLGVGGGDDRVGGSLVHGGGQFGEGRWREPVVAVQGDEVRRSHVRQRRLQRVAKALVFPERQHAHARVPQVAPRDLARSVRRSVIHDDEIPCRRGLCEHACDGHRQIARPVVHGEHHRHARLSPGAHGEPLLCAEHDAKIRYNECKSSRKAWESAVIEDKVRLEFMGVQALLLRIPEEVPIETGEALDRLLSLRAALLRELEGVDGIEDITIGYRSVAVYARFEDVSPDDVLARARRAIQGSQGSPVPATRPEAVVTLPVVYGGSFGPDLDAVAERAGLSPQDVIRLHQEAVYRVAMIGFSPGFAYLIGLPEPLRVPRRETPRSRVERGSVGIAGFQTGVYSFATPGGWQIIGRTPVALFDVHRPSPSLLSPGDEVRFEAVTEEEYHGRFGAYT

SEQ ID NO: 638 - protein, 693 aa, Artificial
  Substituion in SEQ ID NO 630
MCGEGRECLAGTAGGRVLGLPRYLAPARAGARRRAGAVSNHPRRGEGRALAPDQGRPPALVPGRRGDVRRADGARSRPHGAPRRSLAHTGLRRGQVAGSRPSRLREGAAGPRRDAICPGVCGRGGRPRARDLRPDLRGRRRAVGRSRLSVGPPILSAGGLARDEIGHIEPPLRVRLPHNLVGISPLAHHPLVHRLLDGVEARPLLGPREIRRVQADVVQHAIHVQESADGGELEEDEFVLVVAALAVRLALKTSDAQDGLRAVKARHEIRSVAKNVELVRKRTPAQDVIAHQAAAVFSPVLGVGGGDDRVGGSLVHGGGQFGEGRWREPVVAVQGDEVRRSHVRQRRLQRVAKALVFPERQHAHARVPQVAPRDLARSVRRSVIHDDEIPCRRGLCEHACDGHRQIARPVVHGEHHRHARLSPGAHGEPLLCAEHDAKIRYNECKSSRKAWESAVIEDKVRLEFMGVQALLLRLPEEVPIETGEALDRLLSLRAALLRELEGVDGIEDITIGYRSVAVYARFEDVSPDDVLARARRAIQGSQGSPVPATRPEAVVTLPVVYGGSFGPDLDAVAERAGLSPQDVIRLHQEAVYRVAMIGFSPGFAYLIGLPEPLRVPRRETPRSRVERGSVGIAGFQTGVYSFATPGGWQIIGRTPVALFDVHRPSPSLLSPGDEVRFEAVTEEEYHGRFGAYT

SEQ ID NO: 639 - protein, 693 aa, Artificial
  Substituion in SEQ ID NO 630
MCGEGRECLAGTAGGRVLGLPRYLAPARAGARRRAGAVSNHPRRGEGRALAPDQGRPPALVPGRRGDVRRADGARSRPHGAPRRSLAHTGLRRGQVAGSRPSRLREGAAGPRRDAICPGVCGRGGRPRARDLRPDLRGRRRAVGRSRLSVGPPILSAGGLARDEIGHIEPPLRVRLPHNLVGISPLAHHPLVHRLLDGVEARPLLGPREIRRVQADVVQHAIHVQESADGGELEEDEFVLVVAALAVRIALKTSDAQDGLRAVKARHEIRSVAKNVELVRKRTPAQDVIAHQAAAVFSPVLGVGGGDDRVGGSLVHGGGQFGEGRWREPVVAVQGDEVRRSHVRQRRLQRVAKALVFPERQHAHARVPQVAPRDLARSVRRSVIHDDEIPCRRGLCEHACDGHRQIARPVVHGEHHRHARLSPGAHGEPLLCAEHDAKIRYNECKSSRKAWESAVIEDKVRLEFMGVQALLLRLPEEVPIETGEALDRLLSLRAALLRELEGVDGIEDITIGYRSVAVYARFEDVSPDDVLARARRAIQGSQGSPVPATRPEAVVTIPVVYGGSFGPDLDAVAERAGLSPQDVIRLHQEAVYRVAMIGFSPGFAYLIGLPEPLRVPRRETPRSRVERGSVGIAGFQTGVYSFATPGGWQIIGRTPVALFDVHRPSPSLLSPGDEVRFEAVTEEEYHGRFGAYT

SEQ ID NO: 640 - protein, 693 aa, Artificial
  Substituion in SEQ ID NO 630
MCGEGRECLAGTAGGRVLGLPRYLAPARAGARRRAGAVSNHPRRGEGRALAPDQGRPPALVPGRRGDVRRADGARSRPHGAPRRSLAHTGLRRGQVAGSRPSRLREGAAGPRRDAICPGVCGRGGRPRARDLRPDLRGRRRAVGRSRLSIGPPILSAGGLARDEIGHIEPPLRVRLPHNLVGISPLAHHPLVHRLLDGVEARPLLGPREIRRVQADVVQHAIHVQESADGGELEEDEFVLVVAALAVRIALKTSDAQDGLRAVKARHEIRSVAKNVELVRKRTPAQDVIAHQAAAVFSPVLGVGGGDDRVGGSLVHGGGQFGEGRWREPVVAVQGDEVRRSHVRQRRLQRVAKALVFPERQHAHARVPQVAPRDLARSVRRSVIHDDEIPCRRGLCEHACDGHRQIARPVVHGEHHRHARLSPGAHGEPLLCAEHDAKIRYNECKSSRKAWESAVIEDKVRLEFMGVQALLLRLPEEVPIETGEALDRLLSLRAALLRELEGVDGIEDITIGYRSVAVYARFEDVSPDDVLARARRAIQGSQGSPVPATRPEAVVTLPVVYGGSFGPDLDAVAERAGLSPQDVIRLHQEAVYRVAMIGFSPGFAYLIGLPEPLRVPRRETPRSRVERGSVGIAGFQTGVYSFATPGGWQIIGRTPVALFDVHRPSPSLLSPGDEVRFEAVTEEEYHGRFGAYT

SEQ ID NO: 641 - protein, 693 aa, Artificial
  Substituion in SEQ ID NO 630
MCGEGRECLAGTAGGRVLGLPRYLAPARAGARRRAGAVSNHPRRGEGRALAPDQGRPPALVPGRRGDVRRADGARSRPHGAPRRSLAHTGLRRGQVAGSRPSRLREGAAGPRRDAICPGVCGRGGRPRARDLRPDLRGRRRAVGRSRLSVGPPILSAGGLARDELGHIEPPLRVRLPHNLVGISPLAHHPLVHRLLDGVEARPLLGPREIRRVQADVVQHAIHVQESADGGELEEDEFVLVVAALAVRIALKTSDAQDGLRAVKARHEIRSVAKNVELVRKRTPAQDVIAHQAAAVFSPVLGVGGGDDRVGGSLVHGGGQFGEGRWREPVVAVQGDEVRRSHVRQRRLQRVAKALVFPERQHAHARVPQVAPRDLARSVRRSVIHDDEIPCRRGLCEHACDGHRQIARPVVHGEHHRHARLSPGAHGEPLLCAEHDAKIRYNECKSSRKAWESAVIEDKVRLEFMGVQALLLRLPEEVPIETGEALDRLLSLRAALLRELEGVDGIEDITIGYRSVAVYARFEDVSPDDVLARARRAIQGSQGSPVPATRPEAVVTLPVVYGGSFGPDLDAVAERAGLSPQDVIRLHQEAVYRVAMIGFSPGFAYLIGLPEPLRVPRRETPRSRVERGSVGIAGFQTGVYSFATPGGWQIIGRTPVALFDVHRPSPSLLSPGDEVRFEAVTEEEYHGRFGAYT

SEQ ID NO: 642 - DNA, 2082 bp, Artificial
  Substituion in SEQ ID NO 631
ttgtgcggtgaaggccgtgagtgcttggctggaaccgcaggagggcgtgtcctggggctgccacgttacctggcgccggcgcgcgcgggtgcgcgaaggcgggcgggcgcggtatcaaaccacccgcggcgaggcgaaggacgcgcgctggctccagaccaagggcggccacctgctctcgttccaggacggcgaggcgatgtacgccgtgcggatggagcgcgatcgcgtcctcatggtgcgccgcggcgaagtctcgctcacacaggtcttcgccgcgggcaagtcgcaggatctcgtccttcgcgcctacgggaaggagctgccggtccgcgccgagacgcgatctgtccaggtgtctgtgggcgaggcgggaggccgcgcgcacgtgatcttcgacctgatctacgcggacgacgtagagcagtcggtcgatctcgtctttcagtgggtccgccgatcctgagcgccggcggactcgcgcgggacgagatcggccacatcgagccacccctccgggtgcgtcttccacacaatctcgtagggatctccccactcgcgcatcatccgctcgtacatcgccttcttgatggcgttgaggcgcgcccgctcctcgggccgcgtgagattcgccgcgtgcaggcggacgtggtacagcacgcgatccacgtgcaggaatcggccgatggcggcgagcttgaggaggatgagtttgtcctcgtagtagcggccctggccgtgcggatcgcgctcaaaacctccgacgcgcaggacggcctccgtgcggtaaaagcgcggcacgagatacggtccgtagcgaaaaacgtcgaacttgtccgaaaacgcacgcccgcgcaggacgtgatcgcgcatcaggcggccgctgtcttctcgccagtgctgggcgttggcggaggcgacgaccgcgtcggcgggtccctcgtccatggcggcggtcagttcggcgagggccgttggcgcgaaccagtcgtcgctgtccaaggtgacgaagtacggcgttcgcacgtgcggcagcgtcgcctgcagcgcgttgccaaggccctcgttttccccgagcgacaacacgcgcacgcgagggtcccacaggtagcgccgcgcgatctcgcccgatccgtccgtcgatccgtcatccacgacgacgagattccatgccggcgtggtctgtgcgaacacgcttgcgatggccatcggcaaatcgcgcgcccggttgtacacggcgagcaccaccgtcacgcgcggctctcccccggtgcacatggcgaacccctcctttgcgcggaacatgacgcgaagattcgatacaatgagtgtaaatcatcgcggaaggcgtgggaatcggccgtgatcgaagacaaggtgcgactggagttcatgggcgttcaggcgcttctcctgcgcattccggaggaagtccccatcgagacgggtgaggcgctcgacaggcttctgtctttgcgagcggcgcttttgcgagagctcgaaggcgtagatggaattgaagacatcaccattggctatcgatccgtcgcggtctacgcgcgcttcgaagacgtgtccccggacgatgtgctggcgcgcgcccgccgcgcgattcaggggtcacagggctcgccggtgcctgcgacgaggccggaggcagtcgtcacgctgccggtggtctacggcggttccttcggcccggacctggatgcggtggccgaacgcgccggactttcgccgcaggacgtgatccgccttcatcaggaggcggtctaccgcgtggcgatgatcggattttcgccggggttcgcctatctcatcggcttgccggaaccgctccgcgtgccgcgccgcgagaccccgcgaagccgggtcgaacggggctcggttgggatcgcgggctttcagaccggggtgtattcgttcgcgacacctggggggtggcagatcatcggccgcacgccggtcgcgctgtttgacgtgcaccgcccttcgccgagccttctttcgccgggcgacgaggtgcggtttgaagcggtgacggaggaggaataccatggccgctttggcgcgtacacatga

SEQ ID NO: 643 - DNA, 2082 bp, Artificial
  Substituion in SEQ ID NO 631
ttgtgcggtgaaggccgtgagtgcttggctggaaccgcaggagggcgtgtcctggggctgccacgttacctggcgccggcgcgcgcgggtgcgcgaaggcgggcgggcgcggtatcaaaccacccgcggcgaggcgaaggacgcgcgctggctccagaccaagggcggccacctgctctcgttccaggacggcgaggcgatgtacgccgtgcggatggagcgcgatcgcgtcctcatggtgcgccgcggcgaagtctcgctcacacaggtcttcgccgcgggcaagtcgcaggatctcgtccttcgcgcctacgggaaggagctgccggtccgcgccgagacgcgatctgtccaggtgtctgtgggcgaggcgggaggccgcgcgcacgtgatcttcgacctgatctacgcggacgacgtagagcagtcggtcgatctcgtctttcagtgggtccgccgatcctgagcgccggcggactcgcgcgggacgagatcggccacatcgagccacccctccgggtgcgtcttccacacaatctcgtagggatctccccactcgcgcatcatccgctcgtacatcgccttcttgatggcgttgaggcgcgcccgctcctcgggccgcgtgagattcgccgcgtgcaggcggacgtggtacagcacgcgatccacgtgcaggaatcggccgatggcggcgagcttgaggaggatgagtttgtcctcgtagtagcggccctggccgtgcggttagcgctcaaaacctccgacgcgcaggacggcctccgtgcggtaaaagcgcggcacgagatacggtccgtagcgaaaaacgtcgaacttgtccgaaaacgcacgcccgcgcaggacgtgatcgcgcatcaggcggccgctgtcttctcgccagtgctgggcgttggcggaggcgacgaccgcgtcggcgggtccctcgtccatggcggcggtcagttcggcgagggccgttggcgcgaaccagtcgtcgctgtccaaggtgacgaagtacggcgttcgcacgtgcggcagcgtcgcctgcagcgcgttgccaaggccctcgttttccccgagcgacaacacgcgcacgcgagggtcccacaggtagcgccgcgcgatctcgcccgatccgtccgtcgatccgtcatccacgacgacgagattccatgccggcgtggtctgtgcgaacacgcttgcgatggccatcggcaaatcgcgcgcccggttgtacacggcgagcaccaccgtcacgcgcggctctcccccggtgcacatggcgaacccctcctttgcgcggaacatgacgcgaagattcgatacaatgagtgtaaatcatcgcggaaggcgtgggaatcggccgtgatcgaagacaaggtgcgactggagttcatgggcgttcaggcgcttctcctgcgcctcccggaggaagtccccatcgagacgggtgaggcgctcgacaggcttctgtctttgcgagcggcgcttttgcgagagctcgaaggcgtagatggaattgaagacatcaccattggctatcgatccgtcgcggtctacgcgcgcttcgaagacgtgtccccggacgatgtgctggcgcgcgcccgccgcgcgattcaggggtcacagggctcgccggtgcctgcgacgaggccggaggcagtcgtcacgctgccggtggtctacggcggttccttcggcccggacctggatgcggtggccgaacgcgccggactttcgccgcaggacgtgatccgccttcatcaggaggcggtctaccgcgtggcgatgatcggattttcgccggggttcgcctatctcatcggcttgccggaaccgctccgcgtgccgcgccgcgagaccccgcgaagccgggtcgaacggggctcggttgggatcgcgggctttcagaccggggtgtattcgttcgcgacacctggggggtggcagatcatcggccgcacgccggtcgcgctgtttgacgtgcaccgcccttcgccgagccttctttcgccgggcgacgaggtgcggtttgaagcggtgacggaggaggaataccatggccgctttggcgcgtacacatga

SEQ ID NO: 644 - DNA, 2082 bp, Artificial
  Substituion in SEQ ID NO 631
ttgtgcggtgaaggccgtgagtgcttggctggaaccgcaggagggcgtgtcctggggctgccacgttacctggcgccggcgcgcgcgggtgcgcgaaggcgggcgggcgcggtatcaaaccacccgcggcgaggcgaaggacgcgcgctggctccagaccaagggcggccacctgctctcgttccaggacggcgaggcgatgtacgccgtgcggatggagcgcgatcgcgtcctcatggtgcgccgcggcgaagtctcgctcacacaggtcttcgccgcgggcaagtcgcaggatctcgtccttcgcgcctacgggaaggagctgccggtccgcgccgagacgcgatctgtccaggtgtctgtgggcgaggcgggaggccgcgcgcacgtgatcttcgacctgatctacgcggacgacgtagagcagtcggtcgatctcgtctttcagtgggtccgccgatcctgagcgccggcggactcgcgcgggacgagatcggccacatcgagccacccctccgggtgcgtcttccacacaatctcgtagggatctccccactcgcgcatcatccgctcgtacatcgccttcttgatggcgttgaggcgcgcccgctcctcgggccgcgtgagattcgccgcgtgcaggcggacgtggtacagcacgcgatccacgtgcaggaatcggccgatggcggcgagcttgaggaggatgagtttgtcctcgtagtagcggccctggccgtgcggatcgcgctcaaaacctccgacgcgcaggacggcctccgtgcggtaaaagcgcggcacgagatacggtccgtagcgaaaaacgtcgaacttgtccgaaaacgcacgcccgcgcaggacgtgatcgcgcatcaggcggccgctgtcttctcgccagtgctgggcgttggcggaggcgacgaccgcgtcggcgggtccctcgtccatggcggcggtcagttcggcgagggccgttggcgcgaaccagtcgtcgctgtccaaggtgacgaagtacggcgttcgcacgtgcggcagcgtcgcctgcagcgcgttgccaaggccctcgttttccccgagcgacaacacgcgcacgcgagggtcccacaggtagcgccgcgcgatctcgcccgatccgtccgtcgatccgtcatccacgacgacgagattccatgccggcgtggtctgtgcgaacacgcttgcgatggccatcggcaaatcgcgcgcccggttgtacacggcgagcaccaccgtcacgcgcggctctcccccggtgcacatggcgaacccctcctttgcgcggaacatgacgcgaagattcgatacaatgagtgtaaatcatcgcggaaggcgtgggaatcggccgtgatcgaagacaaggtgcgactggagttcatgggcgttcaggcgcttctcctgcgcctcccggaggaagtccccatcgagacgggtgaggcgctcgacaggcttctgtctttgcgagcggcgcttttgcgagagctcgaaggcgtagatggaattgaagacatcaccattggctatcgatccgtcgcggtctacgcgcgcttcgaagacgtgtccccggacgatgtgctggcgcgcgcccgccgcgcgattcaggggtcacagggctcgccggtgcctgcgacgaggccggaggcagtcgtcacgattccggtggtctacggcggttccttcggcccggacctggatgcggtggccgaacgcgccggactttcgccgcaggacgtgatccgccttcatcaggaggcggtctaccgcgtggcgatgatcggattttcgccggggttcgcctatctcatcggcttgccggaaccgctccgcgtgccgcgccgcgagaccccgcgaagccgggtcgaacggggctcggttgggatcgcgggctttcagaccggggtgtattcgttcgcgacacctggggggtggcagatcatcggccgcacgccggtcgcgctgtttgacgtgcaccgcccttcgccgagccttctttcgccgggcgacgaggtgcggtttgaagcggtgacggaggaggaataccatggccgctttggcgcgtacacatga

SEQ ID NO: 645 - DNA, 2082 bp, Artificial
  Substituion in SEQ ID NO 631
ttgtgcggtgaaggccgtgagtgcttggctggaaccgcaggagggcgtgtcctggggctgccacgttacctggcgccggcgcgcgcgggtgcgcgaaggcgggcgggcgcggtatcaaaccacccgcggcgaggcgaaggacgcgcgctggctccagaccaagggcggccacctgctctcgttccaggacggcgaggcgatgtacgccgtgcggatggagcgcgatcgcgtcctcatggtgcgccgcggcgaagtctcgctcacacaggtcttcgccgcgggcaagtcgcaggatctcgtccttcgcgcctacgggaaggagctgccggtccgcgccgagacgcgatctgtccaggtgtctgtgggcgaggcgggaggccgcgcgcacgtgatcttcgacctgatctacgcggacgacgtagagcagtcggtcgatctcgtctttcaattggtccgccgatcctgagcgccggcggactcgcgcgggacgagatcggccacatcgagccacccctccgggtgcgtcttccacacaatctcgtagggatctccccactcgcgcatcatccgctcgtacatcgccttcttgatggcgttgaggcgcgcccgctcctcgggccgcgtgagattcgccgcgtgcaggcggacgtggtacagcacgcgatccacgtgcaggaatcggccgatggcggcgagcttgaggaggatgagtttgtcctcgtagtagcggccctggccgtgcggatcgcgctcaaaacctccgacgcgcaggacggcctccgtgcggtaaaagcgcggcacgagatacggtccgtagcgaaaaacgtcgaacttgtccgaaaacgcacgcccgcgcaggacgtgatcgcgcatcaggcggccgctgtcttctcgccagtgctgggcgttggcggaggcgacgaccgcgtcggcgggtccctcgtccatggcggcggtcagttcggcgagggccgttggcgcgaaccagtcgtcgctgtccaaggtgacgaagtacggcgttcgcacgtgcggcagcgtcgcctgcagcgcgttgccaaggccctcgttttccccgagcgacaacacgcgcacgcgagggtcccacaggtagcgccgcgcgatctcgcccgatccgtccgtcgatccgtcatccacgacgacgagattccatgccggcgtggtctgtgcgaacacgcttgcgatggccatcggcaaatcgcgcgcccggttgtacacggcgagcaccaccgtcacgcgcggctctcccccggtgcacatggcgaacccctcctttgcgcggaacatgacgcgaagattcgatacaatgagtgtaaatcatcgcggaaggcgtgggaatcggccgtgatcgaagacaaggtgcgactggagttcatgggcgttcaggcgcttctcctgcgcctcccggaggaagtccccatcgagacgggtgaggcgctcgacaggcttctgtctttgcgagcggcgcttttgcgagagctcgaaggcgtagatggaattgaagacatcaccattggctatcgatccgtcgcggtctacgcgcgcttcgaagacgtgtccccggacgatgtgctggcgcgcgcccgccgcgcgattcaggggtcacagggctcgccggtgcctgcgacgaggccggaggcagtcgtcacgctgccggtggtctacggcggttccttcggcccggacctggatgcggtggccgaacgcgccggactttcgccgcaggacgtgatccgccttcatcaggaggcggtctaccgcgtggcgatgatcggattttcgccggggttcgcctatctcatcggcttgccggaaccgctccgcgtgccgcgccgcgagaccccgcgaagccgggtcgaacggggctcggttgggatcgcgggctttcagaccggggtgtattcgttcgcgacacctggggggtggcagatcatcggccgcacgccggtcgcgctgtttgacgtgcaccgcccttcgccgagccttctttcgccgggcgacgaggtgcggtttgaagcggtgacggaggaggaataccatggccgctttggcgcgtacacatga

SEQ ID NO: 646 - DNA, 2082 bp, Artificial
  Substituion in SEQ ID NO 631
ttgtgcggtgaaggccgtgagtgcttggctggaaccgcaggagggcgtgtcctggggctgccacgttacctggcgccggcgcgcgcgggtgcgcgaaggcgggcgggcgcggtatcaaaccacccgcggcgaggcgaaggacgcgcgctggctccagaccaagggcggccacctgctctcgttccaggacggcgaggcgatgtacgccgtgcggatggagcgcgatcgcgtcctcatggtgcgccgcggcgaagtctcgctcacacaggtcttcgccgcgggcaagtcgcaggatctcgtccttcgcgcctacgggaaggagctgccggtccgcgccgagacgcgatctgtccaggtgtctgtgggcgaggcgggaggccgcgcgcacgtgatcttcgacctgatctacgcggacgacgtagagcagtcggtcgatctcgtctttcagtgggtccgccgatcctgagcgccggcggactcgcgcgggacgagttaggccacatcgagccacccctccgggtgcgtcttccacacaatctcgtagggatctccccactcgcgcatcatccgctcgtacatcgccttcttgatggcgttgaggcgcgcccgctcctcgggccgcgtgagattcgccgcgtgcaggcggacgtggtacagcacgcgatccacgtgcaggaatcggccgatggcggcgagcttgaggaggatgagtttgtcctcgtagtagcggccctggccgtgcggatcgcgctcaaaacctccgacgcgcaggacggcctccgtgcggtaaaagcgcggcacgagatacggtccgtagcgaaaaacgtcgaacttgtccgaaaacgcacgcccgcgcaggacgtgatcgcgcatcaggcggccgctgtcttctcgccagtgctgggcgttggcggaggcgacgaccgcgtcggcgggtccctcgtccatggcggcggtcagttcggcgagggccgttggcgcgaaccagtcgtcgctgtccaaggtgacgaagtacggcgttcgcacgtgcggcagcgtcgcctgcagcgcgttgccaaggccctcgttttccccgagcgacaacacgcgcacgcgagggtcccacaggtagcgccgcgcgatctcgcccgatccgtccgtcgatccgtcatccacgacgacgagattccatgccggcgtggtctgtgcgaacacgcttgcgatggccatcggcaaatcgcgcgcccggttgtacacggcgagcaccaccgtcacgcgcggctctcccccggtgcacatggcgaacccctcctttgcgcggaacatgacgcgaagattcgatacaatgagtgtaaatcatcgcggaaggcgtgggaatcggccgtgatcgaagacaaggtgcgactggagttcatgggcgttcaggcgcttctcctgcgcctcccggaggaagtccccatcgagacgggtgaggcgctcgacaggcttctgtctttgcgagcggcgcttttgcgagagctcgaaggcgtagatggaattgaagacatcaccattggctatcgatccgtcgcggtctacgcgcgcttcgaagacgtgtccccggacgatgtgctggcgcgcgcccgccgcgcgattcaggggtcacagggctcgccggtgcctgcgacgaggccggaggcagtcgtcacgctgccggtggtctacggcggttccttcggcccggacctggatgcggtggccgaacgcgccggactttcgccgcaggacgtgatccgccttcatcaggaggcggtctaccgcgtggcgatgatcggattttcgccggggttcgcctatctcatcggcttgccggaaccgctccgcgtgccgcgccgcgagaccccgcgaagccgggtcgaacggggctcggttgggatcgcgggctttcagaccggggtgtattcgttcgcgacacctggggggtggcagatcatcggccgcacgccggtcgcgctgtttgacgtgcaccgcccttcgccgagccttctttcgccgggcgacgaggtgcggtttgaagcggtgacggaggaggaataccatggccgctttggcgcgtacacatga

SEQ ID NO: 647 - protein, 357 aa, Alicyclobacillus acidocaldarius
MIAGQDGGGGAPPPFAWERRHSVPKRATIQDVARAAGVSVTTVSRYLNGRYESMSENTREKIAAVIAELGYRPNALAKGLKAQRTETVGAIVVNMSYPFCVGFLRAFSRTLSAAGYHLMVAESEGDAKRERQLIESFVANRVEAIALQTSGANNDYLEDLAREMPVVLVDRAFALRNAYAIGTNNRDASREIAWQLFDLGYDCVVYLTEDERGIPTRTDRLEGYLDACRVALREPVVMRVRRGDPASFREALARVDACARKERTAVYTANGLVLMECYRPLRALGHKVPDAMGIATFDQPDWADLVDPPLTCVRQPVEEMGEAAGRIITARLRGEAVAAEVLVVPSTVVMRGSTGRG

SEQ ID NO: 648 - DNA, 1074 bp, Alicyclobacillus acidocaldarius
gtgatcgcaggccaggacggcggtggcggcgcgccaccgccttttgcatgggagaggaggcacagcgtgccaaagcgggccaccatccaggacgtcgcgcgagcggccggggtgtcggtcaccacggtgtcgcggtacttgaacgggcgctacgagtccatgagcgagaatacgcgagagaagattgccgcggtcatcgcggaactcggctatcggcccaacgcgctcgccaaggggctgaaggcgcagcggacggagaccgtgggcgcgattgtggtcaacatgagctatccgttttgcgtcggctttctccgcgcgttctcgcggacgctcagcgctgccgggtaccacctcatggtggccgagtccgagggcgacgcaaaacgggagcgacagctcatcgagtcgtttgttgccaaccgcgtggaggccatcgcgctgcagacgagtggagccaacaacgactacctggaggatttggcgcgcgagatgccggtggtgttggtcgatcgcgccttcgccctgcggaacgcgtacgccatcggcaccaacaaccgcgacgcttcgcgcgagatcgcgtggcagctgttcgacctcggctacgactgcgtggtctatctgacggaggacgagcgcgggatccccacgcggacggatcgcctggaagggtatctggacgcatgccgcgtggcgctccgggagcccgtggtgatgcgcgtgcggcgcggcgatccggcttccttccgcgaagcgctcgcccgtgtggacgcctgtgcgcgcaaggagcgcaccgccgtgtacaccgcgaatggcctcgtgctgatggaatgctatcggccgctccgggcgctcggccacaaggtgccggatgccatgggcattgccaccttcgaccagccggactgggccgatctcgtcgatccgcccttgacctgcgtccgtcagcccgtggaggagatgggcgaagcggcagggcggatcatcaccgcccgcctgcggggggaagcggtagctgcggaggtcctcgttgtgccgtccaccgtcgtgatgagggggtcgacggggcggggataa

SEQ ID NO: 649 - protein, 328 aa, Bacillus pumilus SAFR-032
KVTINEVAAYAGVSKSTVSRYINGRTNEISIEKVKKIKKAIEELHYRPSQLAQGLKVRKSKVIGFIVADITNPFSVATLRGVEEICDEYGYSIMVCNTDNRPEKEREMLLKLNAHYIEGLIINTTGQNNDILQDFQKDGVPIVLVDRKLSELKVDTVTTNNRDITIQLLQQMYEKSYEHIAFFTEPVDGISPREERKEAYEQTAMSKHKKPIIKEIDLKQKEQLREELVHFVQTNQQKKAILAANGLLMLKLISELVELGLKIPEDIGVAGFDDTEWYKLIGPGITTVAQPSHEMGKAAMQKIKTRLEGDESAPQTIQLDGEIIVRKS

SEQ ID NO: 650 - protein, 333 aa, Thermosinus carboxydivorans Nor1
TIRDVAQQAGVSKSTISRYLNGRYECMSLETRERIARVIAELDYRPNAVARSLKQKRTHTVGAIVANILNPFSTSIIRGVEDHCKKHGFNLILCNADDDPVKEREYIEMLTAKQIDGLIINTTGGNNPLVKEVNASVPVVLIDRKAPEMGLDTVTVDSDLGARLAIGHLVGLGHRRIAMFTLPCDQVSPRLERVRGYQAALAEYNIPFRPELLVETDTQLETVIAKVRELLTRAPGERPTAIFGANNLMTMAIVKALKRLGVAIPRDMAVIGFDDWEWAELIDPPITVVAQPVYDMGVKAAAVLIKRIKAGKPPKKPATVVFAPQLVVRASCG

SEQ ID NO: 651 - protein, 333 aa, Clostridium acetobutylicum ATCC 824
KKVVIDDVAKLAGVSKATISRYLNGKFEYMSEKTKDRIKESIEELNYRPNNIARSLKSNKSKLIGVVIADLTNPFSSIIIKGIGDECKARGYNMVIANSDNDVKQEEEYIKSLLDQRVEGIIVNSTGYNEEFLLSIKERGIPVSMVDRTFCEDKVDSVKSNNYDITVETINYLIDAGFNSLCFFTERLDNIKPRIERERAFIDVCSKRLKKENYNISVVDYSKAGNLEVNIYKFLNNYSGKKAIFAVNGVVLLHTLSAINKLNINVPKDLGICGYDNWGWAALIPPGITTISQPSYEMGSEAAKLVLDRIEGKASLGAVCKTLSAKLEIRGST

SEQ ID NO: 652 - protein, 330 aa, Bacillus licheniformis ATCC 14580
KVTINEVAAHAGVSKSTVSRYINGKIDAISPKKVKSIKKAIEELNYRPSQMAQGLKVKKSKVIGFLVADITNPFSVATLRGVEEVCDQYGYSIMVCNTDNSPEKEREMLHKLNAHYIEGLIINTTGRNNDVLLDLISQDVSIVLVDRKVPGLKIDAVTTNNREVTSQIVNLMYDKGYAQVGLFTEPIKGISPREERASAYTEIALERNAGGTPLVYEADVKDKESLLQSVKSFLEMKEGKKAILGNNGLLMLKIISCLYELGISIPEDVGIAGFDDTEWYKLIGPGITTIAQPSHEMGRVAMERIIKRIEGDESAPQTIQLEAELVLRQS

SEQ ID NO: 653 - protein, 335 aa, Ralstonia eutropha H16
EKLTIQDVADYAGVSKATVSRYLNRGGEQLSADVEARVAAAIRALGYSPSPMAQGLKRGKSRLIGLVVADVSNSFSVAVLRGVEKACRDAGYMVMLFNLGNDEQLEREAIRSLSAYRVEGFILHTLGHDAGALADAAQLGKPVVLVDRKVGDAEVDLVALDNQTAVQEAAGHLVEAGYRRLLFISEPIKAISSRNERARAFQAFVAEHVDTVGGTVFEAQRGDDDALDEALRALRRGAGQAPVAVLAANAVISLRVAASAARLGWQLGADLGLIGFDDPEWAALVGPGLSAISQPTDDIGRVATNCLIERLQGTQLPPRRVLLPGTLVTRGSTRR

SEQ ID NO: 654 - protein, 357 aa, Artificial
  Substituion in SEQ ID NO 647
MIAGQDGGGGAPPPFAWERRHSVPKRATIQDVARAAGVSVTTVSRYLNGRYESMSENTREKIAAVIAELGYRPNALAKGLKAQRTETVGAIVVNMSYPFCVGFLRAFSRTLSAAGYHLMVAESEGDAKKERQLIESFVANRVEAIALQTSGANNDYLEDLAREMPVVLVDRAFALRNAYAIGTNNRDASREIAWQLFDLGYDCVVYLTEDERGIPTRTDRLEGYLDACRVALREPVVMRVRRGDPASFREALARVDACARKERTAVYTANGLVLMECYRPLRALGHKVPDAMGIATFDQPDWADLVDPPLTCVRQPVEEMGEAAGRIITARLRGEAVAAEVLVVPSTVVMRGSTGRG

SEQ ID NO: 655 - protein, 357 aa, Artificial
  Substituion in SEQ ID NO 647
MIAGQDGGGGAPPPFAWERRHSVPKRATIQDVARAAGVSVTTVSRYLNGRYESMSENTREKIAAVIAELGYRPNALAKGLKAQRTETVGAIVVNMSYPFCVGFLRAFSRTLSAAGYHLMVAESEGDAKRERQLIESFVANRVEAIALQTSGANNDYLEDLAREMPVVLVDRAFALRNAYAIGTNNRDASREIAWQLFDLGYDCVVYLTEDERGIPTRTDRLEGYLDACRVALREPVVMRVRRGDPASFREALARVDACARKERTAIYTANGLVLMECYRPLRALGHKVPDAMGIATFDQPDWADLVDPPLTCVRQPVEEMGEAAGRIITARLRGEAVAAEVLVVPSTVVMRGSTGRG

SEQ ID NO: 656 - protein, 357 aa, Artificial
  Substituion in SEQ ID NO 647
MIAGQDGGGGAPPPFAWERRHSVPKRATIQDVARAAGVSVTTVSRYLNGRYESMSENTREKIAAVIAELGYRPNALAKGLKAQRTETVGAIVVNMSYPFCVGFLRAFSRTLSAAGYHLMVAESEGDAKRERQLIESFVANRVEAIALQTSGANNDYIEDLAREMPVVLVDRAFALRNAYAIGTNNRDASREIAWQLFDLGYDCVVYLTEDERGIPTRTDRLEGYLDACRVALREPVVMRVRRGDPASFREALARVDACARKERTAVYTANGLVLMECYRPLRALGHKVPDAMGIATFDQPDWADLVDPPLTCVRQPVEEMGEAAGRIITARLRGEAVAAEVLVVPSTVVMRGSTGRG

SEQ ID NO: 657 - protein, 357 aa, Artificial
  Substituion in SEQ ID NO 647
MIAGQDGGGGAPPPFAWERRHSVPKRATIQDVARAAGVSVTTVSRYLNGRYESMSENTREKIAAVIAELGYRPNALAKGLKAQRTETVGAIVVNMSYPFCVGFLRAFSRTLSAAGYHLMVAESEGDAKRERQLIESFVANRVEAIALQTSGANNDYLEDLAREMPVVLVDRAFALRNAYAIGTNNRDASREIAWQLFDLGYDCVVYLTEDERGIPTRTDRLEGYLDACRVALREPVVMRVRRGDPASFREALARVDACARKERTAVYTANGLVLMECYRPLRALGHKVPDAMGIATFDQPDWADLVDPPLTCVRQPVEEMGEAAGRIITARLRGEAVAAEVLVVPSTVVMRGSTGKG

SEQ ID NO: 658 - protein, 357 aa, Artificial
  Substituion in SEQ ID NO 647
MIAGQDGGGGAPPPFAWERRHSVPKRATIQDVARAAGVSVTTVSRYLNGRYESMSENTREKIAAVIAELGYRPNALAKGLKAQRTETVGAIVVNMSYPFCVGFLRAFSRTLSAAGYHLMVAESDGDAKRERQLIESFVANRVEAIALQTSGANNDYLEDLAREMPVVLVDRAFALRNAYAIGTNNRDASREIAWQLFDLGYDCVVYLTEDERGIPTRTDRLEGYLDACRVALREPVVMRVRRGDPASFREALARVDACARKERTAVYTANGLVLMECYRPLRALGHKVPDAMGIATFDQPDWADLVDPPLTCVRQPVEEMGEAAGRIITARLRGEAVAAEVLVVPSTVVMRGSTGRG

SEQ ID NO: 659 - DNA, 1074 bp, Artificial
  Substituion in SEQ ID NO 648
gtgatcgcaggccaggacggcggtggcggcgcgccaccgccttttgcatgggagaggaggcacagcgtgccaaagcgggccaccatccaggacgtcgcgcgagcggccggggtgtcggtcaccacggtgtcgcggtacttgaacgggcgctacgagtccatgagcgagaatacgcgagagaagattgccgcggtcatcgcggaactcggctatcggcccaacgcgctcgccaaggggctgaaggcgcagcggacggagaccgtgggcgcgattgtggtcaacatgagctatccgttttgcgtcggctttctccgcgcgttctcgcggacgctcagcgctgccgggtaccacctcatggtggccgagtccgagggcgacgcaaaaaaagagcgacagctcatcgagtcgtttgttgccaaccgcgtggaggccatcgcgctgcagacgagtggagccaacaacgactacctggaggatttggcgcgcgagatgccggtggtgttggtcgatcgcgccttcgccctgcggaacgcgtacgccatcggcaccaacaaccgcgacgcttcgcgcgagatcgcgtggcagctgttcgacctcggctacgactgcgtggtctatctgacggaggacgagcgcgggatccccacgcggacggatcgcctggaagggtatctggacgcatgccgcgtggcgctccgggagcccgtggtgatgcgcgtgcggcgcggcgatccggcttccttccgcgaagcgctcgcccgtgtggacgcctgtgcgcgcaaggagcgcaccgccgtgtacaccgcgaatggcctcgtgctgatggaatgctatcggccgctccgggcgctcggccacaaggtgccggatgccatgggcattgccaccttcgaccagccggactgggccgatctcgtcgatccgcccttgacctgcgtccgtcagcccgtggaggagatgggcgaagcggcagggcggatcatcaccgcccgcctgcggggggaagcggtagctgcggaggtcctcgttgtgccgtccaccgtcgtgatgagggggtcgacggggcggggataa

SEQ ID NO: 660 - DNA, 1074 bp, Artificial
  Substituion in SEQ ID NO 648
gtgatcgcaggccaggacggcggtggcggcgcgccaccgccttttgcatgggagaggaggcacagcgtgccaaagcgggccaccatccaggacgtcgcgcgagcggccggggtgtcggtcaccacggtgtcgcggtacttgaacgggcgctacgagtccatgagcgagaatacgcgagagaagattgccgcggtcatcgcggaactcggctatcggcccaacgcgctcgccaaggggctgaaggcgcagcggacggagaccgtgggcgcgattgtggtcaacatgagctatccgttttgcgtcggctttctccgcgcgttctcgcggacgctcagcgctgccgggtaccacctcatggtggccgagtccgagggcgacgcaaaacgggagcgacagctcatcgagtcgtttgttgccaaccgcgtggaggccatcgcgctgcagacgagtggagccaacaacgactacctggaggatttggcgcgcgagatgccggtggtgttggtcgatcgcgccttcgccctgcggaacgcgtacgccatcggcaccaacaaccgcgacgcttcgcgcgagatcgcgtggcagctgttcgacctcggctacgactgcgtggtctatctgacggaggacgagcgcgggatccccacgcggacggatcgcctggaagggtatctggacgcatgccgcgtggcgctccgggagcccgtggtgatgcgcgtgcggcgcggcgatccggcttccttccgcgaagcgctcgcccgtgtggacgcctgtgcgcgcaaggagcgcaccgccatttacaccgcgaatggcctcgtgctgatggaatgctatcggccgctccgggcgctcggccacaaggtgccggatgccatgggcattgccaccttcgaccagccggactgggccgatctcgtcgatccgcccttgacctgcgtccgtcagcccgtggaggagatgggcgaagcggcagggcggatcatcaccgcccgcctgcggggggaagcggtagctgcggaggtcctcgttgtgccgtccaccgtcgtgatgagggggtcgacggggcggggataa

SEQ ID NO: 661 - DNA, 1074 bp, Artificial
  Substituion in SEQ ID NO 648
gtgatcgcaggccaggacggcggtggcggcgcgccaccgccttttgcatgggagaggaggcacagcgtgccaaagcgggccaccatccaggacgtcgcgcgagcggccggggtgtcggtcaccacggtgtcgcggtacttgaacgggcgctacgagtccatgagcgagaatacgcgagagaagattgccgcggtcatcgcggaactcggctatcggcccaacgcgctcgccaaggggctgaaggcgcagcggacggagaccgtgggcgcgattgtggtcaacatgagctatccgttttgcgtcggctttctccgcgcgttctcgcggacgctcagcgctgccgggtaccacctcatggtggccgagtccgagggcgacgcaaaacgggagcgacagctcatcgagtcgtttgttgccaaccgcgtggaggccatcgcgctgcagacgagtggagccaacaacgactacattgaggatttggcgcgcgagatgccggtggtgttggtcgatcgcgccttcgccctgcggaacgcgtacgccatcggcaccaacaaccgcgacgcttcgcgcgagatcgcgtggcagctgttcgacctcggctacgactgcgtggtctatctgacggaggacgagcgcgggatccccacgcggacggatcgcctggaagggtatctggacgcatgccgcgtggcgctccgggagcccgtggtgatgcgcgtgcggcgcggcgatccggcttccttccgcgaagcgctcgcccgtgtggacgcctgtgcgcgcaaggagcgcaccgccgtgtacaccgcgaatggcctcgtgctgatggaatgctatcggccgctccgggcgctcggccacaaggtgccggatgccatgggcattgccaccttcgaccagccggactgggccgatctcgtcgatccgcccttgacctgcgtccgtcagcccgtggaggagatgggcgaagcggcagggcggatcatcaccgcccgcctgcggggggaagcggtagctgcggaggtcctcgttgtgccgtccaccgtcgtgatgagggggtcgacggggcggggataa

SEQ ID NO: 662 - DNA, 1074 bp, Artificial
  Substituion in SEQ ID NO 648
gtgatcgcaggccaggacggcggtggcggcgcgccaccgccttttgcatgggagaggaggcacagcgtgccaaagcgggccaccatccaggacgtcgcgcgagcggccggggtgtcggtcaccacggtgtcgcggtacttgaacgggcgctacgagtccatgagcgagaatacgcgagagaagattgccgcggtcatcgcggaactcggctatcggcccaacgcgctcgccaaggggctgaaggcgcagcggacggagaccgtgggcgcgattgtggtcaacatgagctatccgttttgcgtcggctttctccgcgcgttctcgcggacgctcagcgctgccgggtaccacctcatggtggccgagtccgagggcgacgcaaaacgggagcgacagctcatcgagtcgtttgttgccaaccgcgtggaggccatcgcgctgcagacgagtggagccaacaacgactacctggaggatttggcgcgcgagatgccggtggtgttggtcgatcgcgccttcgccctgcggaacgcgtacgccatcggcaccaacaaccgcgacgcttcgcgcgagatcgcgtggcagctgttcgacctcggctacgactgcgtggtctatctgacggaggacgagcgcgggatccccacgcggacggatcgcctggaagggtatctggacgcatgccgcgtggcgctccgggagcccgtggtgatgcgcgtgcggcgcggcgatccggcttccttccgcgaagcgctcgcccgtgtggacgcctgtgcgcgcaaggagcgcaccgccgtgtacaccgcgaatggcctcgtgctgatggaatgctatcggccgctccgggcgctcggccacaaggtgccggatgccatgggcattgccaccttcgaccagccggactgggccgatctcgtcgatccgcccttgacctgcgtccgtcagcccgtggaggagatgggcgaagcggcagggcggatcatcaccgcccgcctgcggggggaagcggtagctgcggaggtcctcgttgtgccgtccaccgtcgtgatgagggggtcgacggggaaaggataa

SEQ ID NO: 663 - DNA, 1074 bp, Artificial
  Substituion in SEQ ID NO 648
gtgatcgcaggccaggacggcggtggcggcgcgccaccgccttttgcatgggagaggaggcacagcgtgccaaagcgggccaccatccaggacgtcgcgcgagcggccggggtgtcggtcaccacggtgtcgcggtacttgaacgggcgctacgagtccatgagcgagaatacgcgagagaagattgccgcggtcatcgcggaactcggctatcggcccaacgcgctcgccaaggggctgaaggcgcagcggacggagaccgtgggcgcgattgtggtcaacatgagctatccgttttgcgtcggctttctccgcgcgttctcgcggacgctcagcgctgccgggtaccacctcatggtggccgagtccgatggcgacgcaaaacgggagcgacagctcatcgagtcgtttgttgccaaccgcgtggaggccatcgcgctgcagacgagtggagccaacaacgactacctggaggatttggcgcgcgagatgccggtggtgttggtcgatcgcgccttcgccctgcggaacgcgtacgccatcggcaccaacaaccgcgacgcttcgcgcgagatcgcgtggcagctgttcgacctcggctacgactgcgtggtctatctgacggaggacgagcgcgggatccccacgcggacggatcgcctggaagggtatctggacgcatgccgcgtggcgctccgggagcccgtggtgatgcgcgtgcggcgcggcgatccggcttccttccgcgaagcgctcgcccgtgtggacgcctgtgcgcgcaaggagcgcaccgccgtgtacaccgcgaatggcctcgtgctgatggaatgctatcggccgctccgggcgctcggccacaaggtgccggatgccatgggcattgccaccttcgaccagccggactgggccgatctcgtcgatccgcccttgacctgcgtccgtcagcccgtggaggagatgggcgaagcggcagggcggatcatcaccgcccgcctgcggggggaagcggtagctgcggaggtcctcgttgtgccgtccaccgtcgtgatgagggggtcgacggggcggggataa

SEQ ID NO: 664 - protein, 135 aa, Alicyclobacillus acidocaldarius
MRRYYTIRDLADMFDITPRTLRHYEDMGLLKPARRGAKRLYSERDRVRLQLILRGRRLGFSLPEIAEMLDLYDADPTEITQLREVIRRGDEKLRHVELQISELEALRDELIAMRSRLQQVLDDKLKQCHQKGCDD

SEQ ID NO: 665 - DNA, 408 bp, Alicyclobacillus acidocaldarius
atgcgccgctactacaccattcgagatctcgccgacatgttcgacatcaccccgcgcaccctgcgccactacgaggatatgggcctgctgaagcccgcacgccgaggcgcaaagcgcctgtacagcgagcgggatcgcgtccgcctgcaactcatcctgcgcgggcgccgcctgggattcagcctgcccgagatcgccgagatgctggatctgtacgatgccgatccgaccgaaatcacgcagctgcgcgaagtcatccggcgaggcgacgaaaaactgcgccacgtggaacttcagatctccgaactggaggccctgcgcgacgagcttatcgcgatgcggagccgcctccaacaagtgctcgacgacaagctgaaacagtgtcatcagaaagggtgtgacgattga

SEQ ID NO: 666 - protein, 120 aa, Rhodospirillum rubrum ATCC 11170
RDSFSIADLAAEFSVTPRAIRFYEDKGLITPARDGMRRIYSPRDRVRLMLILRGKRLGFSLKEIQEIIDLYDAEPTGEAQLRRLITTCQTSRAALRQQMEDIRITIDEIEAVEAQCRQAL

SEQ ID NO: 667 - protein, 119 aa, Aeromonas salmonicida subsp. salmonicida A449
RTYSISELAREFDVTTRSIRFYEDQGLLNPARQGQTRIYSKQDRVRLKLTLRGKRLGFSLADIRDLFDLYDADKSSRTQLQTMLGLVADKRETLQQQLEDIKMVLLELDAAEQRCQQAL

SEQ ID NO: 668 - protein, 118 aa, Shewanella amazonensis SB2B
YSISDLSKEFDITTRSIRFYEDQGLLKPKRRGQTRIYSLKDRVRLKLILRGKRLGFSLAETRRLFELYDADKTSVTQLNTMLALIEEKKAALQQQMDDIKVVLMELTSAEAQCRGALD

SEQ ID NO: 669 - protein, 118 aa, Aeromonas salmonicida subsp. salmonicida A449
YSISELAHEFDITPRTIRYYEDEGLITPTREGQTRIYSHKDKIRLKLTLRGKRLGFSLAEIRELFDMYDTDRSSKTQLHSMIQLINAKRQSLHQQLEDIQMVMAELEAAEQRCANSLN

SEQ ID NO: 670 - protein, 119 aa, Aeromonas hydrophila subsp. hydrophila ATCC 7966
RTYSISELAREFDVTTRSIRFYEDQGLLNPARQGQTRIYSRQDRVRLKLTLRGKRLGFSLADIRDLFDLYDADKSSRTQLQTMLGLVADKRETLQQQLEDIKMVLLELDAAEQRCQQAL

SEQ ID NO: 671 - protein, 135 aa, Artificial
  Substituion in SEQ ID NO 664
MRRYYTIRDLADMFDITPRTLRHYEDMGLLKPARRGAKRLYSERDRVRLQLILRGRRLGFSLPEIAEMLDLYDADPTEITQLREVIKRGDEKLRHVELQISELEALRDELIAMRSRLQQVLDDKLKQCHQKGCDD

SEQ ID NO: 672 - protein, 135 aa, Artificial
  Substituion in SEQ ID NO 664
MRRYYTIRDLADMFDITPRTLRHYEDMGLLKPARRGAKRLYSERDRVRLQLILRGRRLGFSLPEIAEMLDLYDADPTEITQLREVIRRGDEKLRHVELQISELEAIRDELIAMRSRLQQVLDDKLKQCHQKGCDD

SEQ ID NO: 673 - protein, 135 aa, Artificial
  Substituion in SEQ ID NO 664
MRRYYTIRDLADMFDITPRTLRHYEDMGLLKPARRGAKRLYSERDRVRLQLILRGRRLGFSLPEIAEMLDLYDADPTEITQLREVIRKGDEKLRHVELQISELEALRDELIAMRSRLQQVLDDKLKQCHQKGCDD

SEQ ID NO: 674 - protein, 135 aa, Artificial
  Substituion in SEQ ID NO 664
MRRYYTIRDLADMFDITPRTLRHYEDMGLLKPARRGAKRLYSERDRVRLQLILRGRRLGFSLPEIAEMLDLYDADPTEITQLREVIRRGDEKLRHVELQISELEALRDELIAMRSRLQQVLDDRLKQCHQKGCDD

SEQ ID NO: 675 - protein, 135 aa, Artificial
  Substituion in SEQ ID NO 664
MRRYYTIRDLADMFDITPRTLRHYEDMGLLKPARRGAKRLYSDRDRVRLQLILRGRRLGFSLPEIAEMLDLYDADPTEITQLREVIRRGDEKLRHVELQISELEALRDELIAMRSRLQQVLDDKLKQCHQKGCDD

SEQ ID NO: 676 - DNA, 408 bp, Artificial
  Substituion in SEQ ID NO 665
atgcgccgctactacaccattcgagatctcgccgacatgttcgacatcaccccgcgcaccctgcgccactacgaggatatgggcctgctgaagcccgcacgccgaggcgcaaagcgcctgtacagcgagcgggatcgcgtccgcctgcaactcatcctgcgcgggcgccgcctgggattcagcctgcccgagatcgccgagatgctggatctgtacgatgccgatccgaccgaaatcacgcagctgcgcgaagtcatcaaacgaggcgacgaaaaactgcgccacgtggaacttcagatctccgaactggaggccctgcgcgacgagcttatcgcgatgcggagccgcctccaacaagtgctcgacgacaagctgaaacagtgtcatcagaaagggtgtgacgattga

SEQ ID NO: 677 - DNA, 408 bp, Artificial
  Substituion in SEQ ID NO 665
atgcgccgctactacaccattcgagatctcgccgacatgttcgacatcaccccgcgcaccctgcgccactacgaggatatgggcctgctgaagcccgcacgccgaggcgcaaagcgcctgtacagcgagcgggatcgcgtccgcctgcaactcatcctgcgcgggcgccgcctgggattcagcctgcccgagatcgccgagatgctggatctgtacgatgccgatccgaccgaaatcacgcagctgcgcgaagtcatccggcgaggcgacgaaaaactgcgccacgtggaacttcagatctccgaactggaggccattcgcgacgagcttatcgcgatgcggagccgcctccaacaagtgctcgacgacaagctgaaacagtgtcatcagaaagggtgtgacgattga

SEQ ID NO: 678 - DNA, 408 bp, Artificial
  Substituion in SEQ ID NO 665
atgcgccgctactacaccattcgagatctcgccgacatgttcgacatcaccccgcgcaccctgcgccactacgaggatatgggcctgctgaagcccgcacgccgaggcgcaaagcgcctgtacagcgagcgggatcgcgtccgcctgcaactcatcctgcgcgggcgccgcctgggattcagcctgcccgagatcgccgagatgctggatctgtacgatgccgatccgaccgaaatcacgcagctgcgcgaagtcatccggaaaggcgacgaaaaactgcgccacgtggaacttcagatctccgaactggaggccctgcgcgacgagcttatcgcgatgcggagccgcctccaacaagtgctcgacgacaagctgaaacagtgtcatcagaaagggtgtgacgattga

SEQ ID NO: 679 - DNA, 408 bp, Artificial
  Substituion in SEQ ID NO 665
atgcgccgctactacaccattcgagatctcgccgacatgttcgacatcaccccgcgcaccctgcgccactacgaggatatgggcctgctgaagcccgcacgccgaggcgcaaagcgcctgtacagcgagcgggatcgcgtccgcctgcaactcatcctgcgcgggcgccgcctgggattcagcctgcccgagatcgccgagatgctggatctgtacgatgccgatccgaccgaaatcacgcagctgcgcgaagtcatccggcgaggcgacgaaaaactgcgccacgtggaacttcagatctccgaactggaggccctgcgcgacgagcttatcgcgatgcggagccgcctccaacaagtgctcgacgaccgtctgaaacagtgtcatcagaaagggtgtgacgattga

SEQ ID NO: 680 - DNA, 408 bp, Artificial
  Substituion in SEQ ID NO 665
atgcgccgctactacaccattcgagatctcgccgacatgttcgacatcaccccgcgcaccctgcgccactacgaggatatgggcctgctgaagcccgcacgccgaggcgcaaagcgcctgtacagcgatcgggatcgcgtccgcctgcaactcatcctgcgcgggcgccgcctgggattcagcctgcccgagatcgccgagatgctggatctgtacgatgccgatccgaccgaaatcacgcagctgcgcgaagtcatccggcgaggcgacgaaaaactgcgccacgtggaacttcagatctccgaactggaggccctgcgcgacgagcttatcgcgatgcggagccgcctccaacaagtgctcgacgacaagctgaaacagtgtcatcagaaagggtgtgacgattga

SEQ ID NO: 681 - protein, 342 aa, Alicyclobacillus acidocaldarius
MATIKDVARLANVSPSTVSRVLANSPRISEETKRRVRAALEQLNYHPNAFARGLVTNSTGAIGILIPPSAQEFFVNPFFAEWMAGVAEVARQRGVDTVLSTSARGEIETLDHMIRGRRVDGVLLIGARQGDPVLQEVAKLRCPAVLLGRPADPAPISWVNNDNQRAAYDATVHLLNLGHRRIGFLGGASDLVVTMDRVAGYRQALVDHGVEPDSRLEVSSFFLEQGGYLGMMRLLAIPDRPTAVLCADDVLAFGGMRAAHELGFEVPGDLAIVGFNDIRLAELAHPALTSVRVHMHELGVRSAELLLEEIDQGKPLQRHVIVKHELVIRYSCGAKPIGTLTT

SEQ ID NO: 682 - DNA, 1029 bp, Alicyclobacillus acidocaldarius
gtggccaccattaaagacgttgcccgcctcgccaatgtgtcaccgtccaccgtgtcccgagtgctcgccaactcgccccgcatctctgaagagaccaagcgaagggttcgggctgcgcttgaacaactgaactaccacccgaacgcctttgcacgcggcctggtgacgaattcgaccggcgccatcggcattctgattcctccctcagcgcaagagttcttcgtgaatccattcttcgccgagtggatggcgggcgtggccgaggtggcccggcagcggggagttgacaccgtgctctccacatccgccaggggagagatcgaaacacttgatcacatgatacgggggaggcgtgtggacggcgttctcctcatcggcgcgcggcaaggcgatcccgtcctgcaggaggtcgcgaagttgcgctgtcccgctgttcttctcggccgacccgctgatccagcacccatcagttgggtgaataacgacaatcagcgagccgcttacgacgcgacagttcacttgttgaacctggggcaccgccgcattggatttttaggaggcgcttccgacttggttgtgacgatggatcgcgtcgccggctatcgacaagccctggtggaccacggtgtggaacctgattctcggcttgaggtctcaagcttttttcttgagcaaggaggctatctcggcatgatgcgcttgctcgcgatccccgatcgtcccaccgcggtcctgtgtgcagacgacgtgctggcgtttggcggcatgcgtgcggctcatgaacttggattcgaggttcctggcgatctcgccatcgtcggatttaacgatattcgcttggcagagctcgcccatccggcgcttaccagtgtgcgggttcacatgcatgagctgggtgtccgatctgccgaacttttgcttgaggagattgaccaaggcaaacctctgcaacggcatgtcatcgtcaagcatgaactggtgattcgatattcctgcggtgcaaaacccatcggcacgttgacaacctga

SEQ ID NO: 683 - protein, 342 aa, Alicyclobacillus acidocaldarius; identical to SEQ ID NO: 681

SEQ ID NO: 684 - protein, 334 aa, Thermoanaerobacter sp. X514
TIKDVAKRANVAPSTVSRVIADNPRISKETKERVWKAMEELGYYPNAIARSLASKVTNTLGLIMPRSTEEAFSNPFFPEVMRGISVVAHREKYDLLLSTSGNQEEEKEAVINMVKGKRVDGIILLSSRTTDELIPWLRDEKFPFVVIGKPLDAKGVYWVDNDNIGASKLATNYLIKHGHREIAFISGSLEYVVSLDRLDGYKLALEENGIPFKRELAEQDEFSEDGGYRAMMRILEREKPTAVVVTDDVMAFGVIRAAIDKGYRVPEDISIVGFNNIPLSAFANPPLTTIDISTFDLGIKSAELLIARLKQKEIDIDHIIVPVKLVERKSCVAR

SEQ ID NO: 685 - protein, 334 aa, Thermoanaerobacter pseudethanolicus ATCC 33223
TIKDVAKRANVAPSTVSRVIADNPRISKETKERVWKAMEELGYYPNAIARSLASKVTNTLGLIMPRSTEEAFSNPFFPEVMRGISVVAHREKYDLLLSTSGNQEEEKEAVINMVKGKRVDGIILLSSRTTDELIPWLRDEKFPFVVIGKPLDAKGVYWVDNDNIGASKLATNYLIKHGHREIAFISGSLEYVVSLDRLDGYKLALEENGIPFKRELVEQDEFSEDGGYRAMMRILEREKPTAVVVTDDVMAFGVIRAAIDKGYRVPEDISIVGFNNIPLSAFANPPLTTIDISTFDLGIKSAELLIARLKQKDVDTDHIIVPVKLVERKSCVAR

SEQ ID NO: 686 - protein, 331 aa, Thermoanaerobacter tengcongensis MB4
TIKDVAKRANVAPSTVSRVIADSPRISKETKERVWKAMEELGYYPNAIARSLASKVTNTLGLIMPRSTEEAFSNPFFPEVMRGISVVAHREKYDLLLSTSGNKEEEKEAVIRMVKGKRVDGIILLSSRTTDELIPWLRDEKFPFVVIGKPLDARGVYWVDNDNIGASKLATNYLIKHGHREIAFISGSLEYVVSLDRLDGYKLALEENGLTFKRELVEQEEFSEDGGYRAMMKILERAKPTGVVVTDDVMAFGVIRATIDKGFRVPEDISIVGFNNIPLSAFANPPLTTIDISTFELGIKSAELLIARLKQKEIESDHIIVPVKLIERKSC

SEQ ID NO: 687 - protein, 331 aa, Bacillus selenitireducens MLS10
TIKDVAKLANVAPSTVSRVIANSPRISERTKETVREAMKELGYHPNFNARSLANKSTNTIGIVMPNSANKTFQNPFFPEVIRGISSKAHQLEYGLYLSTGQTEAEIFEEVQHMVQGKRVDGIILLYSRVDDKVVDYLYKENFPFSVIGRPYDEKKRDITFVNNDNFKAAKTVTEYLLLLGHKNIAFIGGNLDFVVTVDHMEGYRKALSNAGMELLDDYVVFHEELQEGGQEAVIDLMSLNDPPTAMIVADDIMTFGVMRMLSEMEMKVPDDVSIISFNNVMISELSSPPMTTVDIHIYNLGFEACNLLIDQILHPETGSKQVLIPHKMIKR

SEQ ID NO: 688 - protein, 342 aa, Artificial
  Substituion in SEQ ID NO 681
MATIKDVARLANVSPSTVSRVLANSPRISEETKRRVRAALEQLNYHPNAFARGLVTNSTGAIGILIPPSAQEFFVNPFFAEWMAGVAEVARQRGVDTVLSTSARGEIETLDHMIRGRRVDGVLLIGARQGDPVLQEVAKLRCPAVLLGRPADPAPISWVNNDNQRAAYDATVHLLNLGHRRIGFLGGASDLVVTMDRIAGYRQALVDHGVEPDSRLEVSSFFLEQGGYLGMMRLLAIPDRPTAVLCADDVLAFGGMRAAHELGFEVPGDLAIVGFNDIRLAELAHPALTSVRVHMHELGVRSAELLLEEIDQGKPLQRHVIVKHELVIRYSCGAKPIGTLTT

SEQ ID NO: 689 - protein, 342 aa, Artificial
  Substituion in SEQ ID NO 681
MATIKDVARLANVSPSTVSRVLANSPRISEETKRRVRAALEQLNYHPNAFARGLVTNSTGAIGILIPPSAQEFFVNPFFAEWMAGVAEVARQRGVDTVLSTSARGEIETLDHMIRGRRVDGVLLIGARQGDPVLQEVAKLRCPAVLLGRPADPAPISWVNNDNQRAAYDATVHLLNLGHRRIGFLGGASDLVVTMDRVAGYRQALVDHGVEPDSRIEVSSFFLEQGGYLGMMRLLAIPDRPTAVLCADDVLAFGGMRAAHELGFEVPGDLAIVGFNDIRLAELAHPALTSVRVHMHELGVRSAELLLEEIDQGKPLQRHVIVKHELVIRYSCGAKPIGTLTT

SEQ ID NO: 690 - protein, 342 aa, Artificial
  Substituion in SEQ ID NO 681
MATIKDVARLANVSPSTVSRVLANSPRISEETKRRVRAALEQLNYHPNAFARGLVTNSTGAIGILIPPSAQEFFVNPFFAEWMAGVAEVARQRGVDTVLSTSARGEIETLDHMIRGRRVDGVLLIGARQGDPVLQEVAKLRCPAVLLGRPADPAPISWVNNDNQRAAYDATVHLLNLGHRRIGFLGGASDLVVTMDRVAGYRQALVDHGVEPDSRLEVSSFFLEQGGYLGMMRLLAIPDRPTAVLCADDILAFGGMRAAHELGFEVPGDLAIVGFNDIRLAELAHPALTSVRVHMHELGVRSAELLLEEIDQGKPLQRHVIVKHELVIRYSCGAKPIGTLTT

SEQ ID NO: 691 - protein, 342 aa, Artificial
  Substituion in SEQ ID NO 681
MATIKDVARLANVSPSTVSRVLANSPRISEDTKRRVRAALEQLNYHPNAFARGLVTNSTGAIGILIPPSAQEFFVNPFFAEWMAGVAEVARQRGVDTVLSTSARGEIETLDHMIRGRRVDGVLLIGARQGDPVLQEVAKLRCPAVLLGRPADPAPISWVNNDNQRAAYDATVHLLNLGHRRIGFLGGASDLVVTMDRVAGYRQALVDHGVEPDSRLEVSSFFLEQGGYLGMMRLLAIPDRPTAVLCADDVLAFGGMRAAHELGFEVPGDLAIVGFNDIRLAELAHPALTSVRVHMHELGVRSAELLLEEIDQGKPLQRHVIVKHELVIRYSCGAKPIGTLTT

SEQ ID NO: 692 - protein, 342 aa, Artificial
  Substituion in SEQ ID NO 681
MATIKDVARLANVSPSTVSRVLANSPRISEETKRRVRAALEQLNYHPNAFARGLVTNSTGAIGILIPPSAQEFFVNPFFAEWMAGVAEVARQRGVDTVLSTSARGEIETLDHMIRGRRVDGVLLIGARQGDPVLQEVAKLRCPAVLLGRPADPAPISWVNNDNQRAAYDATVHLLNLGHRRIGFLGGASDLVVTMDRVAGYRQALVDHGIEPDSRLEVSSFFLEQGGYLGMMRLLAIPDRPTAVLCADDVLAFGGMRAAHELGFEVPGDLAIVGFNDIRLAELAHPALTSVRVHMHELGVRSAELLLEEIDQGKPLQRHVIVKHELVIRYSCGAKPIGTLTT

SEQ ID NO: 693 - DNA, 1029 bp, Artificial
  Substituion in SEQ ID NO 682
gtggccaccattaaagacgttgcccgcctcgccaatgtgtcaccgtccaccgtgtcccgagtgctcgccaactcgccccgcatctctgaagagaccaagcgaagggttcgggctgcgcttgaacaactgaactaccacccgaacgcctttgcacgcggcctggtgacgaattcgaccggcgccatcggcattctgattcctccctcagcgcaagagttcttcgtgaatccattcttcgccgagtggatggcgggcgtggccgaggtggcccggcagcggggagttgacaccgtgctctccacatccgccaggggagagatcgaaacacttgatcacatgatacgggggaggcgtgtggacggcgttctcctcatcggcgcgcggcaaggcgatcccgtcctgcaggaggtcgcgaagttgcgctgtcccgctgttcttctcggccgacccgctgatccagcacccatcagttgggtgaataacgacaatcagcgagccgcttacgacgcgacagttcacttgttgaacctggggcaccgccgcattggatttttaggaggcgcttccgacttggttgtgacgatggatcgcattgccggctatcgacaagccctggtggaccacggtgtggaacctgattctcggcttgaggtctcaagcttttttcttgagcaaggaggctatctcggcatgatgcgcttgctcgcgatccccgatcgtcccaccgcggtcctgtgtgcagacgacgtgctggcgtttggcggcatgcgtgcggctcatgaacttggattcgaggttcctggcgatctcgccatcgtcggatttaacgatattcgcttggcagagctcgcccatccggcgcttaccagtgtgcgggttcacatgcatgagctgggtgtccgatctgccgaacttttgcttgaggagattgaccaaggcaaacctctgcaacggcatgtcatcgtcaagcatgaactggtgattcgatattcctgcggtgcaaaacccatcggcacgttgacaacctga

SEQ ID NO: 694 - DNA, 1029 bp, Artificial
  Substituion in SEQ ID NO 682
gtggccaccattaaagacgttgcccgcctcgccaatgtgtcaccgtccaccgtgtcccgagtgctcgccaactcgccccgcatctctgaagagaccaagcgaagggttcgggctgcgcttgaacaactgaactaccacccgaacgcctttgcacgcggcctggtgacgaattcgaccggcgccatcggcattctgattcctccctcagcgcaagagttcttcgtgaatccattcttcgccgagtggatggcgggcgtggccgaggtggcccggcagcggggagttgacaccgtgctctccacatccgccaggggagagatcgaaacacttgatcacatgatacgggggaggcgtgtggacggcgttctcctcatcggcgcgcggcaaggcgatcccgtcctgcaggaggtcgcgaagttgcgctgtcccgctgttcttctcggccgacccgctgatccagcacccatcagttgggtgaataacgacaatcagcgagccgcttacgacgcgacagttcacttgttgaacctggggcaccgccgcattggatttttaggaggcgcttccgacttggttgtgacgatggatcgcgtcgccggctatcgacaagccctggtggaccacggtgtggaacctgattctcggattgaggtctcaagcttttttcttgagcaaggaggctatctcggcatgatgcgcttgctcgcgatccccgatcgtcccaccgcggtcctgtgtgcagacgacgtgctggcgtttggcggcatgcgtgcggctcatgaacttggattcgaggttcctggcgatctcgccatcgtcggatttaacgatattcgcttggcagagctcgcccatccggcgcttaccagtgtgcgggttcacatgcatgagctgggtgtccgatctgccgaacttttgcttgaggagattgaccaaggcaaacctctgcaacggcatgtcatcgtcaagcatgaactggtgattcgatattcctgcggtgcaaaacccatcggcacgttgacaacctga

SEQ ID NO: 695 - DNA, 1029 bp, Artificial
  Substituion in SEQ ID NO 682
gtggccaccattaaagacgttgcccgcctcgccaatgtgtcaccgtccaccgtgtcccgagtgctcgccaactcgccccgcatctctgaagagaccaagcgaagggttcgggctgcgcttgaacaactgaactaccacccgaacgcctttgcacgcggcctggtgacgaattcgaccggcgccatcggcattctgattcctccctcagcgcaagagttcttcgtgaatccattcttcgccgagtggatggcgggcgtggccgaggtggcccggcagcggggagttgacaccgtgctctccacatccgccaggggagagatcgaaacacttgatcacatgatacgggggaggcgtgtggacggcgttctcctcatcggcgcgcggcaaggcgatcccgtcctgcaggaggtcgcgaagttgcgctgtcccgctgttcttctcggccgacccgctgatccagcacccatcagttgggtgaataacgacaatcagcgagccgcttacgacgcgacagttcacttgttgaacctggggcaccgccgcattggatttttaggaggcgcttccgacttggttgtgacgatggatcgcgtcgccggctatcgacaagccctggtggaccacggtgtggaacctgattctcggcttgaggtctcaagcttttttcttgagcaaggaggctatctcggcatgatgcgcttgctcgcgatccccgatcgtcccaccgcggtcctgtgtgcagacgacattctggcgtttggcggcatgcgtgcggctcatgaacttggattcgaggttcctggcgatctcgccatcgtcggatttaacgatattcgcttggcagagctcgcccatccggcgcttaccagtgtgcgggttcacatgcatgagctgggtgtccgatctgccgaacttttgcttgaggagattgaccaaggcaaacctctgcaacggcatgtcatcgtcaagcatgaactggtgattcgatattcctgcggtgcaaaacccatcggcacgttgacaacctga

SEQ ID NO: 696 - DNA, 1029 bp, Artificial
  Substituion in SEQ ID NO 682
gtggccaccattaaagacgttgcccgcctcgccaatgtgtcaccgtccaccgtgtcccgagtgctcgccaactcgccccgcatctctgaagataccaagcgaagggttcgggctgcgcttgaacaactgaactaccacccgaacgcctttgcacgcggcctggtgacgaattcgaccggcgccatcggcattctgattcctccctcagcgcaagagttcttcgtgaatccattcttcgccgagtggatggcgggcgtggccgaggtggcccggcagcggggagttgacaccgtgctctccacatccgccaggggagagatcgaaacacttgatcacatgatacgggggaggcgtgtggacggcgttctcctcatcggcgcgcggcaaggcgatcccgtcctgcaggaggtcgcgaagttgcgctgtcccgctgttcttctcggccgacccgctgatccagcacccatcagttgggtgaataacgacaatcagcgagccgcttacgacgcgacagttcacttgttgaacctggggcaccgccgcattggatttttaggaggcgcttccgacttggttgtgacgatggatcgcgtcgccggctatcgacaagccctggtggaccacggtgtggaacctgattctcggcttgaggtctcaagcttttttcttgagcaaggaggctatctcggcatgatgcgcttgctcgcgatccccgatcgtcccaccgcggtcctgtgtgcagacgacgtgctggcgtttggcggcatgcgtgcggctcatgaacttggattcgaggttcctggcgatctcgccatcgtcggatttaacgatattcgcttggcagagctcgcccatccggcgcttaccagtgtgcgggttcacatgcatgagctgggtgtccgatctgccgaacttttgcttgaggagattgaccaaggcaaacctctgcaacggcatgtcatcgtcaagcatgaactggtgattcgatattcctgcggtgcaaaacccatcggcacgttgacaacctga

SEQ ID NO: 697 - DNA, 1029 bp, Artificial
  Substituion in SEQ ID NO 682
gtggccaccattaaagacgttgcccgcctcgccaatgtgtcaccgtccaccgtgtcccgagtgctcgccaactcgccccgcatctctgaagagaccaagcgaagggttcgggctgcgcttgaacaactgaactaccacccgaacgcctttgcacgcggcctggtgacgaattcgaccggcgccatcggcattctgattcctccctcagcgcaagagttcttcgtgaatccattcttcgccgagtggatggcgggcgtggccgaggtggcccggcagcggggagttgacaccgtgctctccacatccgccaggggagagatcgaaacacttgatcacatgatacgggggaggcgtgtggacggcgttctcctcatcggcgcgcggcaaggcgatcccgtcctgcaggaggtcgcgaagttgcgctgtcccgctgttcttctcggccgacccgctgatccagcacccatcagttgggtgaataacgacaatcagcgagccgcttacgacgcgacagttcacttgttgaacctggggcaccgccgcattggatttttaggaggcgcttccgacttggttgtgacgatggatcgcgtcgccggctatcgacaagccctggtggaccacggtattgaacctgattctcggcttgaggtctcaagcttttttcttgagcaaggaggctatctcggcatgatgcgcttgctcgcgatccccgatcgtcccaccgcggtcctgtgtgcagacgacgtgctggcgtttggcggcatgcgtgcggctcatgaacttggattcgaggttcctggcgatctcgccatcgtcggatttaacgatattcgcttggcagagctcgcccatccggcgcttaccagtgtgcgggttcacatgcatgagctgggtgtccgatctgccgaacttttgcttgaggagattgaccaaggcaaacctctgcaacggcatgtcatcgtcaagcatgaactggtgattcgatattcctgcggtgcaaaacccatcggcacgttgacaacctga

SEQ ID NO: 698 - protein, 112 aa, Alicyclobacillus acidocaldarius
MTHGPDMPEDVCMRCLAVLGEPQRLRILRALAEGEQTAGALSERLGVRQNTLSHHMRQLREHGLVEVRRHPHDERFTFYRLNGRRLRALSAVLTDWAARADAECETSGRWSS

SEQ ID NO: 699 - DNA, 339 bp, Alicyclobacillus acidocaldarius
atgacgcacggaccggatatgccagaggacgtctgcatgcggtgcttggcggtgctcggcgagccccagcggctgcgcatcctccgggcgttggccgagggcgagcagaccgcgggcgcgctgagcgagcgcctcggcgtgcgccaaaacaccctttcccatcacatgaggcagcttcgcgagcacgggctggtggaggtgcgccgccatccgcacgacgagcgatttacgttttatcgattgaacgggcgtcgactgcgggccctctctgccgtcctgacggattgggccgctcgcgcagacgcagagtgtgaaacctcgggccgctggtcttcgtga

SEQ ID NO: 700 - protein, 72 aa, Fulvimarina pelagi HTCC2506
DRSEEVAAILSLIANPARLRILCLLAEGEMQVGALAERVGLSQSALSQHLAKLRAGGAVETRRDRQTIYYRL

SEQ ID NO: 701 - protein, 85 aa, Synechococcus sp. WH 8102
LKALADPTRLDVIHALAEGERCVCDLTADLGITQSRLSFHLRVLRDCGLLTDRHSGRWTYYRLQPDALSALEDWLAALRQHCSRS

SEQ ID NO: 702 - protein, 88 aa, Renibacterium salmoninarum ATCC 33209
LEAIAEPTRRRILDAIRTGERSVGDLVEIVGMHQPGISRHLKVLRDSGLVEVRQDAQRRLYRLRAEPLKELDQWLEPYRLEWAGRLDA

SEQ ID NO: 703 - protein, 82 aa, Caulobacter sp. K31
DDACALLKALANPHRLMIVCALIDGEQSVGALAHLLGVRETLASQHLGLLRRDGVVAARRDGQTIYYGLRGGQARALVETLS

SEQ ID NO: 704 - protein, 90 aa, Synechococcus sp. WH 5701
DQARALLKALGDPVRLRVIEALGGGERCVCDLVTDLGLAQSKLSFHLKVLKQAGLLADRQEGRWIYYRLRPETLGALQAWLTDLGAHCGA

SEQ ID NO: 705 - protein, 112 aa, Artificial
  Substituion in SEQ ID NO 698
MTHGPDMPEDVCMRCLAVLGEPQRLRILRALAEGEQTAGALSERLGVRQNTLSHHMRQLREHGLVEVRRHPHDERFTFYRLNGRKLRALSAVLTDWAARADAECETSGRWSS

SEQ ID NO: 706 - protein, 112 aa, Artificial
  Substituion in SEQ ID NO 698
MTHGPDMPEDVCMRCLAVLGEPQRIRILRALAEGEQTAGALSERLGVRQNTLSHHMRQLREHGLVEVRRHPHDERFTFYRLNGRRLRALSAVLTDWAARADAECETSGRWSS

SEQ ID NO: 707 - protein, 112 aa, Artificial
  Substituion in SEQ ID NO 698
MTHGPDMPEEVCMRCLAVLGEPQRLRILRALAEGEQTAGALSERLGVRQNTLSHHMRQLREHGLVEVRRHPHDERFTFYRLNGRRLRALSAVLTDWAARADAECETSGRWSS

SEQ ID NO: 708 - protein, 112 aa, Artificial
  Substituion in SEQ ID NO 698
MTHGPDMPEDVCMRCLAVLGEPQRLRILRALAEGENTAGALSERLGVRQNTLSHHMRQLREHGLVEVRRHPHDERFTFYRLNGRRLRALSAVLTDWAARADAECETSGRWSS

SEQ ID NO: 709 - protein, 112 aa, Artificial
  Substituion in SEQ ID NO 698
MTHGPDMPEDVCMRCLAVLGEPQRLRILRALAEGEQTAGALSEKLGVRQNTLSHHMRQLREHGLVEVRRHPHDERFTFYRLNGRRLRALSAVLTDWAARADAECETSGRWSS

SEQ ID NO: 710 - DNA, 339 bp, Artificial
  Substituion in SEQ ID NO 699
atgacgcacggaccggatatgccagaggacgtctgcatgcggtgcttggcggtgctcggcgagccccagcggctgcgcatcctccgggcgttggccgagggcgagcagaccgcgggcgcgctgagcgagcgcctcggcgtgcgccaaaacaccctttcccatcacatgaggcagcttcgcgagcacgggctggtggaggtgcgccgccatccgcacgacgagcgatttacgttttatcgattgaacgggcgtaaactgcgggccctctctgccgtcctgacggattgggccgctcgcgcagacgcagagtgtgaaacctcgggccgctggtcttcgtga

SEQ ID NO: 711 - DNA, 339 bp, Artificial
  Substituion in SEQ ID NO 699
atgacgcacggaccggatatgccagaggacgtctgcatgcggtgcttggcggtgctcggcgagccccagcggattcgcatcctccgggcgttggccgagggcgagcagaccgcgggcgcgctgagcgagcgcctcggcgtgcgccaaaacaccctttcccatcacatgaggcagcttcgcgagcacgggctggtggaggtgcgccgccatccgcacgacgagcgatttacgttttatcgattgaacgggcgtcgactgcgggccctctctgccgtcctgacggattgggccgctcgcgcagacgcagagtgtgaaacctcgggccgctggtcttcgtga

SEQ ID NO: 712 - DNA, 339 bp, Artificial
  Substituion in SEQ ID NO 699
atgacgcacggaccggatatgccagaggaagtctgcatgcggtgcttggcggtgctcggcgagccccagcggctgcgcatcctccgggcgttggccgagggcgagcagaccgcgggcgcgctgagcgagcgcctcggcgtgcgccaaaacaccctttcccatcacatgaggcagcttcgcgagcacgggctggtggaggtgcgccgccatccgcacgacgagcgatttacgttttatcgattgaacgggcgtcgactgcgggccctctctgccgtcctgacggattgggccgctcgcgcagacgcagagtgtgaaacctcgggccgctggtcttcgtga

SEQ ID NO: 713 - DNA, 339 bp, Artificial
  Substituion in SEQ ID NO 699
atgacgcacggaccggatatgccagaggacgtctgcatgcggtgcttggcggtgctcggcgagccccagcggctgcgcatcctccgggcgttggccgagggcgagaataccgcgggcgcgctgagcgagcgcctcggcgtgcgccaaaacaccctttcccatcacatgaggcagcttcgcgagcacgggctggtggaggtgcgccgccatccgcacgacgagcgatttacgttttatcgattgaacgggcgtcgactgcgggccctctctgccgtcctgacggattgggccgctcgcgcagacgcagagtgtgaaacctcgggccgctggtcttcgtga

SEQ ID NO: 714 - DNA, 339 bp, Artificial
  Substituion in SEQ ID NO 699
atgacgcacggaccggatatgccagaggacgtctgcatgcggtgcttggcggtgctcggcgagccccagcggctgcgcatcctccgggcgttggccgagggcgagcagaccgcgggcgcgctgagcgagaaactcggcgtgcgccaaaacaccctttcccatcacatgaggcagcttcgcgagcacgggctggtggaggtgcgccgccatccgcacgacgagcgatttacgttttatcgattgaacgggcgtcgactgcgggccctctctgccgtcctgacggattgggccgctcgcgcagacgcagagtgtgaaacctcgggccgctggtcttcgtga

SEQ ID NO: 715 - protein, 334 aa, Alicyclobacillus acidocaldarius
MSPCRPLSESSGLFYTHVKIMAGVGDRVIHIKELRSGLPLFKALGSEVRVALLELLLEHGRLNMDEIAKRLGITNGAVTQHVRKLEECGLVVTETAGARHGLQKFCYVNEQKILVELAPETKDQDVYEVDIRVGHYVSFEVWPTCGLATAETIIGTFDDPRYFADPQHIDAEIVWLTKGYLEYWIPNFIRTDRPVEEIQIIAELASEAPSYNNDYPSDIHFSINGVDIGYWTSPGDFGDERGRQNPSWWPPHLNQYGHLKLVRVNHEGTFIDGCKISDVTIEDLQPFQGHAIPLRFSVPENARHVGGMTIFGRRFGHYDQDIKVRVIYGRGARD

SEQ ID NO: 716 - DNA, 1005 bp, Alicyclobacillus acidocaldarius
gtgtcgccctgtcgcccgctgtcggagagctccggtttgttttatactcatgtgaagataatggccggggtgggtgatagggtgattcacatcaaggagttgaggtcgggcttgccgttgttcaaggcgctgggttcggaggtccgcgtcgcgctgctcgagctcttgctcgaacacgggcggctgaacatggacgagatcgccaagcggcttgggatcacgaacggcgcggtgacgcagcacgtgcgaaagcttgaggaatgcggactcgtggtcaccgagaccgcgggggcgcgccacggcctgcagaagttttgctacgtcaacgaacagaagatcctcgtggaactagccccggagacgaaagaccaggacgtgtacgaggtggacatccgggtgggccactatgtctcgtttgaggtgtggcccacctgcggcctggccacggccgagaccatcattggcacgtttgacgatccgcgctacttcgccgatccgcagcacatcgacgccgagattgtgtggctcacaaaaggatatctggagtattggatcccgaatttcattcgcacggacaggccggtggaggagatccagattattgcggaactcgcctccgaggcgccctcgtacaacaacgactatccctctgatatccatttctccatcaacggtgtggacatcggctactggaccagcccgggcgatttcggcgacgaacgcgggcggcagaatccgagctggtggccgcctcacctcaaccagtacggacatctgaagctcgtccgtgtcaaccacgaaggaacattcattgatgggtgcaagatctcagacgtgaccatcgaggatctgcagccgtttcaggggcatgccattccgctgcgattttcggtgccggagaacgcgcgccacgtgggcgggatgaccatcttcggccggaggttcggccactacgatcaggacatcaaggtgcgcgtgatctacgggcgtggggcgagagattga

SEQ ID NO: 717 - protein, 300 aa, Clostridium beijerinckii NCIMB 8052
MIHITNLKESLPLFKALSSDVRMNILEILSQYKQLNMNELSEKLDLTNGAVTMHIKKLEECGLIKTTNLTGKHGLQKICSLHEDKFVIDIGKQDVENSYHIDLNIGHYSNYDITPTCGIATKDSIIGEVDNPNYFADPERINADILWFTKGSIEYRIPNYLKPSEVFSELQISMEISSEAPGVCSIWPSDIHFYLNNVNVGRWTSPGDFGDSKGILTPSWWNPHWNQYGLLKLLTINSFGTFIDGIKISDVTLEDLELTYKSDILLKLAVPEETKHVGGLTIFGKNFGNYNQGISVRLVY

SEQ ID NO: 718 - protein, 298 aa, Caldicellulosiruptor saccharolyticus DSM 8903
IDNLKEAKILFEALASDARLEIINLLSKHREMNMNEIAQKLGLTNGAVTQHMKKLIAAGIVTISAASGKHGNQKICRLVEDKIIINIVTKHPQKLYECEIKVGNYSIFEVYPTCGLATKDKLIGEVDDPKYFAHPEHVNCDIIWFTKGYVEYIIPNFLRQNQKAVEIQISFEISSEAPGVSENWPSDIYFYLNGVELGYWTSPGDFGGETKGIFTPDWWFPNWNQYGLLKLLSVSEDGTYIDGFKISNVTIKDIDIESKNEIRFRVAVPDHAKNIGGVTLFGRNFGNYDQDIKFRIFY

SEQ ID NO: 719 - protein, 290 aa, Bacillus halodurans C-125
LPVYEALASKVRLAIIQQLTRKSMNIRELAEAVGLSSAIMTMHIKKLEKAGIIRTEMVPGKAGIQKLCILDTDHIEINFPPKKESLKLYHQTILSVGHYTDFLVEPTCGLATAEKIIGEFDEPRYFLDPERVNAKILWFSKGYIEYKIPNFLHHSENPKELEISLELSSEAPFTNDNWPSDISFYFNNVKIGIWTSPGDFGDSPGKYTPDWWPKVINQYGLLKFIRITKEGTFIEGAKISDVTIDDVHIRSKQWSFRVAVPDDAENVGGVTIFGEGFGNYNQDIIFRLYY

SEQ ID NO: 720 - protein, 294 aa, Bacillus clausii KSM-K16
KQSLPVYEALASRIRLNVLQLLAERSMNIKELAESQQVSSAIMTKHVQKLEKAGLIDTTHVRGKAGVQKMCSLRVRHAQIAFPNKENGPTRAFHESHVSVGHFTDFYVEPTCGLATPETIVGEFDEPRYFLDPMRVNARILWFYKGFVEYKLSNFIHGGETPKELEISMELSSEAPFTNDNWPSDVSFTFNGVSLGYWRSPGDFGDQKGKYTPAWWPRGINQYGLLKVIRITEAGTFIDGKQLSDVKLADVSIREKVWTFRVAVGEEGVHIGGVTLFGSSFGNYDQDIVFRLYY

SEQ ID NO: 721 - protein, 286 aa, Enterococcus faecium DO
LPVYEALASKTRIKIIQLLSKKKMNVKDLAKELGVSSAITTMHVKKLEEANIIKTEKVGQQKISSLRVDKIDISFPEKIFNAFDTKETSIPIGHYTNYAIEPTCGLATIHDFIGKVDEPRYFMDPRRMDARILWFTSGFVEYQAPNFLNTEDTLEMLEVSVEISSEFPFSNDNWPSDITFSLNGVELGTWTSPGDFADIRGKYTPDWYPDNLNQYGLLKTIRITKHLTNMNGEPLSNITINDIPKEQDTWHLRIEVKDDAKHVGGCTLFGKGFGNYDQDIKLKVYY

SEQ ID NO: 722 - protein, 334 aa, Artificial
  Substituion in SEQ ID NO 715
MSPCRPLSESSGLFYTHVKIMAGVGDRVIHIKELRSGLPLFKALGSEVRVALLELLLEHGRLNMDEIAKRLGITNGAVTQHVRKLEECGLVVTETAGARHGLQKFCYVNEQKILVELAPETKDQDVYEVDIRVGHYVSFEVWPTCGLATAETIIGTFDDPRYFADPQHIDAEIVWLTKGYLEYWIPNFIRTDRPVEEIQIIAELASEAPSYNNDYPSDIHFSINGVDIGYWTSPGDFGDERGRQNPSWWPPHLNQYGHLKLVRVNHEGTFIDGCKISDVTIEDLQPFNGHAIPLRFSVPENARHVGGMTIFGRRFGHYDQDIKVRVIYGRGARD

SEQ ID NO: 723 - protein, 334 aa, Artificial
  Substituion in SEQ ID NO 715
MSPCRPLSESSGLFYTHVKIMAGVGDRVIHIKELRSGLPLFKALGSEVRVALLELLLEHGRLNMDEIAKRLGITNGAVTQHVRKLEECGLVVTETAGARHGLQKFCYVNEQKILVELAPETKDQDVYDVDIRVGHYVSFEVWPTCGLATAETIIGTFDDPRYFADPQHIDAEIVWLTKGYLEYWIPNFIRTDRPVEEIQIIAELASEAPSYNNDYPSDIHFSINGVDIGYWTSPGDFGDERGRQNPSWWPPHLNQYGHLKLVRVNHEGTFIDGCKISDVTIEDLQPFQGHAIPLRFSVPENARHVGGMTIFGRRFGHYDQDIKVRVIYGRGARD

SEQ ID NO: 724 - protein, 334 aa, Artificial
  Substituion in SEQ ID NO 715
MSPCRPLSESSGLFYTHVKIMAGVGDRVIHIKELRSGLPLFKALGSEVRVALLELLLEHGRLNMDEIAKRLGITNGAVTQHVRKLEECGLVVTETAGARHGLQKFCYVNEQKILVELAPETKDQDVYEVDIRVGHYVSFEVWPTCGLATAETIIGTFDDPRYFADPNHIDAEIVWLTKGYLEYWIPNFIRTDRPVEEIQIIAELASEAPSYNNDYPSDIHFSINGVDIGYWTSPGDFGDERGRQNPSWWPPHLNQYGHLKLVRVNHEGTFIDGCKISDVTIEDLQPFQGHAIPLRFSVPENARHVGGMTIFGRRFGHYDQDIKVRVIYGRGARD

SEQ ID NO: 725 - protein, 334 aa, Artificial
  Substituion in SEQ ID NO 715
MSPCRPLSESSGLFYTHVKIMAGVGDRVIHIKELRSGLPLFKALGSEVRVALLELLLEHGRLNMDEIAKRLGITNGAVTQHVRKLEECGLVVTETAGARHGLQKFCYVNEQKILVELAPETKDQDVYEVDIRVGHYVSFEVWPTCGLATAETIIGTFDDPRYFADPQHIDAEIVWLTKGYLEYWIPNFIRTDRPVEEIQIIAELASEAPSYNNDYPSDIHFSINGVDIGYWTSPGDFGDERGRQNPSWWPPHLNQYGHLKLVRVNHEGTFIDGCKLSDVTIEDLQPFQGHAIPLRFSVPENARHVGGMTIFGRRFGHYDQDIKVRVIYGRGARD

SEQ ID NO: 726 - protein, 334 aa, Artificial
  Substituion in SEQ ID NO 715
MSPCRPLSESSGLFYTHVKIMAGVGDRVIHIKELRSGLPLFKALGSEVRVALLELLLEHGRLNMDEIAKRLGITNGAVTQHVRKLEECGLVVTETAGARHGLQKFCYVNEQKILVELAPETKDQDVYEVDIRVGHYVSFEVWPTCGLATAETIIGTFDDPRYFADPQHIDAEIVWLTKGYLEYWIPNFIRTDRPVEEIQIIAELASEAPSYNNDYPSDIHFSINGVDIGYWTSPGDFGDERGRQNPSWWPPHLNQYGHLKLVRVNHEGTFIDGCKISDVTLEDLQPFQGHAIPLRFSVPENARHVGGMTIFGRRFGHYDQDIKVRVIYGRGARD

SEQ ID NO: 727 - DNA, 1005 bp, Artificial
  Substituion in SEQ ID NO 716
gtgtcgccctgtcgcccgctgtcggagagctccggtttgttttatactcatgtgaagataatggccggggtgggtgatagggtgattcacatcaaggagttgaggtcgggcttgccgttgttcaaggcgctgggttcggaggtccgcgtcgcgctgctcgagctcttgctcgaacacgggcggctgaacatggacgagatcgccaagcggcttgggatcacgaacggcgcggtgacgcagcacgtgcgaaagcttgaggaatgcggactcgtggtcaccgagaccgcgggggcgcgccacggcctgcagaagttttgctacgtcaacgaacagaagatcctcgtggaactagccccggagacgaaagaccaggacgtgtacgaggtggacatccgggtgggccactatgtctcgtttgaggtgtggcccacctgcggcctggccacggccgagaccatcattggcacgtttgacgatccgcgctacttcgccgatccgcagcacatcgacgccgagattgtgtggctcacaaaaggatatctggagtattggatcccgaatttcattcgcacggacaggccggtggaggagatccagattattgcggaactcgcctccgaggcgccctcgtacaacaacgactatccctctgatatccatttctccatcaacggtgtggacatcggctactggaccagcccgggcgatttcggcgacgaacgcgggcggcagaatccgagctggtggccgcctcacctcaaccagtacggacatctgaagctcgtccgtgtcaaccacgaaggaacattcattgatgggtgcaagatctcagacgtgaccatcgaggatctgcagccgtttaatgggcatgccattccgctgcgattttcggtgccggagaacgcgcgccacgtgggcgggatgaccatcttcggccggaggttcggccactacgatcaggacatcaaggtgcgcgtgatctacgggcgtggggcgagagattga

SEQ ID NO: 728 - DNA, 1005 bp, Artificial
  Substituion in SEQ ID NO 716
gtgtcgccctgtcgcccgctgtcggagagctccggtttgttttatactcatgtgaagataatggccggggtgggtgatagggtgattcacatcaaggagttgaggtcgggcttgccgttgttcaaggcgctgggttcggaggtccgcgtcgcgctgctcgagctcttgctcgaacacgggcggctgaacatggacgagatcgccaagcggcttgggatcacgaacggcgcggtgacgcagcacgtgcgaaagcttgaggaatgcggactcgtggtcaccgagaccgcgggggcgcgccacggcctgcagaagttttgctacgtcaacgaacagaagatcctcgtggaactagccccggagacgaaagaccaggacgtgtacgatgtggacatccgggtgggccactatgtctcgtttgaggtgtggcccacctgcggcctggccacggccgagaccatcattggcacgtttgacgatccgcgctacttcgccgatccgcagcacatcgacgccgagattgtgtggctcacaaaaggatatctggagtattggatcccgaatttcattcgcacggacaggccggtggaggagatccagattattgcggaactcgcctccgaggcgccctcgtacaacaacgactatccctctgatatccatttctccatcaacggtgtggacatcggctactggaccagcccgggcgatttcggcgacgaacgcgggcggcagaatccgagctggtggccgcctcacctcaaccagtacggacatctgaagctcgtccgtgtcaaccacgaaggaacattcattgatgggtgcaagatctcagacgtgaccatcgaggatctgcagccgtttcaggggcatgccattccgctgcgattttcggtgccggagaacgcgcgccacgtgggcgggatgaccatcttcggccggaggttcggccactacgatcaggacatcaaggtgcgcgtgatctacgggcgtggggcgagagattga

SEQ ID NO: 729 - DNA, 1005 bp, Artificial
  Substituion in SEQ ID NO 716
gtgtcgccctgtcgcccgctgtcggagagctccggtttgttttatactcatgtgaagataatggccggggtgggtgatagggtgattcacatcaaggagttgaggtcgggcttgccgttgttcaaggcgctgggttcggaggtccgcgtcgcgctgctcgagctcttgctcgaacacgggcggctgaacatggacgagatcgccaagcggcttgggatcacgaacggcgcggtgacgcagcacgtgcgaaagcttgaggaatgcggactcgtggtcaccgagaccgcgggggcgcgccacggcctgcagaagttttgctacgtcaacgaacagaagatcctcgtggaactagccccggagacgaaagaccaggacgtgtacgaggtggacatccgggtgggccactatgtctcgtttgaggtgtggcccacctgcggcctggccacggccgagaccatcattggcacgtttgacgatccgcgctacttcgccgatccgaatcacatcgacgccgagattgtgtggctcacaaaaggatatctggagtattggatcccgaatttcattcgcacggacaggccggtggaggagatccagattattgcggaactcgcctccgaggcgccctcgtacaacaacgactatccctctgatatccatttctccatcaacggtgtggacatcggctactggaccagcccgggcgatttcggcgacgaacgcgggcggcagaatccgagctggtggccgcctcacctcaaccagtacggacatctgaagctcgtccgtgtcaaccacgaaggaacattcattgatgggtgcaagatctcagacgtgaccatcgaggatctgcagccgtttcaggggcatgccattccgctgcgattttcggtgccggagaacgcgcgccacgtgggcgggatgaccatcttcggccggaggttcggccactacgatcaggacatcaaggtgcgcgtgatctacgggcgtggggcgagagattga

SEQ ID NO: 730 - DNA, 1005 bp, Artificial
  Substituion in SEQ ID NO 716
gtgtcgccctgtcgcccgctgtcggagagctccggtttgttttatactcatgtgaagataatggccggggtgggtgatagggtgattcacatcaaggagttgaggtcgggcttgccgttgttcaaggcgctgggttcggaggtccgcgtcgcgctgctcgagctcttgctcgaacacgggcggctgaacatggacgagatcgccaagcggcttgggatcacgaacggcgcggtgacgcagcacgtgcgaaagcttgaggaatgcggactcgtggtcaccgagaccgcgggggcgcgccacggcctgcagaagttttgctacgtcaacgaacagaagatcctcgtggaactagccccggagacgaaagaccaggacgtgtacgaggtggacatccgggtgggccactatgtctcgtttgaggtgtggcccacctgcggcctggccacggccgagaccatcattggcacgtttgacgatccgcgctacttcgccgatccgcagcacatcgacgccgagattgtgtggctcacaaaaggatatctggagtattggatcccgaatttcattcgcacggacaggccggtggaggagatccagattattgcggaactcgcctccgaggcgccctcgtacaacaacgactatccctctgatatccatttctccatcaacggtgtggacatcggctactggaccagcccgggcgatttcggcgacgaacgcgggcggcagaatccgagctggtggccgcctcacctcaaccagtacggacatctgaagctcgtccgtgtcaaccacgaaggaacattcattgatgggtgcaagttatcagacgtgaccatcgaggatctgcagccgtttcaggggcatgccattccgctgcgattttcggtgccggagaacgcgcgccacgtgggcgggatgaccatcttcggccggaggttcggccactacgatcaggacatcaaggtgcgcgtgatctacgggcgtggggcgagagattga

SEQ ID NO: 731 - DNA, 1005 bp, Artificial
  Substituion in SEQ ID NO 716
gtgtcgccctgtcgcccgctgtcggagagctccggtttgttttatactcatgtgaagataatggccggggtgggtgatagggtgattcacatcaaggagttgaggtcgggcttgccgttgttcaaggcgctgggttcggaggtccgcgtcgcgctgctcgagctcttgctcgaacacgggcggctgaacatggacgagatcgccaagcggcttgggatcacgaacggcgcggtgacgcagcacgtgcgaaagcttgaggaatgcggactcgtggtcaccgagaccgcgggggcgcgccacggcctgcagaagttttgctacgtcaacgaacagaagatcctcgtggaactagccccggagacgaaagaccaggacgtgtacgaggtggacatccgggtgggccactatgtctcgtttgaggtgtggcccacctgcggcctggccacggccgagaccatcattggcacgtttgacgatccgcgctacttcgccgatccgcagcacatcgacgccgagattgtgtggctcacaaaaggatatctggagtattggatcccgaatttcattcgcacggacaggccggtggaggagatccagattattgcggaactcgcctccgaggcgccctcgtacaacaacgactatccctctgatatccatttctccatcaacggtgtggacatcggctactggaccagcccgggcgatttcggcgacgaacgcgggcggcagaatccgagctggtggccgcctcacctcaaccagtacggacatctgaagctcgtccgtgtcaaccacgaaggaacattcattgatgggtgcaagatctcagacgtgaccttagaggatctgcagccgtttcaggggcatgccattccgctgcgattttcggtgccggagaacgcgcgccacgtgggcgggatgaccatcttcggccggaggttcggccactacgatcaggacatcaaggtgcgcgtgatctacgggcgtggggcgagagattga

SEQ ID NO: 732 - protein, 340 aa, Alicyclobacillus acidocaldarius
MRATIRDVAKAAGVSAATVSRALNRPDLVDPETLERVRKAMEEMSYQPSAIARGLSARRSDTLGLIVPGITDFFFNELYKGIDRASQQYGMKVLLYDSEHSRERAFEGFSILSGYQVSGIIFTSKLVTEDYDPILQRVNIPVVLTLTQSAAKTPLTAFRIDEVRAMFDVVAYLVSRGHRQIAMIAGKLWDDRTGELRLEGYREGLRHFGIEYCEARVEFGQYRFDDGYQAMQRLLERIRDVPFTAVCTASDEMALGAIRCLNDHGYRVPDDISVMGFDDLPIARMVTPRLTTVAQPFHEIGEEAVKWLIRAASQPPSPSEIGDYLLPHRLVERESVRSIS

SEQ ID NO: 733 - DNA, 1023 bp, Alicyclobacillus acidocaldarius
ttgcgagcgaccatccgcgacgtcgccaaggcggcgggggtgtctgccgcgaccgtgtctcgcgccctgaatcggccggacctggtcgatcccgagaccctcgagcgcgttcgcaaggcgatggaagagatgtcgtatcagccgagcgccatcgctcgagggctatccgcgcgaagaagcgacacgctgggactcatcgtgcccggcatcacggatttctttttcaacgagctctacaagggcattgatcgtgccagtcaacagtacggcatgaaggtcttgctgtacgactctgagcattcgcgcgagcgggcgtttgagggcttctccatcctcagcggctaccaggtgtcgggcatcatcttcaccagcaaactggtgacggaggactacgaccccattcttcagcgagtcaacatccctgtcgtcctcacgctgacgcagagcgccgcgaagacgccgctcaccgcctttcgcatcgatgaagtgcgcgccatgttcgacgtcgtggcgtacctggtgtccagaggacatcggcagattgcgatgatcgctggcaagctatgggacgaccggaccggcgaattgcgcttggaaggctaccgggaagggcttcgccatttcgggatcgagtattgcgaggcgcgcgtggagtttgggcagtatcgttttgatgacggctatcaggccatgcagcgcttgctggagcggatccgagacgtgcccttcacagcggtgtgcaccgcgtcggatgaaatggcgctcggcgcgatacgctgtttgaacgatcacggctatcgcgtgccagatgacatctctgtcatgggatttgacgatctgcccatcgcgcgcatggtgacaccgaggcttacgacggtcgctcagccgtttcatgaaatcggtgaggaagctgtcaaatggttgattcgggcggcgtctcagcctccgtcaccttccgagattggggattacttgttgccgcatcgcctagtggaacgtgagtctgtgcgttccatttcctga

SEQ ID NO: 734 - protein, 332 aa, Bacillus halodurans C-125
MNTTIYDVAREAGVSMATVSRVVNGNPNVKPATRKKVLEAIERLGYRPNAVARGLASKRTTTVGVVIPDISSIFFAELARGIEDIATMYKYNIILCNSDQNKEKEIHLINTLLEKQVDGIVFMGGEITNEHAEEFKRAHVPVVLAATLDAEKEIPSVNIDYKQAAFDAVTYLIEKGHTSIGMVSGSLEDPVNGYQKYAGYREALEERGVAFDESMVVIGDYTYDSGIDAMNVFTKLEKRPTAIFVATDEMALGVIHGAQDHGLNIPDDIEVIGFDNTRLATMVRPTLSTVVQPIYDIGAVSMRLLTKYMNKEEVSEHIVELPHRIEFRQSTR

SEQ ID NO: 735 - protein, 332 aa, Halothermothrix orenii H 168
MKPTIKDVARKANVSVATVSRVLNNQPGYSVETEKKVLEAIDELGYHPNALARGLVGKRTKTLGVLIPRISNMVSSQIMNGIEDAAHKNDHSVIICNTDNDGQKTMVYLDVLREKRVDGIIVVSEMLTEEYANKLVELKVPVILISTIDETGQFPHIKVNDEQAAYQATEYLISKGHKNIAMISGTPEDMVAGKPRLDGYKKALRENGLPVKEENIVFGDFWFDSGKECMERLLNNNQGITAIFVASDEMAAGALSTAYKSGIRVPEDISIIGFDNTQLAEMTIPPLTTVSQPFYQMGYKGLKLLLKAIKGKEVNSAILPHVIVERETVKKV

SEQ ID NO: 736 - protein, 332 aa, Bacillus clausii KSM-K16
MNTTIYDVAREAGVSMATVSRVVNGNPNVKPTTRKKVLEAIERLNYRPNAVARGLASKRTTTVGVIIPDISSIFFSELARGIEDIATMYKYNIILCNSDQNKDKEIHLINTLLEKQVDGIVFMGGEITEEHAEQFKRAPVPIVLAATLDDEKSFPSVNIDYTQAAEDAIQFLIEKGHKRIGMLSGSLEDPINGYQKFAGYRQALQKNNIEFDENLIVIGDYTYDSGMEAMDAFLALDEKPTALFASNDEMALGVIHGIQDRGYDVPGDIEVLGFDNTRLATMVRPTLTTVVQPLYDIGAVSMRLLTKLMNKEEVDNYTVTLPHRIESRGSTK

SEQ ID NO: 737 - protein, 330 aa, Geobacillus kaustophilus HTA426
MTVTIYDVAREANVSMATVSRVVNGNPNVKPSTRKKVLEAIERLGYRPNAVARGLASKKTTTVGVIIPDISSIFFAELARGIEDIATMYKYNIILSNSDQNKEKELHLLNTMLAKQVDGLLFMGGTITDEHVAEFQKSSVPIVLAATMGPNEIPSVNIDYEQAAFEAVTYLLEKGNRRIVYVTGPTDDPINQRKLAGYRRALEEHGAPYEEELVIEGDNSYDSGLEAYEKITELAERPTAVFAGTDEMALGIIHSAQDHGGRVPDELEVVGFDNTRLATMVRPRLTTVVQPMYDIGAVAMRLLTKYMNKEPVDHHIVVLPHRLEVRESTK

SEQ ID NO: 738 - protein, 331 aa, Geobacillus thermodenitrificans NG80-2
MTVTIYDVAREANVSMATVSRVVNGNPNVKPSTRKKVLEAIERLGYRPNAVARGLASKKTTTVGVIIPDISSIFFAELARGIEDIATMYKYNIILSNSDQNKDKELHLLNTMLAKQVDGILFMGGTITEEHVAEFQKSSVPIVLAATIEPNETIPSVNIDYEQAAFEAVTYLLERGNRRVAYVTGPTDDPINQRKLAGYRRALEEHGVPYDEELVVEGDNSYDSGLEAYEKIAELAERPTAVFAGTDEMALGIIHSAQDQGVRVPDELEVVGFDNTRLATMVRPRLTTVVQPMYDIGAVAMRLLTKYMNKEHVDNHIVVLPHRLEVRESTK

SEQ ID NO: 739 - protein, 340 aa, Artificial
  Substituion in SEQ ID NO 732
MRATIRDVAKAAGVSAATVSRALNRPDLVDPETLERVRKAMEEMSYQPSAIARGLSARRSDTLGLIVPGITDFFFNELYKGIDRASQQYGMKVLLYDSEHSRERAFEGFSILSGYQVSGIIFTSKLVTEDYDPILQRVNIPVVLTLTQSAAKTPLTAFRIDEVRAMFDVVAYLVSRGHRQIAMIAGKLWDDRTGELRLEGYREGLRHFGIEYCEARVEFGQYRFDDGYQAMQRLLERIRDVPFTAVCTASDEMALGAIRCLNDHGYRVPDDISVMGFDDLPIARMVTPRLTTVAQPFHEIGEEAVKWLIRAASQPPSPSEIGDYLLPHRLVERESIRSIS

SEQ ID NO: 740 - protein, 340 aa, Artificial
  Substituion in SEQ ID NO 732
MRATIRDVAKAAGVSAATVSRAINRPDLVDPETLERVRKAMEEMSYQPSAIARGLSARRSDTLGLIVPGITDFFFNELYKGIDRASQQYGMKVLLYDSEHSRERAFEGFSILSGYQVSGIIFTSKLVTEDYDPILQRVNIPVVLTLTQSAAKTPLTAFRIDEVRAMFDVVAYLVSRGHRQIAMIAGKLWDDRTGELRLEGYREGLRHFGIEYCEARVEFGQYRFDDGYQAMQRLLERIRDVPFTAVCTASDEMALGAIRCLNDHGYRVPDDISVMGFDDLPIARMVTPRLTTVAQPFHEIGEEAVKWLIRAASQPPSPSEIGDYLLPHRLVERESVRSIS

SEQ ID NO: 741 - protein, 340 aa, Artificial
  Substituion in SEQ ID NO 732
MRATIRDVAKAAGVSAATVSRALNRPDLVDPETLERVRKAMEEMSYQPSAIARGLSARRSDTLGLIVPGITDFFFNELYKGIDRASQQYGMKVLLYDSEHSRERAFEGFSILSGYQVSGIIFTSKLVTEDYDPILQRVNIPVVLTLTQSAAKTPLTAFRIDEVRAMFDVVAYLVSRGHRQIAMIAGKLWDDRTGELRLEGYREGLRHFGIEYCEARVEFGQYRFDDGYQAMQRLLERIRDVPFTAVCTASDEMALGAIRCLNDHGYRVPDDISVMGFDDLPIARMVTPRLTTVAQPFHDIGEEAVKWLIRAASQPPSPSEIGDYLLPHRLVERESVRSIS

SEQ ID NO: 742 - protein, 340 aa, Artificial
  Substituion in SEQ ID NO 732
MRATIRDVAKAAGVSAATVSRALNRPDLVDPETLERVRKAMEEMSYQPSAIARGLSARRSDTLGLIVPGITDFFFNELYKGIDRASQQYGMKVLLYDSEHSRERAFEGFSILSGYQVSGIIFTSKLVTEDYDPILQRVNIPVVLTLTQSAAKTPLTAFRIDEVRAMFDVVAYLVSRGHRQIAMIAGKLWDDRTGELRLEGYREGLRHFGIEYCEARVEFGQYRFDDGYQAMQRLLERIRDVPFTAVCTASDEMALGAIRCLNDHGYRVPDDISVMGFDDLPIARMVTPRLTTVAQPFHEIGEEAVKWLIRAASQPPSPSEIGDYILPHRLVERESVRSIS

SEQ ID NO: 743 - protein, 340 aa, Artificial
  Substituion in SEQ ID NO 732
MRATIRDVAKAAGVSAATVSRALNRPDLVDPETLERVRKAMEEMSYQPSAIARGLSARRSDTLGLIVPGITDFFFNELYKGIDRASQQYGMKVLLYDSEHSRERAFEGFSILSGYQVSGIIFTSKLVTEDYDPILQRVNIPVVLTLTQSAAKTPLTAFRIDEVRAMFDVVAYLVSRGHRQIAMIAGKLWDDRTGELRLEGYREGLRHFGIEYCEARVEFGQYRFDDGYQAMQRLLERLRDVPFTAVCTASDEMALGAIRCLNDHGYRVPDDISVMGFDDLPIARMVTPRLTTVAQPFHEIGEEAVKWLIRAASQPPSPSEIGDYLLPHRLVERESVRSIS

SEQ ID NO: 744 - DNA, 1023 bp, Artificial
  Substituion in SEQ ID NO 733
ttgcgagcgaccatccgcgacgtcgccaaggcggcgggggtgtctgccgcgaccgtgtctcgcgccctgaatcggccggacctggtcgatcccgagaccctcgagcgcgttcgcaaggcgatggaagagatgtcgtatcagccgagcgccatcgctcgagggctatccgcgcgaagaagcgacacgctgggactcatcgtgcccggcatcacggatttctttttcaacgagctctacaagggcattgatcgtgccagtcaacagtacggcatgaaggtcttgctgtacgactctgagcattcgcgcgagcgggcgtttgagggcttctccatcctcagcggctaccaggtgtcgggcatcatcttcaccagcaaactggtgacggaggactacgaccccattcttcagcgagtcaacatccctgtcgtcctcacgctgacgcagagcgccgcgaagacgccgctcaccgcctttcgcatcgatgaagtgcgcgccatgttcgacgtcgtggcgtacctggtgtccagaggacatcggcagattgcgatgatcgctggcaagctatgggacgaccggaccggcgaattgcgcttggaaggctaccgggaagggcttcgccatttcgggatcgagtattgcgaggcgcgcgtggagtttgggcagtatcgttttgatgacggctatcaggccatgcagcgcttgctggagcggatccgagacgtgcccttcacagcggtgtgcaccgcgtcggatgaaatggcgctcggcgcgatacgctgtttgaacgatcacggctatcgcgtgccagatgacatctctgtcatgggatttgacgatctgcccatcgcgcgcatggtgacaccgaggcttacgacggtcgctcagccgtttcatgaaatcggtgaggaagctgtcaaatggttgattcgggcggcgtctcagcctccgtcaccttccgagattggggattacttgttgccgcatcgcctagtggaacgtgagtctattcgttccatttcctga

SEQ ID NO: 745 - DNA, 1023 bp, Artificial
  Substituion in SEQ ID NO 733
ttgcgagcgaccatccgcgacgtcgccaaggcggcgggggtgtctgccgcgaccgtgtctcgcgccattaatcggccggacctggtcgatcccgagaccctcgagcgcgttcgcaaggcgatggaagagatgtcgtatcagccgagcgccatcgctcgagggctatccgcgcgaagaagcgacacgctgggactcatcgtgcccggcatcacggatttctttttcaacgagctctacaagggcattgatcgtgccagtcaacagtacggcatgaaggtcttgctgtacgactctgagcattcgcgcgagcgggcgtttgagggcttctccatcctcagcggctaccaggtgtcgggcatcatcttcaccagcaaactggtgacggaggactacgaccccattcttcagcgagtcaacatccctgtcgtcctcacgctgacgcagagcgccgcgaagacgccgctcaccgcctttcgcatcgatgaagtgcgcgccatgttcgacgtcgtggcgtacctggtgtccagaggacatcggcagattgcgatgatcgctggcaagctatgggacgaccggaccggcgaattgcgcttggaaggctaccgggaagggcttcgccatttcgggatcgagtattgcgaggcgcgcgtggagtttgggcagtatcgttttgatgacggctatcaggccatgcagcgcttgctggagcggatccgagacgtgcccttcacagcggtgtgcaccgcgtcggatgaaatggcgctcggcgcgatacgctgtttgaacgatcacggctatcgcgtgccagatgacatctctgtcatgggatttgacgatctgcccatcgcgcgcatggtgacaccgaggcttacgacggtcgctcagccgtttcatgaaatcggtgaggaagctgtcaaatggttgattcgggcggcgtctcagcctccgtcaccttccgagattggggattacttgttgccgcatcgcctagtggaacgtgagtctgtgcgttccatttcctga

SEQ ID NO: 746 - DNA, 1023 bp, Artificial
  Substituion in SEQ ID NO 733
ttgcgagcgaccatccgcgacgtcgccaaggcggcgggggtgtctgccgcgaccgtgtctcgcgccctgaatcggccggacctggtcgatcccgagaccctcgagcgcgttcgcaaggcgatggaagagatgtcgtatcagccgagcgccatcgctcgagggctatccgcgcgaagaagcgacacgctgggactcatcgtgcccggcatcacggatttctttttcaacgagctctacaagggcattgatcgtgccagtcaacagtacggcatgaaggtcttgctgtacgactctgagcattcgcgcgagcgggcgtttgagggcttctccatcctcagcggctaccaggtgtcgggcatcatcttcaccagcaaactggtgacggaggactacgaccccattcttcagcgagtcaacatccctgtcgtcctcacgctgacgcagagcgccgcgaagacgccgctcaccgcctttcgcatcgatgaagtgcgcgccatgttcgacgtcgtggcgtacctggtgtccagaggacatcggcagattgcgatgatcgctggcaagctatgggacgaccggaccggcgaattgcgcttggaaggctaccgggaagggcttcgccatttcgggatcgagtattgcgaggcgcgcgtggagtttgggcagtatcgttttgatgacggctatcaggccatgcagcgcttgctggagcggatccgagacgtgcccttcacagcggtgtgcaccgcgtcggatgaaatggcgctcggcgcgatacgctgtttgaacgatcacggctatcgcgtgccagatgacatctctgtcatgggatttgacgatctgcccatcgcgcgcatggtgacaccgaggcttacgacggtcgctcagccgtttcatgatatcggtgaggaagctgtcaaatggttgattcgggcggcgtctcagcctccgtcaccttccgagattggggattacttgttgccgcatcgcctagtggaacgtgagtctgtgcgttccatttcctga

SEQ ID NO: 747 - DNA, 1023 bp, Artificial
  Substituion in SEQ ID NO 733
ttgcgagcgaccatccgcgacgtcgccaaggcggcgggggtgtctgccgcgaccgtgtctcgcgccctgaatcggccggacctggtcgatcccgagaccctcgagcgcgttcgcaaggcgatggaagagatgtcgtatcagccgagcgccatcgctcgagggctatccgcgcgaagaagcgacacgctgggactcatcgtgcccggcatcacggatttctttttcaacgagctctacaagggcattgatcgtgccagtcaacagtacggcatgaaggtcttgctgtacgactctgagcattcgcgcgagcgggcgtttgagggcttctccatcctcagcggctaccaggtgtcgggcatcatcttcaccagcaaactggtgacggaggactacgaccccattcttcagcgagtcaacatccctgtcgtcctcacgctgacgcagagcgccgcgaagacgccgctcaccgcctttcgcatcgatgaagtgcgcgccatgttcgacgtcgtggcgtacctggtgtccagaggacatcggcagattgcgatgatcgctggcaagctatgggacgaccggaccggcgaattgcgcttggaaggctaccgggaagggcttcgccatttcgggatcgagtattgcgaggcgcgcgtggagtttgggcagtatcgttttgatgacggctatcaggccatgcagcgcttgctggagcggatccgagacgtgcccttcacagcggtgtgcaccgcgtcggatgaaatggcgctcggcgcgatacgctgtttgaacgatcacggctatcgcgtgccagatgacatctctgtcatgggatttgacgatctgcccatcgcgcgcatggtgacaccgaggcttacgacggtcgctcagccgtttcatgaaatcggtgaggaagctgtcaaatggttgattcgggcggcgtctcagcctccgtcaccttccgagattggggattacattttgccgcatcgcctagtggaacgtgagtctgtgcgttccatttcctga

SEQ ID NO: 748 - DNA, 1023 bp, Artificial
  Substituion in SEQ ID NO 733
ttgcgagcgaccatccgcgacgtcgccaaggcggcgggggtgtctgccgcgaccgtgtctcgcgccctgaatcggccggacctggtcgatcccgagaccctcgagcgcgttcgcaaggcgatggaagagatgtcgtatcagccgagcgccatcgctcgagggctatccgcgcgaagaagcgacacgctgggactcatcgtgcccggcatcacggatttctttttcaacgagctctacaagggcattgatcgtgccagtcaacagtacggcatgaaggtcttgctgtacgactctgagcattcgcgcgagcgggcgtttgagggcttctccatcctcagcggctaccaggtgtcgggcatcatcttcaccagcaaactggtgacggaggactacgaccccattcttcagcgagtcaacatccctgtcgtcctcacgctgacgcagagcgccgcgaagacgccgctcaccgcctttcgcatcgatgaagtgcgcgccatgttcgacgtcgtggcgtacctggtgtccagaggacatcggcagattgcgatgatcgctggcaagctatgggacgaccggaccggcgaattgcgcttggaaggctaccgggaagggcttcgccatttcgggatcgagtattgcgaggcgcgcgtggagtttgggcagtatcgttttgatgacggctatcaggccatgcagcgcttgctggagcggttacgagacgtgcccttcacagcggtgtgcaccgcgtcggatgaaatggcgctcggcgcgatacgctgtttgaacgatcacggctatcgcgtgccagatgacatctctgtcatgggatttgacgatctgcccatcgcgcgcatggtgacaccgaggcttacgacggtcgctcagccgtttcatgaaatcggtgaggaagctgtcaaatggttgattcgggcggcgtctcagcctccgtcaccttccgagattggggattacttgttgccgcatcgcctagtggaacgtgagtctgtgcgttccatttcctga

SEQ ID NO: 749 - protein, 72 aa, Alicyclobacillus acidocaldarius
MAKSNRLLLGQASRALQDMKYEIAGELGITPPADGYWGFVSSYENGSIGGSITKRLVRYAQERLAQGDAGSP

SEQ ID NO: 750 - DNA, 219 bp, Alicyclobacillus acidocaldarius
atggcaaagagcaatcgcctgttgcttgggcaggcgtcgcgggcgctgcaggacatgaagtacgagattgcgggagaactcggcatcacgccccccgcggacggctactggggcttcgtctcatcgtacgagaacggttccatcggtggcagtattaccaaaaggctcgtccgttatgcgcaggagcgattggcgcagggagacgcgggttcgccgtga

SEQ ID NO: 751 - protein, 62 aa, Paenibacillus larvae subsp. larvae BRL-230010
SNVLVVPQANQALEQLKYEVAQELGIQIPQDGYYGYMATRDTGAIGGNITRRLVQIAEQSLA

SEQ ID NO: 752 - protein, 61 aa, Thermoanaerobacter tengcongensis MB4
NPLVVKEARQVMNQWKYEIANELGITPPADGYWGYLTSRDCGAVGGHMVRKMIQMAESQMA

SEQ ID NO: 753 - protein, 67 aa, Paenibacillus larvae subsp. larvae BRL-230010
SNVLVVPQANAALDQLKYEVAQELGIVIPQDGYYGNMATRDTGAIGGHITRRLVQIAEQQLSGTQGS

SEQ ID NO: 754 - protein, 61 aa, Thermoanaerobacter pseudethanolicus ATCC 33223
NPLVVKEAKQVMSQWKYEIANELGITPPADGYWGNLTSRDCGAVGGHMVRKMIQMAESQMA

SEQ ID NO: 755 - protein, 61 aa, Thermoanaerobacter pseudethanolicus ATCC 33223
NPLVVKEAKQVMSQWKYEIARELGITPPADGYWGNLTSRDCGAVGGHMVRKMIQMAESQMA

SEQ ID NO: 756 - protein, 72 aa, Artificial
  Substituion in SEQ ID NO 749
MAKSNRLLLGQASRALQDMKYEIAGELGITPPADGYWGFVSSYENGSIGGSITKKLVRYAQERLAQGDAGSP

SEQ ID NO: 757 - protein, 72 aa, Artificial
  Substituion in SEQ ID NO 749
MAKSNRLLLGQASRALQDMKYEIAGELGITPPADGYWGFVSSYENGSIGGSLTKRLVRYAQERLAQGDAGSP

SEQ ID NO: 758 - protein, 72 aa, Artificial
  Substituion in SEQ ID NO 749
MAKSNRLLLGQASRALQDMKYEIAGELGITPPADGYWGFVSSYENGSIGGSITKRLVRYAQDRLAQGDAGSP

SEQ ID NO: 759 - protein, 72 aa, Artificial
  Substituion in SEQ ID NO 749
MAKSNKLLLGQASRALQDMKYEIAGELGITPPADGYWGFVSSYENGSIGGSITKRLVRYAQERLAQGDAGSP

SEQ ID NO: 760 - protein, 72 aa, Artificial
  Substituion in SEQ ID NO 749
MAKSNRLLLGQASRAIQDMKYEIAGELGITPPADGYWGFVSSYENGSIGGSITKRLVRYAQERLAQGDAGSP

SEQ ID NO: 761 - DNA, 219 bp, Artificial
  Substituion in SEQ ID NO 750
atggcaaagagcaatcgcctgttgcttgggcaggcgtcgcgggcgctgcaggacatgaagtacgagattgcgggagaactcggcatcacgccccccgcggacggctactggggcttcgtctcatcgtacgagaacggttccatcggtggcagtattaccaaaaaactcgtccgttatgcgcaggagcgattggcgcagggagacgcgggttcgccgtga

SEQ ID NO: 762 - DNA, 219 bp, Artificial
  Substituion in SEQ ID NO 750
atggcaaagagcaatcgcctgttgcttgggcaggcgtcgcgggcgctgcaggacatgaagtacgagattgcgggagaactcggcatcacgccccccgcggacggctactggggcttcgtctcatcgtacgagaacggttccatcggtggcagtttaaccaaaaggctcgtccgttatgcgcaggagcgattggcgcagggagacgcgggttcgccgtga

SEQ ID NO: 763 - DNA, 219 bp, Artificial
  Substituion in SEQ ID NO 750
atggcaaagagcaatcgcctgttgcttgggcaggcgtcgcgggcgctgcaggacatgaagtacgagattgcgggagaactcggcatcacgccccccgcggacggctactggggcttcgtctcatcgtacgagaacggttccatcggtggcagtattaccaaaaggctcgtccgttatgcgcaggatcgattggcgcagggagacgcgggttcgccgtga

SEQ ID NO: 764 - DNA, 219 bp, Artificial
  Substituion in SEQ ID NO 750
atggcaaagagcaataaactgttgcttgggcaggcgtcgcgggcgctgcaggacatgaagtacgagattgcgggagaactcggcatcacgccccccgcggacggctactggggcttcgtctcatcgtacgagaacggttccatcggtggcagtattaccaaaaggctcgtccgttatgcgcaggagcgattggcgcagggagacgcgggttcgccgtga

SEQ ID NO: 765 - DNA, 219 bp, Artificial
  Substituion in SEQ ID NO 750
atggcaaagagcaatcgcctgttgcttgggcaggcgtcgcgggcgattcaggacatgaagtacgagattgcgggagaactcggcatcacgccccccgcggacggctactggggcttcgtctcatcgtacgagaacggttccatcggtggcagtattaccaaaaggctcgtccgttatgcgcaggagcgattggcgcagggagacgcgggttcgccgtga

SEQ ID NO: 766 - protein, 384 aa, Alicyclobacillus acidocaldarius
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLIGIAARLDPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVRSGWRLPANSEQTR

SEQ ID NO: 767 - DNA, 1155 bp, Alicyclobacillus acidocaldarius
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 768 - protein, 359 aa, Geobacillus thermodenitrificans NG80-2
VLHVISGGETGGSRKHVVTLLSKFAPGTATLVVFQDGPLAAEARQAGIDVRLLAQSSRYDLSVLSKLVALIRRERFDILHTHGPRANLYGALIKRKIAIPWMTTVHSDPRLDFMKSGWKGKWFTRLNVWALQKVDYFFAVSERFKESLMELGIAAERIQTIYNGIDFDDAPRPHMLQRADLGLREDDLVIAMVARLHPIKGHALVFEALASLSDPDMKLLVVGDGPLASELREKATQSGIGRQVQFLGFRRDVADIYALSDVALMASYSESFPLALLEAANERLPVISTDVGGVSQLIASSDMGWIVPVGDRAALAQAMREARSRRHELKTMGKRLYEHASTHFSLQRLYEETMATYER

SEQ ID NO: 769 - protein, 367 aa, Bacteroides capillosus ATCC 29799
VIHLISGGDSGGAKTHVHMLLQNLSRTPGVEVTMVCFMEGPFSQEARELGISTVVLPGKNIFRTFHTLKNMIREGGYEIIHCHGARGNMMGALLRKATGLPVVTTVHSDYRLDYMGRPISRITYGTINTLALRLLDYRIGVSDAMTDLLISRGFDPDKLFTIYNGIDFTPRTPSMTRSEYLKSVGANWPEDCVVAGIAARLNPVKDIPTLIRGFAQARQSCPKLRLLIAGDGEQMNELKALAADLGVAEDVCFAGWVSDVDSFYGALDINTLTSLSETFPYSLTEGARAGLPTVASRVGGVPYLIDHGVNGLLFEAGDYETLAKHLTALASDETMRTHMGQRLYQKGKNDYSLESTLQRQLEIYSVI

SEQ ID NO: 770 - protein, 314 aa, Bacillus weihenstephanensis KBAB4
AGAEDGGGKTHIISLLDQFPDGEVELAVFEDGIVAKEARELGIKVHVFSQKSRYDLSILKNISEFINKEKFDVVHTHGPRANFFVSLMKKKFAAKWVTTIHSDPFQDFTKQGLKGWIFTKLNLKALKNIDLFFVVTNRLKKSLAALGISNEKMHVIYNGIEYDQEKADGYNKKEMFNIDEDVFTAIQVARLHPVKGHEVLFDALQQTKLEKIKVLLVGDGPLERELKALATEKGINDKVEFLGHRQDVKQLFASSHVNLLTSHSEGFPLVLLEAANQRVPSIVTRAGEIEPLIADETYGWIVPTGDGKALASAL

SEQ ID NO: 771 - protein, 316 aa, Bacillus cereus subsp. cytotoxis NVH 391-98
AGAEDGGGKTHIISLLDQFPTDEVELAVFEDGIVAREAREIGIKVHVFSQKSRYDLSILKNISRFINEEQFDIVHTHGPRANFYVSLMKKRIAAKWVTTIHSDPFQDFTKQGLKGWIFTKLNLKALKDIDLFFVVTNRLKKSLEQLGISSEKMRVIYNGIEYDKEKAQGYDKKEKFHIEEDVFTAIQVARLHPVKGHEVLFDALNNTSLTKIKVLLVGDGPLEEDLKALAKEKGIDDKVQFLGHRQDVKQLFASAHINLLTSHSEGFPLVLLEAANQRVPSIVTRAGEIEPLIVDDTYGWVVPVGDGKALANALEQ

SEQ ID NO: 772 - protein, 314 aa, Bacillus cereus ATCC 14579
AGAEDGGGKTHIISLLDQFPTGEVELAVFEDGIVAKEARELGIKVHVFSQKSRYDLSILKNISEFINKEKFDVVHTHGPRANFYVSLMKKRIKAKWVTTIHSDPFQDFTKQGLKGWIFTKLNLKALKNIDLFFVVTNRLKKSLAALGISNEKMHVIYNGIEYDKEKAEGYNKKEMFNIDEDVFTAIQVARLHPVKGHEVLFDALQQTKLEKIKVLLVGDGPLEENLKSLATEKGINDKVEFLGHRQDVKQLFASSHVNLLTSHSEGFPLVLLEAANQRVPSIVTRAGEIEPLIVDETYGWIVPTGDGKALALAL

SEQ ID NO: 773 - protein, 384 aa, Artificial
  Substituion in SEQ ID NO 766
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLIGIAARLDPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVKSGWRLPANSEQTR

SEQ ID NO: 774 - protein, 384 aa, Artificial
  Substituion in SEQ ID NO 766
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLIGIAARLDPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVDRFQRLVLPRYRPERMVVAYERGYTVIEEDAVRSGWRLPANSEQTR

SEQ ID NO: 775 - protein, 384 aa, Artificial
  Substituion in SEQ ID NO 766
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPKYDFEGHPLKAALFPSLHLWRLSRARGLFVVQPALGDALPCRTILEVPNAFFPRLPRASRDVCAAEWRRRLGLNPESRLIGIAARLDPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVRSGWRLPANSEQTR

SEQ ID NO: 776 - protein, 384 aa, Artificial
  Substituion in SEQ ID NO 766
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLLGIAARLDPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVRSGWRLPANSEQTR

SEQ ID NO: 777 - protein, 384 aa, Artificial
  Substituion in SEQ ID NO 766
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLIGIAARLEPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVRSGWRLPANSEQTR

SEQ ID NO: 778 - DNA, 1155 bp, Artificial
  Substituion in SEQ ID NO 767
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgaaaagtggctggaggcttccggcgaactctgaacagacgaggtga

SEQ ID NO: 779 - DNA, 1155 bp, Artificial
  Substituion in SEQ ID NO 767
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggatcggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 780 - DNA, 1155 bp, Artificial
  Substituion in SEQ ID NO 767
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctaaatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 781 - DNA, 1155 bp, Artificial
  Substituion in SEQ ID NO 767
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgttaggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 782 - DNA, 1155 bp, Artificial
  Substituion in SEQ ID NO 767
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgaaccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 783 - protein, 218 aa, Alicyclobacillus acidocaldarius
MMGHLEETVKSLLRRRSMSMRQLATATGISVSTISKMIAGKQRVNLDYLRRIADALGVPPLTLAEAAGLPLIKEPIGPTDGDRQTSMNALLEYLGLGNLNVLRTEIERELEKYEAYAQTEEGRQFIAEKYLAKRGQIQGIGDFLRDLDDIYDRFSRPDTPEDERRILASGILYFLLATDAIPDYLFPAGYLDDAIAMQMVRERLARRREMKDQGAEGS

SEQ ID NO: 784 - DNA, 657 bp, Alicyclobacillus acidocaldarius
atgatgggacatttggaagagacggtgaagtctttgctgagacgccgctcgatgtccatgcgccagttggccaccgccacgggtatcagcgtcagcacgatttcgaagatgatcgccgggaaacagagggtgaatttggactacctgcggcgcatcgcggacgcactcggcgtaccaccgctcaccctggcggaagccgcggggctcccactcatcaaggagcccatagggccaaccgatggcgatcggcagacgtcgatgaacgcgcttctcgagtacctcggccttgggaatttgaatgttctgcggacggagatcgaacgagagcttgagaaatatgaggcatacgcgcagacggaagagggacgacaattcattgcggaaaagtacctcgcgaagcgaggtcaaattcaaggcatcggagatttcctgcgcgatctcgacgacatctacgatcgattttctcggccagacacgcctgaggacgaaaggcggatcttggccagtggaatcctgtacttcctgctcgccacggacgccatcccggattatttgtttcctgcaggatatttggatgacgcgatcgccatgcaaatggtgcgcgagcgtctggcgcgccgccgggaaatgaaggaccagggtgcagagggttcctga

SEQ ID NO: 785 - protein, 189 aa, Bacillus cereus subsp. cytotoxis NVH 391-98
QLGTLTNIDPSTISRIISGKQQAKQKHLQKFAECLKVPPQLLYGALHSASSPIKKEKIDMYNSIDTIQDTLQSSNLFDYDYTTIRVKQELENYERYAQTTEGQMRIHESFSTKLKQIDSTGPFIEQLTEMYQQFCKDTISETERAVIGSALLYFVLSTDIIPDYIFPIGYLDDAIAVELVKEKLAHFRK

SEQ ID NO: 786 - protein, 201 aa, Bacillus thuringiensis serovar konkukian str. 97-27
LSKLIKKLLKERALSMRQLGMLTNIDPATISRIMNGKQPPKQKHLQKFAECLQVPPQLLFDEMYPDSPHINKEKTDMYTSLDTIQQTLQSSNLFDFDYTTTRVKQELENYERYAQTTEGEKRIHESFASKLEQIDSAGPFIEQLTDMYQQFCNETIPKEERAVLGGALLYFILSTDIIPDYLFPIGYLDDAIAVELAKEKL

SEQ ID NO: 787 - protein, 184 aa, Bacillus thuringiensis str. Al Hakam
QLGMLTNIDPATISRIMNGKQPPKQKHLQKFAECLQVPPQLLFDEMYPDSPHINKEKTDMYTSLDTIQQTLQSSNLFDFDYTTTRVKQELENYERYAQTTEGEKRIHESFASKLEQIDSAGPFIEQLTDMYQQFCNETIPKEERAVLGGALLYFILSTDIIPDYLFPIGYLDDAIAVELAKEKL

SEQ ID NO: 788 - protein, 184 aa, Bacillus cereus G9241; identical to SEQ ID NO: 787

SEQ ID NO: 789 - protein, 203 aa, Paenibacillus larvae subsp. larvae BRL-230010
LGSTIKALLKERSLSMRKLSALTGIDTATISRIVNGKQAAKPDHLKVFALHLGVPVERLFQAAGYDVGTNKTSTEIGIHTSINRIKEVLQSSNFFDYELTTELVQKELFKYEQYALTEEGQRVIHNEFSSKVEKVNGSGPFIDELRQMHELFCSREVSQDTRAIAGSALLYFILSADIIPDYVFPIGYLDDAIAVQMVRNRLS

SEQ ID NO: 790 - protein, 218 aa, Artificial
  Substituion in SEQ ID NO 783
MMGHLEETVKSLLRRRSMSMRQLATATGISVSTISKMIAGKQRVNLDYLRRIADALGVPPLTLAEAAGLPLIKEPIGPTDGDRQTSMNALLEYLGLGNLNVLRTEIERELEKYEAYAQTEEGRQFIAEKYLAKRGQIQGIGDFLRDLDDIYDRFSKPDTPEDERRILASGILYFLLATDAIPDYLFPAGYLDDAIAMQMVRERLARRREMKDQGAEGS

SEQ ID NO: 791 - protein, 218 aa, Artificial
  Substituion in SEQ ID NO 783
MMGHLEETVKSLLRRRSMSMRQLATATGISISTISKMIAGKQRVNLDYLRRIADALGVPPLTLAEAAGLPLIKEPIGPTDGDRQTSMNALLEYLGLGNLNVLRTEIERELEKYEAYAQTEEGRQFIAEKYLAKRGQIQGIGDFLRDLDDIYDRFSRPDTPEDERRILASGILYFLLATDAIPDYLFPAGYLDDAIAMQMVRERLARRREMKDQGAEGS

SEQ ID NO: 792 - protein, 218 aa, Artificial
  Substituion in SEQ ID NO 783
MMGHLEETVKSLLRRRSMSMRQLATATGISVSTISKMIAGKQRVNLDYLRRIADALGVPPLTLAEAAGLPLIKEPIGPTDGDRQTSMNALLEYLGLGNLNVLRTEIERELEKYEAYAQTEEGRQFIAEKYLAKRGQIQGIGDFLRDLDDIYDRFSRPDTPEDDRRILASGILYFLLATDAIPDYLFPAGYLDDAIAMQMVRERLARRREMKDQGAEGS

SEQ ID NO: 793 - protein, 218 aa, Artificial
  Substituion in SEQ ID NO 783
MMGHLEETVKSLLRRRSMSMRQLATATGISVSTISKMIAGKQRVNLDYLRRIADALGVPPLTLAEAAGLPLIKEPIGPTDGDRQTSMNALLEYLGLGNLNVLRTEIERELEKYEAYAQTEEGRQFIAEKYLAKRGQIQGIGDFLRDLDDIYDRFSRPDTPEDERRILASGILYFLLATDAIPDYLFPAGYLDDAIAMQMVRERLARKREMKDQGAEGS

SEQ ID NO: 794 - protein, 218 aa, Artificial
  Substituion in SEQ ID NO 783
MMGHLEETVKSLLRRRSMSMRQLATATGISVSTISKMIAGKQRINLDYLRRIADALGVPPLTLAEAAGLPLIKEPIGPTDGDRQTSMNALLEYLGLGNLNVLRTEIERELEKYEAYAQTEEGRQFIAEKYLAKRGQIQGIGDFLRDLDDIYDRFSRPDTPEDERRILASGILYFLLATDAIPDYLFPAGYLDDAIAMQMVRERLARRREMKDQGAEGS

SEQ ID NO: 795 - DNA, 657 bp, Artificial
  Substituion in SEQ ID NO 784
atgatgggacatttggaagagacggtgaagtctttgctgagacgccgctcgatgtccatgcgccagttggccaccgccacgggtatcagcgtcagcacgatttcgaagatgatcgccgggaaacagagggtgaatttggactacctgcggcgcatcgcggacgcactcggcgtaccaccgctcaccctggcggaagccgcggggctcccactcatcaaggagcccatagggccaaccgatggcgatcggcagacgtcgatgaacgcgcttctcgagtacctcggccttgggaatttgaatgttctgcggacggagatcgaacgagagcttgagaaatatgaggcatacgcgcagacggaagagggacgacaattcattgcggaaaagtacctcgcgaagcgaggtcaaattcaaggcatcggagatttcctgcgcgatctcgacgacatctacgatcgattttctaaaccagacacgcctgaggacgaaaggcggatcttggccagtggaatcctgtacttcctgctcgccacggacgccatcccggattatttgtttcctgcaggatatttggatgacgcgatcgccatgcaaatggtgcgcgagcgtctggcgcgccgccgggaaatgaaggaccagggtgcagagggttcctga

SEQ ID NO: 796 - DNA, 657 bp, Artificial
  Substituion in SEQ ID NO 784
atgatgggacatttggaagagacggtgaagtctttgctgagacgccgctcgatgtccatgcgccagttggccaccgccacgggtatcagcattagcacgatttcgaagatgatcgccgggaaacagagggtgaatttggactacctgcggcgcatcgcggacgcactcggcgtaccaccgctcaccctggcggaagccgcggggctcccactcatcaaggagcccatagggccaaccgatggcgatcggcagacgtcgatgaacgcgcttctcgagtacctcggccttgggaatttgaatgttctgcggacggagatcgaacgagagcttgagaaatatgaggcatacgcgcagacggaagagggacgacaattcattgcggaaaagtacctcgcgaagcgaggtcaaattcaaggcatcggagatttcctgcgcgatctcgacgacatctacgatcgattttctcggccagacacgcctgaggacgaaaggcggatcttggccagtggaatcctgtacttcctgctcgccacggacgccatcccggattatttgtttcctgcaggatatttggatgacgcgatcgccatgcaaatggtgcgcgagcgtctggcgcgccgccgggaaatgaaggaccagggtgcagagggttcctga

SEQ ID NO: 797 - DNA, 657 bp, Artificial
  Substituion in SEQ ID NO 784
atgatgggacatttggaagagacggtgaagtctttgctgagacgccgctcgatgtccatgcgccagttggccaccgccacgggtatcagcgtcagcacgatttcgaagatgatcgccgggaaacagagggtgaatttggactacctgcggcgcatcgcggacgcactcggcgtaccaccgctcaccctggcggaagccgcggggctcccactcatcaaggagcccatagggccaaccgatggcgatcggcagacgtcgatgaacgcgcttctcgagtacctcggccttgggaatttgaatgttctgcggacggagatcgaacgagagcttgagaaatatgaggcatacgcgcagacggaagagggacgacaattcattgcggaaaagtacctcgcgaagcgaggtcaaattcaaggcatcggagatttcctgcgcgatctcgacgacatctacgatcgattttctcggccagacacgcctgaggacgataggcggatcttggccagtggaatcctgtacttcctgctcgccacggacgccatcccggattatttgtttcctgcaggatatttggatgacgcgatcgccatgcaaatggtgcgcgagcgtctggcgcgccgccgggaaatgaaggaccagggtgcagagggttcctga

SEQ ID NO: 798 - DNA, 657 bp, Artificial
  Substituion in SEQ ID NO 784
atgatgggacatttggaagagacggtgaagtctttgctgagacgccgctcgatgtccatgcgccagttggccaccgccacgggtatcagcgtcagcacgatttcgaagatgatcgccgggaaacagagggtgaatttggactacctgcggcgcatcgcggacgcactcggcgtaccaccgctcaccctggcggaagccgcggggctcccactcatcaaggagcccatagggccaaccgatggcgatcggcagacgtcgatgaacgcgcttctcgagtacctcggccttgggaatttgaatgttctgcggacggagatcgaacgagagcttgagaaatatgaggcatacgcgcagacggaagagggacgacaattcattgcggaaaagtacctcgcgaagcgaggtcaaattcaaggcatcggagatttcctgcgcgatctcgacgacatctacgatcgattttctcggccagacacgcctgaggacgaaaggcggatcttggccagtggaatcctgtacttcctgctcgccacggacgccatcccggattatttgtttcctgcaggatatttggatgacgcgatcgccatgcaaatggtgcgcgagcgtctggcgcgcaaacgggaaatgaaggaccagggtgcagagggttcctga

SEQ ID NO: 799 - DNA, 657 bp, Artificial
  Substituion in SEQ ID NO 784
atgatgggacatttggaagagacggtgaagtctttgctgagacgccgctcgatgtccatgcgccagttggccaccgccacgggtatcagcgtcagcacgatttcgaagatgatcgccgggaaacagaggattaatttggactacctgcggcgcatcgcggacgcactcggcgtaccaccgctcaccctggcggaagccgcggggctcccactcatcaaggagcccatagggccaaccgatggcgatcggcagacgtcgatgaacgcgcttctcgagtacctcggccttgggaatttgaatgttctgcggacggagatcgaacgagagcttgagaaatatgaggcatacgcgcagacggaagagggacgacaattcattgcggaaaagtacctcgcgaagcgaggtcaaattcaaggcatcggagatttcctgcgcgatctcgacgacatctacgatcgattttctcggccagacacgcctgaggacgaaaggcggatcttggccagtggaatcctgtacttcctgctcgccacggacgccatcccggattatttgtttcctgcaggatatttggatgacgcgatcgccatgcaaatggtgcgcgagcgtctggcgcgccgccgggaaatgaaggaccagggtgcagagggttcctga

SEQ ID NO: 800 - protein, 87 aa, Alicyclobacillus acidocaldarius
MVEKVLTVNLPQGLAARPAAEFVKRASSFSSQIRIGKNGHFVDAKSVLGVMSMAIARGESVTLQAEGSDAERAVETLAELLSRDTFE

SEQ ID NO: 801 - DNA, 264 bp, Alicyclobacillus acidocaldarius
atggtggagaaggtcctgaccgtcaatcttcctcaggggctcgcggcgcggccagcggcggagtttgtcaagcgggcgtcatcgttttccagtcagattcggattgggaaaaacggtcatttcgtcgatgcgaagagcgtcctcggcgtgatgtccatggccattgcgcgcggggaatcggtcaccctgcaggccgaggggagcgacgcagagcgggcggtagagacactcgcggaattgctgtcgcgcgatacgttcgagtga

SEQ ID NO: 802 - protein, 81 aa, Bacillus coagulans 36D1
MIEKQLEVKLKSGLQARPAAQFVQEATRFSSEIFLEKEGRKVNAKSIMGLMTLAAGHGETVTLSVDGSDEEEAFEHLANYI

SEQ ID NO: 803 - protein, 84 aa, Bacillus pumilus SAFR-032
MVEKTVTIQLKTGLQARPAALFVQEANRFGADIFLEKDGKKVNAKSIMGLMSLAISSGVTITLIADGADEQEAIEALTDFVNQE

SEQ ID NO: 804 - protein, 85 aa, Bacillus sp. SG-1
MIEQKVEVKLKTGLQARPAALFVQEANRFSSEVFLERNGKKVNAKSIMGLMSLAVSSGTEITLIADGTDEEQAVKHLTEFVQKES

SEQ ID NO: 805 - protein, 78 aa, Bacillus cereus ATCC 14579
MVQKRVQVSLKNGLQARPAALFVQEANRFHADIFIEKDGKTVNAKSIMGIMSLAIGTGSMITITTEGSDAEEALEALA

SEQ ID NO: 806 - protein, 77 aa, Oceanobacillus iheyensis HTE831
MVEKLVTVELDTGLQARPAAQFVQEANRFSSHVFLEKDDKKINAKSIMGLMSLAITKGEQIKLIAEGPDEDTAIEHL

SEQ ID NO: 807 - protein, 87 aa, Artificial
  Substituion in SEQ ID NO 800
MVEKVLTVNLPQGLAARPAAEFVKRASSFSSQIRIGKNGHFVDAKSVLGVMSMAIARGESVTLQAEGSDAERAVETLADLLSRDTFE

SEQ ID NO: 808 - protein, 87 aa, Artificial
  Substituion in SEQ ID NO 800
MVEKVLTVNLPQGLAARPAAEFVKRASSFSSQIRIGKNGHFVDAKSVLGVMSMAIARGESVTLQAEGSDAEKAVETLAELLSRDTFE

SEQ ID NO: 809 - protein, 87 aa, Artificial
  Substituion in SEQ ID NO 800
MVEKVLTVNLPQGLAARPAAEFVKRASSFSSQIRIGKNGHFVEAKSVLGVMSMAIARGESVTLQAEGSDAERAVETLAELLSRDTFE

SEQ ID NO: 810 - protein, 87 aa, Artificial
  Substituion in SEQ ID NO 800
MVEKVLTVNLPQGLAARPAAEFVKRASSFSSQIKIGKNGHFVDAKSVLGVMSMAIARGESVTLQAEGSDAERAVETLAELLSRDTFE

SEQ ID NO: 811 - protein, 87 aa, Artificial
  Substituion in SEQ ID NO 800
MIEKVLTVNLPQGLAARPAAEFVKRASSFSSQIRIGKNGHFVDAKSVLGVMSMAIARGESVTLQAEGSDAERAVETLAELLSRDTFE

SEQ ID NO: 812 - DNA, 264 bp, Artificial
  Substituion in SEQ ID NO 801
atggtggagaaggtcctgaccgtcaatcttcctcaggggctcgcggcgcggccagcggcggagtttgtcaagcgggcgtcatcgttttccagtcagattcggattgggaaaaacggtcatttcgtcgatgcgaagagcgtcctcggcgtgatgtccatggccattgcgcgcggggaatcggtcaccctgcaggccgaggggagcgacgcagagcgggcggtagagacactcgcggatttgctgtcgcgcgatacgttcgagtga

SEQ ID NO: 813 - DNA, 264 bp, Artificial
  Substituion in SEQ ID NO 801
atggtggagaaggtcctgaccgtcaatcttcctcaggggctcgcggcgcggccagcggcggagtttgtcaagcgggcgtcatcgttttccagtcagattcggattgggaaaaacggtcatttcgtcgatgcgaagagcgtcctcggcgtgatgtccatggccattgcgcgcggggaatcggtcaccctgcaggccgaggggagcgacgcagagaaagcggtagagacactcgcggaattgctgtcgcgcgatacgttcgagtga

SEQ ID NO: 814 - DNA, 264 bp, Artificial
  Substituion in SEQ ID NO 801
atggtggagaaggtcctgaccgtcaatcttcctcaggggctcgcggcgcggccagcggcggagtttgtcaagcgggcgtcatcgttttccagtcagattcggattgggaaaaacggtcatttcgtcgaagcgaagagcgtcctcggcgtgatgtccatggccattgcgcgcggggaatcggtcaccctgcaggccgaggggagcgacgcagagcgggcggtagagacactcgcggaattgctgtcgcgcgatacgttcgagtga

SEQ ID NO: 815 - DNA, 264 bp, Artificial
  Substituion in SEQ ID NO 801
atggtggagaaggtcctgaccgtcaatcttcctcaggggctcgcggcgcggccagcggcggagtttgtcaagcgggcgtcatcgttttccagtcagattaaaattgggaaaaacggtcatttcgtcgatgcgaagagcgtcctcggcgtgatgtccatggccattgcgcgcggggaatcggtcaccctgcaggccgaggggagcgacgcagagcgggcggtagagacactcgcggaattgctgtcgcgcgatacgttcgagtga

SEQ ID NO: 816 - DNA, 264 bp, Artificial
  Substituion in SEQ ID NO 801
atgattgagaaggtcctgaccgtcaatcttcctcaggggctcgcggcgcggccagcggcggagtttgtcaagcgggcgtcatcgttttccagtcagattcggattgggaaaaacggtcatttcgtcgatgcgaagagcgtcctcggcgtgatgtccatggccattgcgcgcggggaatcggtcaccctgcaggccgaggggagcgacgcagagcgggcggtagagacactcgcggaattgctgtcgcgcgatacgttcgagtga

SEQ ID NO: 817 - protein, 242 aa, Alicyclobacillus acidocaldarius
MDQVPGLLTLLALVFKDVSLFVSYVKQGAFPHPLSPEEEERAIRDYLAGDADARNRLIEHNLRLVAHLAKKYESSGEEMDDLISIGTIGLIKAVESYRPDKGTKLATYAARCIENEILMYLRSSKKHRRDAFLSDPVGTDKDGNEMTLADLLGSDPDDVIDAVDMSWEKQKMFECLPLLAPREREVLCKRFGLPDGEERTQREIAKELGISRSYVSRIEQKAIVKLYENMRQRKPAGSGADA

SEQ ID NO: 818 - DNA, 729 bp, Alicyclobacillus acidocaldarius
gtggaccaagtgcccggcttgctcacgctgctggcgctcgtgttcaaggacgtctcgctgtttgtctcgtatgtcaagcagggcgcttttcctcacccgctgagccccgaggaggaagagcgcgcaattcgcgactacctcgcgggcgacgccgacgcgcgcaatcgcctcatcgagcacaacctgcgcctcgtggcgcacctggccaagaagtacgagtcgtccggcgaggagatggacgatctcatctccatcggcaccatcgggcttatcaaggcggtcgagagctatcggcccgacaagggcacgaagctcgcgacctacgccgcccgctgcatcgagaacgaaatcctcatgtacctgcgcagcagcaagaagcatcggcgcgacgcctttttgtctgatcccgtcggcaccgacaaggacggcaacgagatgacgctcgcggaccttttgggttccgatccggacgacgtgatcgacgccgtggatatgtcctgggagaagcagaagatgttcgagtgcctgccgcttctcgcgccgcgcgagcgggaggtgctgtgcaagcggtttgggctgccggacggggaggagcgaacgcagcgggagatcgcgaaggaactcggcatttcgcgcagctacgtttcgcgcattgagcaaaaggccattgtgaaattgtacgaaaacatgcgccagcgaaaacctgccggctcgggcgcagacgcgtag

SEQ ID NO: 819 - protein, 230 aa, Geobacillus thermodenitrificans NG80-2
GIFSAFAFLLKELTFLVSYIKNNAFPQPLSPKEEEKYLELMAKGDEQARNRLIEHNLRLVAHIVKKFENTGEEVEDLISIGTIGLIKAIESYSPNKGTKLATYAARCIENEILMHLRSLKKTRKDVSLHEPIGQDKEGNEISLLDILKSEGQDIVDEIQLNMELEQVKKYISVLDEREKEVIVNRFGLGRQREKTQREIAKELGISRSYVSRIEKRALMKMFHEFYRQEK

SEQ ID NO: 820 - protein, 221 aa, Bacillus halodurans C-125
IIAALTYFFKEVLVFVSYVKNNAFPQPLSKEEERHYLKRMAEGDEEARNRLIEHNLRLVAHIVKKFENTREHTEDLISIGTIGLIKAIESFSEGKGTKLATYAARCIENEILMHLRALKKVKKDVSLHDPIGTDKEGNEITLIDVLQEDSEDIADSIQLKMEKKQIYEYIHVLDDREKEVIVGRFGLDLEEERTQREIAKELGISRSYVSRIEKRALMKLF

SEQ ID NO: 821 - protein, 222 aa, Bacillus clausii KSM-K16
GILAALTYFMKEVFVFVSYVKNNAFPQPLSKEDEKKYLARMAEGDASARNMLIEHNLRLVAHIVKKFENTREDVEDLISIGTIGLIKAIESYSEGKGTKLATYAARCIENEILMHLRALKKVKKDVSLHDPIGTDKEGNEITLIDILKDDGEDIVDVLQTEMEKKQIYEYIHVLDEREKEVIIGRFGLNMEEERTQREIAKELNISRSYVSRIEKRALMKLF

SEQ ID NO: 822 - protein, 230 aa, Geobacillus kaustophilus HTA426
GIFTAFTFLLKELTFLVSYIKNNAFPQPLSAQEEEKYLALMAKGDEQARNRLIEHNLRLVAHIVKKFENTGEEVEDLISIGTIGLIKAIESYSPGKGTKLATYAARCIENEILMHLRSLKKTRKDVSLHEPIGQDKEGNEISLLDILKAEGEDIADEIHLNMELEQVKQYISVLDEREKEVIINRFGLGRQREKTQREIAKELGISRSYVSRIEKRALMKMFHEFYRQEK

SEQ ID NO: 823 - protein, 229 aa, Bacillus sp. SG-1
IATAIGYFLKELVFLVSYVKNNAFPQPLSSQEEKKYLRKMANGDEDARNILIEHNLRLVAHIVKKFENTGEDPEDLISIGTIGLIKAIESYSEGKGTKLATYAARCIENEILMHLRALKKTKKDVSLHDPIGQDKEGNEISLIDILKSDADDVIETIQLSMELEKVRKYICVLDDREKEVIIGRFGLDMKEEKTQREIAKELGISRSYVSRIEKRALMKMFHEFYREEK

SEQ ID NO: 824 - protein, 242 aa, Artificial
  Substituion in SEQ ID NO 817
MDQVPGLLTLLALVFKDVSLFVSYVKQGAFPHPLSPEEEERAIRDYLAGDADARNRLIEHNLRLVAHLAKKYESSGEEMDDLISIGTIGLIKAVESYRPDKGTKLATYAARCIENEILMYLRSSKKHRRDAFLSDPVGTDKDGNEMTLADLLGSDPDDVIDAVDMSWEKQKMFECLPLLAPREREVLCKRFGLPDGEERTQREIAKELGISRSYVSRIEQKAIVKLYENMRQKKPAGSGADA

SEQ ID NO: 825 - protein, 242 aa, Artificial
  Substituion in SEQ ID NO 817
MDQVPGLLTLLALVFKDVSLFVSYVKQGAFPHPLSPEEEERAIRDYLAGDADARNRLIEHNLRLVAHLAKKYESSGEEMDDLISIGTIGLIKAVESYRPDKGTKLATYAARCIENEILMYLRSSKKHRRDAFLSDPVGTDKDGNEMTLADLLGSEPDDVIDAVDMSWEKQKMFECLPLLAPREREVLCKRFGLPDGEERTQREIAKELGISRSYVSRIEQKAIVKLYENMRQRKPAGSGADA

SEQ ID NO: 826 - protein, 242 aa, Artificial
  Substituion in SEQ ID NO 817
MDQVPGLLTLLALVFKDVSLFVSYVKQGAFPHPLSPEEEERAIRDYLAGDADARNRLIEHNLRLVAHLAKKYESSGEEMDDLISIGTIGLIKAVESYRPDKGTKLATYAARCIENEILMYLRSSKKHRRDAFLSDPVGTDKDGNEMTLADLLGSDPDDVIDAVDMSWEKNKMFECLPLLAPREREVLCKRFGLPDGEERTQREIAKELGISRSYVSRIEQKAIVKLYENMRQRKPAGSGADA

SEQ ID NO: 827 - protein, 242 aa, Artificial
  Substituion in SEQ ID NO 817
MDQVPGLLTLLALVFKDVSLFVSYVKQGAFPHPLSPEEEERAIREYLAGDADARNRLIEHNLRLVAHLAKKYESSGEEMDDLISIGTIGLIKAVESYRPDKGTKLATYAARCIENEILMYLRSSKKHRRDAFLSDPVGTDKDGNEMTLADLLGSDPDDVIDAVDMSWEKQKMFECLPLLAPREREVLCKRFGLPDGEERTQREIAKELGISRSYVSRIEQKAIVKLYENMRQRKPAGSGADA

SEQ ID NO: 828 - protein, 242 aa, Artificial
  Substituion in SEQ ID NO 817
MDQVPGLLTLLALVFKDVSLFVSYVKQGAFPHPLSPEEEERAIRDYLAGDADARNRLIEHNLRLVAHIAKKYESSGEEMDDLISIGTIGLIKAVESYRPDKGTKLATYAARCIENEILMYLRSSKKHRRDAFLSDPVGTDKDGNEMTLADLLGSDPDDVIDAVDMSWEKQKMFECLPLLAPREREVLCKRFGLPDGEERTQREIAKELGISRSYVSRIEQKAIVKLYENMRQRKPAGSGADA

SEQ ID NO: 829 - DNA, 729 bp, Artificial
  Substituion in SEQ ID NO 818
gtggaccaagtgcccggcttgctcacgctgctggcgctcgtgttcaaggacgtctcgctgtttgtctcgtatgtcaagcagggcgcttttcctcacccgctgagccccgaggaggaagagcgcgcaattcgcgactacctcgcgggcgacgccgacgcgcgcaatcgcctcatcgagcacaacctgcgcctcgtggcgcacctggccaagaagtacgagtcgtccggcgaggagatggacgatctcatctccatcggcaccatcgggcttatcaaggcggtcgagagctatcggcccgacaagggcacgaagctcgcgacctacgccgcccgctgcatcgagaacgaaatcctcatgtacctgcgcagcagcaagaagcatcggcgcgacgcctttttgtctgatcccgtcggcaccgacaaggacggcaacgagatgacgctcgcggaccttttgggttccgatccggacgacgtgatcgacgccgtggatatgtcctgggagaagcagaagatgttcgagtgcctgccgcttctcgcgccgcgcgagcgggaggtgctgtgcaagcggtttgggctgccggacggggaggagcgaacgcagcgggagatcgcgaaggaactcggcatttcgcgcagctacgtttcgcgcattgagcaaaaggccattgtgaaattgtacgaaaacatgcgccagaaaaaacctgccggctcgggcgcagacgcgtag

SEQ ID NO: 830 - DNA, 729 bp, Artificial
  Substituion in SEQ ID NO 818
gtggaccaagtgcccggcttgctcacgctgctggcgctcgtgttcaaggacgtctcgctgtttgtctcgtatgtcaagcagggcgcttttcctcacccgctgagccccgaggaggaagagcgcgcaattcgcgactacctcgcgggcgacgccgacgcgcgcaatcgcctcatcgagcacaacctgcgcctcgtggcgcacctggccaagaagtacgagtcgtccggcgaggagatggacgatctcatctccatcggcaccatcgggcttatcaaggcggtcgagagctatcggcccgacaagggcacgaagctcgcgacctacgccgcccgctgcatcgagaacgaaatcctcatgtacctgcgcagcagcaagaagcatcggcgcgacgcctttttgtctgatcccgtcggcaccgacaaggacggcaacgagatgacgctcgcggaccttttgggttccgaaccggacgacgtgatcgacgccgtggatatgtcctgggagaagcagaagatgttcgagtgcctgccgcttctcgcgccgcgcgagcgggaggtgctgtgcaagcggtttgggctgccggacggggaggagcgaacgcagcgggagatcgcgaaggaactcggcatttcgcgcagctacgtttcgcgcattgagcaaaaggccattgtgaaattgtacgaaaacatgcgccagcgaaaacctgccggctcgggcgcagacgcgtag

SEQ ID NO: 831 - DNA, 729 bp, Artificial
  Substituion in SEQ ID NO 818
gtggaccaagtgcccggcttgctcacgctgctggcgctcgtgttcaaggacgtctcgctgtttgtctcgtatgtcaagcagggcgcttttcctcacccgctgagccccgaggaggaagagcgcgcaattcgcgactacctcgcgggcgacgccgacgcgcgcaatcgcctcatcgagcacaacctgcgcctcgtggcgcacctggccaagaagtacgagtcgtccggcgaggagatggacgatctcatctccatcggcaccatcgggcttatcaaggcggtcgagagctatcggcccgacaagggcacgaagctcgcgacctacgccgcccgctgcatcgagaacgaaatcctcatgtacctgcgcagcagcaagaagcatcggcgcgacgcctttttgtctgatcccgtcggcaccgacaaggacggcaacgagatgacgctcgcggaccttttgggttccgatccggacgacgtgatcgacgccgtggatatgtcctgggagaagaataagatgttcgagtgcctgccgcttctcgcgccgcgcgagcgggaggtgctgtgcaagcggtttgggctgccggacggggaggagcgaacgcagcgggagatcgcgaaggaactcggcatttcgcgcagctacgtttcgcgcattgagcaaaaggccattgtgaaattgtacgaaaacatgcgccagcgaaaacctgccggctcgggcgcagacgcgtag

SEQ ID NO: 832 - DNA, 729 bp, Artificial
  Substituion in SEQ ID NO 818
gtggaccaagtgcccggcttgctcacgctgctggcgctcgtgttcaaggacgtctcgctgtttgtctcgtatgtcaagcagggcgcttttcctcacccgctgagccccgaggaggaagagcgcgcaattcgcgaatacctcgcgggcgacgccgacgcgcgcaatcgcctcatcgagcacaacctgcgcctcgtggcgcacctggccaagaagtacgagtcgtccggcgaggagatggacgatctcatctccatcggcaccatcgggcttatcaaggcggtcgagagctatcggcccgacaagggcacgaagctcgcgacctacgccgcccgctgcatcgagaacgaaatcctcatgtacctgcgcagcagcaagaagcatcggcgcgacgcctttttgtctgatcccgtcggcaccgacaaggacggcaacgagatgacgctcgcggaccttttgggttccgatccggacgacgtgatcgacgccgtggatatgtcctgggagaagcagaagatgttcgagtgcctgccgcttctcgcgccgcgcgagcgggaggtgctgtgcaagcggtttgggctgccggacggggaggagcgaacgcagcgggagatcgcgaaggaactcggcatttcgcgcagctacgtttcgcgcattgagcaaaaggccattgtgaaattgtacgaaaacatgcgccagcgaaaacctgccggctcgggcgcagacgcgtag

SEQ ID NO: 833 - DNA, 729 bp, Artificial
  Substituion in SEQ ID NO 818
gtggaccaagtgcccggcttgctcacgctgctggcgctcgtgttcaaggacgtctcgctgtttgtctcgtatgtcaagcagggcgcttttcctcacccgctgagccccgaggaggaagagcgcgcaattcgcgactacctcgcgggcgacgccgacgcgcgcaatcgcctcatcgagcacaacctgcgcctcgtggcgcacattgccaagaagtacgagtcgtccggcgaggagatggacgatctcatctccatcggcaccatcgggcttatcaaggcggtcgagagctatcggcccgacaagggcacgaagctcgcgacctacgccgcccgctgcatcgagaacgaaatcctcatgtacctgcgcagcagcaagaagcatcggcgcgacgcctttttgtctgatcccgtcggcaccgacaaggacggcaacgagatgacgctcgcggaccttttgggttccgatccggacgacgtgatcgacgccgtggatatgtcctgggagaagcagaagatgttcgagtgcctgccgcttctcgcgccgcgcgagcgggaggtgctgtgcaagcggtttgggctgccggacggggaggagcgaacgcagcgggagatcgcgaaggaactcggcatttcgcgcagctacgtttcgcgcattgagcaaaaggccattgtgaaattgtacgaaaacatgcgccagcgaaaacctgccggctcgggcgcagacgcgtag

SEQ ID NO: 834 - protein, 343 aa, Alicyclobacillus acidocaldarius
MVISWNAARRVRLKPCHLPISRSSPRTDLAVEARELALREGHIRGVEEEREEHEGVVITRVRVSTQVAARRLGKRKGTYVTIEAPGMRRRDFDLEDRLTRILADELKRLLPERAETALVIGLGNEHVTADALGPMVVNRLFVTRHLFSYMPEVLGDGEGYRSIAALAPGVLGLTGIETSEVVLGVVERIKPDVVLAVDALAARSLERLHRTIQLSDVGIQPGAGVGNHRKAIDKETLGVPVIAIGVPTVVDAATIASDAIELVFRELGRQVPGNAANRLLDQLTGQEKWQLVREVLEPIEQNLVVAPKEVDEFMENVAYLIAKSMNVALHPAMTLEDADLVTH

SEQ ID NO: 835 - DNA, 1032 bp, Alicyclobacillus acidocaldarius
atggtcatttcatggaacgcggcgcggagggtgcgcctgaagccgtgccacttgccgatctcgagatcgtctcctcgcacggatctcgccgtggaggcgcgagaactggcgcttcgggaaggccacattcgaggggtggaagaggagcgggaagagcatgagggcgtggtgatcacgcgggttcgcgtctcgacgcaggtcgccgcgaggcgcctagggaagcggaagggcacctatgtcaccatcgaggcgcccggcatgcgccgccgcgacttcgacctcgaggacaggctgacgcgcatcttggccgacgaattgaagcgccttctgcctgagcgagcggagacggcgctcgtcattggcctcgggaacgaacacgtgacagccgacgcactgggccccatggtcgtgaaccggctgtttgtcacgcgccacctgttcagttatatgcccgaggtgctcggcgacggtgagggctaccgatccatcgcggcgctcgcacccggcgtgcttgggctgaccggcatcgagacgagcgaggtggttcttggcgtggtggagcgcatcaagcccgacgtggtgctggccgtcgacgccctggcggcgcgatcgctcgagcgcctgcaccgaaccattcagctttccgacgtggggattcagccgggcgccggcgtgggcaatcaccggaaggccatcgacaaagagacgctgggcgtacctgtgattgccatcggcgtgccgacggtcgtggacgccgccaccatcgcgagcgacgccatcgagctggtgtttcgtgagctcgggcggcaggtgccgggcaatgccgccaatcgtctgctggatcagctgacaggccaggagaagtggcagttggtgcgggaagtgctggagcccatcgagcagaacctcgtcgtcgcgccgaaggaagtcgacgagttcatggagaacgtcgcctacctgatcgccaagagcatgaacgtggcgcttcatcccgcgatgacgctcgaagacgccgacctggtgacgcactga

SEQ ID NO: 836 - protein, 317 aa, Thermoanaerobacter tengcongensis MB4
RTDLALEARELYKEREIPGVSIREEGEEGIKITRVKILDERGEKAMGKPVGDYITIEAPGLLERDLDLEERVAKVLANIISELAQLKKDSHVLVVGLGNWNVTPDALGPRVVSNIVVTRHLKEYAPLQFGDEIRSVSAFSPGVLGITGIETAEILKGVVDRVKPDLVITIDALASRRLERLSTTIQISNTGISPGSGVGNRRLSITSESLGVPVIAIGVPTVVDAVTIAHDTIEYLVKELSEQTSKESVFYKVLENMNKQEKYSLIEEVLSPYVQNLVVTPKEIDLLIKNIALVISRGINLALQPGLTEKEMNQLLH

SEQ ID NO: 837 - protein, 320 aa, Alkaliphilus metalliredigens QYMF
RTDLALEVRELYQEEKQQEIPGVKVDQEEDTDVLVTRVDVMDQQGAEIMGKKQGMYITLESPGLRKADADLKDHISQVLAKELKALLPERKNLKALVVGLGNWNVTPDALGPKAVAKIHVTRHLFKMYQKESDDHMIEVSAISPGVMGTTGLETGEIIKGIVEHSRPDVVVVVDALASRKMERVNATIQISTTGISPGSGVGNKRMALDEESLGVPVIAVGVPTVVDAATLTNDTIQLVIKAFSKQAQAGSEFYSMLEKLKEEEKYGLIREVLEPYNANVMVTPKEIDDIILDLSQIIANGINIALHPGIDLKDVNRYIH

SEQ ID NO: 838 - protein, 319 aa, Thermoanaerobacter pseudethanolicus ATCC 33223
SIRTDLAVEARELYKGREIPGVRVDEKHLEGIKVTKVKILNEEGEKAMGKPVGDYITIEAPGLIERDLDLEEEVAKVLADIIKEIANLTENTQVLVVGLGNWNVTPDALGPRVVSNIVVTRHLKEYAPQQFGDEIRSVSAISPGVLGITGIETAEILKGVVDRIKPDLIITIDALASRRLERLSTTIQISNTGISPGSGIGNRRLSITEQSLGIPVIAIGVPTVVDAVTIANDTIEYLTEELLKHTKEESPFYEVLKNMSQQEKYSLIQEVLTPYVHNLVVTPKEIDLLVRNIASIISRGINLALQPGLTEREMNQLLH

SEQ ID NO: 839 - protein, 281 aa, Clostridium thermocellum ATCC 27405
TRVRVTSPTGEAAIGKPMGNYITLEVPRLKENDQELYEETCKALAKELTRVLNLKDDSTILVIGLGNWNVTPDALGPKVVSRLMVTRHLLEYVPDQVDEGVRPVCAVSPGVLGITGIETGEIVRGIVDRVKPDVVIAIDALASRKMERVNTTIQIADTGISPGSGVGNKRMELSRETLGVPVIAIGVPTVVDAATMANDTIDLVIDNLIREAKEDSHFYNMLKNIDRNEKYQLIQEVLQPYVGNLVVTPKEIDDVVDRIAKVIANGLNIALHQGITLNDVN

SEQ ID NO: 840 - protein, 317 aa, Alkaliphilus oremlandii OhILAs
PNTDLAIEARELYSEKTSGEIPGVTMDNEEIEDVLITRVEVFNETGVSIIGKPIGKYITLESNSLRKADADFKDEMSKLLAKELRRIIPQKDDIKVLVVGLGNWDVTPDALGPKVVSKIFVTRHLFQMYNKEGDVDLSEVSAISPGVMGTTGLETGEVIKGIVDNSKPDLVIVVDALASRKMERVNATIQISTTGITPGSGVGNKRKALNRETLGVPVIAIGVPTVVDAATLTNDTIDKVIDAFSRQAKVGSQFYNMLRELKEEEKYSLITEVLEPYSANIIVTPKEVDEVIVNLSQIIANGINIAVHPGIDLKDVN

SEQ ID NO: 841 - protein, 343 aa, Artificial
  Substituion in SEQ ID NO 834
MVISWNAARRVKLKPCHLPISRSSPRTDLAVEARELALREGHIRGVEEEREEHEGVVITRVRVSTQVAARRLGKRKGTYVTIEAPGMRRRDFDLEDRLTRILADELKRLLPERAETALVIGLGNEHVTADALGPMVVNRLFVTRHLFSYMPEVLGDGEGYRSIAALAPGVLGLTGIETSEVVLGVVERIKPDVVLAVDALAARSLERLHRTIQLSDVGIQPGAGVGNHRKAIDKETLGVPVIAIGVPTVVDAATIASDAIELVFRELGRQVPGNAANRLLDQLTGQEKWQLVREVLEPIEQNLVVAPKEVDEFMENVAYLIAKSMNVALHPAMTLEDADLVTH

SEQ ID NO: 842 - protein, 343 aa, Artificial
  Substituion in SEQ ID NO 834
MVISWNAARRVRLKPCHLPISRSSPRTDLAVEARELALREGHIRGVEDEREEHEGVVITRVRVSTQVAARRLGKRKGTYVTIEAPGMRRRDFDLEDRLTRILADELKRLLPERAETALVIGLGNEHVTADALGPMVVNRLFVTRHLFSYMPEVLGDGEGYRSIAALAPGVLGLTGIETSEVVLGVVERIKPDVVLAVDALAARSLERLHRTIQLSDVGIQPGAGVGNHRKAIDKETLGVPVIAIGVPTVVDAATIASDAIELVFRELGRQVPGNAANRLLDQLTGQEKWQLVREVLEPIEQNLVVAPKEVDEFMENVAYLIAKSMNVALHPAMTLEDADLVTH

SEQ ID NO: 843 - protein, 343 aa, Artificial
  Substituion in SEQ ID NO 834
MVISWNAARRVRLKPCHLPISRSSPRTDLAVEARELALREGHIRGVEEEREEHEGVVITRVRVSTQVAARRLGKRKGTYVTIEAPGMRRRDFDLEDRLTRILADELKRLLPERAETALVIGLGNEHVTADALGPMVVNRLFVTRHLFSYMPEVLGDGEGYRSIAALAPGVLGLTGIETSEVVLGVVERIKPDVVLAVDALAARSLERLHRTIQLSDVGIQPGAGVGNHRKAIDKETLGVPVIAIGVPTVVDAATIASDAIELVFRELGRQIPGNAANRLLDQLTGQEKWQLVREVLEPIEQNLVVAPKEVDEFMENVAYLIAKSMNVALHPAMTLEDADLVTH

SEQ ID NO: 844 - protein, 343 aa, Artificial
  Substituion in SEQ ID NO 834
MVISWNAARRVRLKPCHLPISRSSPRTDLAVEARELALREGHIRGVEEEREEHEGVVITRVRVSTQVAARRLGKRKGTYVTIEAPGMRRRDFDLEDRLTRILADELKRLLPERAETALVIGLGNEHVTADALGPMVVNRLFVTRHLFSYMPEVLGDGEGYRSIAALAPGVLGLTGIETSEVVLGVVERIKPDVVLAVDALAARSLERLHRTIQLSDVGIQPGAGVGNHRKAIDKETLGVPVIAIGVPTVVDAATIASDAIELVFRELGRQVPGNAANRLLDQLTGQEKWQLVREVLEPIDQNLVVAPKEVDEFMENVAYLIAKSMNVALHPAMTLEDADLVTH

SEQ ID NO: 845 - protein, 343 aa, Artificial
  Substituion in SEQ ID NO 834
MVISWNAARRVRLKPCHLPISRSSPRTDLAVEARELALREGHIRGVEEEREEHEGVVITRVRVSTQVAARRLGKRKGTYVTIEAPGMRRRDFDLEDRLTRILADELKRLLPERAETALVIGLGNEHVTADALGPMVVNRLFVTRHLFSYMPEVLGDGEGYRSIAALAPGVLGLTGIETSEVVLGVVERIKPDVVLAVDALAARSLERLHRTIQLSDVGIQPGAGVGNHRKAIDKETLGVPVIAIGVPTVVDAATIASDAIELVFRELGRQVPGNAANRLLDQLTGQEKWQLVKEVLEPIEQNLVVAPKEVDEFMENVAYLIAKSMNVALHPAMTLEDADLVTH

SEQ ID NO: 846 - DNA, 1032 bp, Artificial
  Substituion in SEQ ID NO 835
atggtcatttcatggaacgcggcgcggagggtgaaactgaagccgtgccacttgccgatctcgagatcgtctcctcgcacggatctcgccgtggaggcgcgagaactggcgcttcgggaaggccacattcgaggggtggaagaggagcgggaagagcatgagggcgtggtgatcacgcgggttcgcgtctcgacgcaggtcgccgcgaggcgcctagggaagcggaagggcacctatgtcaccatcgaggcgcccggcatgcgccgccgcgacttcgacctcgaggacaggctgacgcgcatcttggccgacgaattgaagcgccttctgcctgagcgagcggagacggcgctcgtcattggcctcgggaacgaacacgtgacagccgacgcactgggccccatggtcgtgaaccggctgtttgtcacgcgccacctgttcagttatatgcccgaggtgctcggcgacggtgagggctaccgatccatcgcggcgctcgcacccggcgtgcttgggctgaccggcatcgagacgagcgaggtggttcttggcgtggtggagcgcatcaagcccgacgtggtgctggccgtcgacgccctggcggcgcgatcgctcgagcgcctgcaccgaaccattcagctttccgacgtggggattcagccgggcgccggcgtgggcaatcaccggaaggccatcgacaaagagacgctgggcgtacctgtgattgccatcggcgtgccgacggtcgtggacgccgccaccatcgcgagcgacgccatcgagctggtgtttcgtgagctcgggcggcaggtgccgggcaatgccgccaatcgtctgctggatcagctgacaggccaggagaagtggcagttggtgcgggaagtgctggagcccatcgagcagaacctcgtcgtcgcgccgaaggaagtcgacgagttcatggagaacgtcgcctacctgatcgccaagagcatgaacgtggcgcttcatcccgcgatgacgctcgaagacgccgacctggtgacgcactga

SEQ ID NO: 847 - DNA, 1032 bp, Artificial
  Substituion in SEQ ID NO 835
atggtcatttcatggaacgcggcgcggagggtgcgcctgaagccgtgccacttgccgatctcgagatcgtctcctcgcacggatctcgccgtggaggcgcgagaactggcgcttcgggaaggccacattcgaggggtggaagatgagcgggaagagcatgagggcgtggtgatcacgcgggttcgcgtctcgacgcaggtcgccgcgaggcgcctagggaagcggaagggcacctatgtcaccatcgaggcgcccggcatgcgccgccgcgacttcgacctcgaggacaggctgacgcgcatcttggccgacgaattgaagcgccttctgcctgagcgagcggagacggcgctcgtcattggcctcgggaacgaacacgtgacagccgacgcactgggccccatggtcgtgaaccggctgtttgtcacgcgccacctgttcagttatatgcccgaggtgctcggcgacggtgagggctaccgatccatcgcggcgctcgcacccggcgtgcttgggctgaccggcatcgagacgagcgaggtggttcttggcgtggtggagcgcatcaagcccgacgtggtgctggccgtcgacgccctggcggcgcgatcgctcgagcgcctgcaccgaaccattcagctttccgacgtggggattcagccgggcgccggcgtgggcaatcaccggaaggccatcgacaaagagacgctgggcgtacctgtgattgccatcggcgtgccgacggtcgtggacgccgccaccatcgcgagcgacgccatcgagctggtgtttcgtgagctcgggcggcaggtgccgggcaatgccgccaatcgtctgctggatcagctgacaggccaggagaagtggcagttggtgcgggaagtgctggagcccatcgagcagaacctcgtcgtcgcgccgaaggaagtcgacgagttcatggagaacgtcgcctacctgatcgccaagagcatgaacgtggcgcttcatcccgcgatgacgctcgaagacgccgacctggtgacgcactga

SEQ ID NO: 848 - DNA, 1032 bp, Artificial
  Substituion in SEQ ID NO 835
atggtcatttcatggaacgcggcgcggagggtgcgcctgaagccgtgccacttgccgatctcgagatcgtctcctcgcacggatctcgccgtggaggcgcgagaactggcgcttcgggaaggccacattcgaggggtggaagaggagcgggaagagcatgagggcgtggtgatcacgcgggttcgcgtctcgacgcaggtcgccgcgaggcgcctagggaagcggaagggcacctatgtcaccatcgaggcgcccggcatgcgccgccgcgacttcgacctcgaggacaggctgacgcgcatcttggccgacgaattgaagcgccttctgcctgagcgagcggagacggcgctcgtcattggcctcgggaacgaacacgtgacagccgacgcactgggccccatggtcgtgaaccggctgtttgtcacgcgccacctgttcagttatatgcccgaggtgctcggcgacggtgagggctaccgatccatcgcggcgctcgcacccggcgtgcttgggctgaccggcatcgagacgagcgaggtggttcttggcgtggtggagcgcatcaagcccgacgtggtgctggccgtcgacgccctggcggcgcgatcgctcgagcgcctgcaccgaaccattcagctttccgacgtggggattcagccgggcgccggcgtgggcaatcaccggaaggccatcgacaaagagacgctgggcgtacctgtgattgccatcggcgtgccgacggtcgtggacgccgccaccatcgcgagcgacgccatcgagctggtgtttcgtgagctcgggcggcagattccgggcaatgccgccaatcgtctgctggatcagctgacaggccaggagaagtggcagttggtgcgggaagtgctggagcccatcgagcagaacctcgtcgtcgcgccgaaggaagtcgacgagttcatggagaacgtcgcctacctgatcgccaagagcatgaacgtggcgcttcatcccgcgatgacgctcgaagacgccgacctggtgacgcactga

SEQ ID NO: 849 - DNA, 1032 bp, Artificial
  Substituion in SEQ ID NO 835
atggtcatttcatggaacgcggcgcggagggtgcgcctgaagccgtgccacttgccgatctcgagatcgtctcctcgcacggatctcgccgtggaggcgcgagaactggcgcttcgggaaggccacattcgaggggtggaagaggagcgggaagagcatgagggcgtggtgatcacgcgggttcgcgtctcgacgcaggtcgccgcgaggcgcctagggaagcggaagggcacctatgtcaccatcgaggcgcccggcatgcgccgccgcgacttcgacctcgaggacaggctgacgcgcatcttggccgacgaattgaagcgccttctgcctgagcgagcggagacggcgctcgtcattggcctcgggaacgaacacgtgacagccgacgcactgggccccatggtcgtgaaccggctgtttgtcacgcgccacctgttcagttatatgcccgaggtgctcggcgacggtgagggctaccgatccatcgcggcgctcgcacccggcgtgcttgggctgaccggcatcgagacgagcgaggtggttcttggcgtggtggagcgcatcaagcccgacgtggtgctggccgtcgacgccctggcggcgcgatcgctcgagcgcctgcaccgaaccattcagctttccgacgtggggattcagccgggcgccggcgtgggcaatcaccggaaggccatcgacaaagagacgctgggcgtacctgtgattgccatcggcgtgccgacggtcgtggacgccgccaccatcgcgagcgacgccatcgagctggtgtttcgtgagctcgggcggcaggtgccgggcaatgccgccaatcgtctgctggatcagctgacaggccaggagaagtggcagttggtgcgggaagtgctggagcccatcgatcagaacctcgtcgtcgcgccgaaggaagtcgacgagttcatggagaacgtcgcctacctgatcgccaagagcatgaacgtggcgcttcatcccgcgatgacgctcgaagacgccgacctggtgacgcactga

SEQ ID NO: 850 - DNA, 1032 bp, Artificial
  Substituion in SEQ ID NO 835
atggtcatttcatggaacgcggcgcggagggtgcgcctgaagccgtgccacttgccgatctcgagatcgtctcctcgcacggatctcgccgtggaggcgcgagaactggcgcttcgggaaggccacattcgaggggtggaagaggagcgggaagagcatgagggcgtggtgatcacgcgggttcgcgtctcgacgcaggtcgccgcgaggcgcctagggaagcggaagggcacctatgtcaccatcgaggcgcccggcatgcgccgccgcgacttcgacctcgaggacaggctgacgcgcatcttggccgacgaattgaagcgccttctgcctgagcgagcggagacggcgctcgtcattggcctcgggaacgaacacgtgacagccgacgcactgggccccatggtcgtgaaccggctgtttgtcacgcgccacctgttcagttatatgcccgaggtgctcggcgacggtgagggctaccgatccatcgcggcgctcgcacccggcgtgcttgggctgaccggcatcgagacgagcgaggtggttcttggcgtggtggagcgcatcaagcccgacgtggtgctggccgtcgacgccctggcggcgcgatcgctcgagcgcctgcaccgaaccattcagctttccgacgtggggattcagccgggcgccggcgtgggcaatcaccggaaggccatcgacaaagagacgctgggcgtacctgtgattgccatcggcgtgccgacggtcgtggacgccgccaccatcgcgagcgacgccatcgagctggtgtttcgtgagctcgggcggcaggtgccgggcaatgccgccaatcgtctgctggatcagctgacaggccaggagaagtggcagttggtgaaagaagtgctggagcccatcgagcagaacctcgtcgtcgcgccgaaggaagtcgacgagttcatggagaacgtcgcctacctgatcgccaagagcatgaacgtggcgcttcatcccgcgatgacgctcgaagacgccgacctggtgacgcactga

SEQ ID NO: 851 - protein, 344 aa, Alicyclobacillus acidocaldarius
MLTPRQQLILSAIIEDYVRMAEPIGSRALAKHEEIQYSPATIRNEMADLEEMGYLTQPHASAGRFPSQKGYRFYVDNLLRLGQMDRETGEFLKSVFTKRIDEVEQVAREVANVLSMLTKQTVIVLGPKTDTEKLRKIELIPLGGGRAIAILVTNSGHVETVHVRFSSEMEADDVETLVRVLNDKVVGVPISELRRTLYAELAGELRRTVERFEDAIAVLNEVCQVPEREEAVYIGGASNMLAQPEFHDVGKAQPILSLLEQNESISNWFPKAEDGIEVRIGAENAVVELKDCTVIATTYRLGGVPVGHIGVLGPTRMDYNRVMQILSFTSQALTEFLTRFASSG

SEQ ID NO: 852 - DNA, 1035 bp, Alicyclobacillus acidocaldarius
atgttgacgccccgacagcaactgattttgtccgcgatcatcgaggactacgtccggatggcggaacccatcggttcgcgggcactcgccaaacatgaggagattcaatatagcccagccaccatccgaaatgagatggcggatctggaggaaatgggctatttaacccagccacacgcctcggccggacgctttccatcccagaagggctaccggttctatgtcgacaacctgttgcgcctgggacagatggatcgcgagacgggcgagtttttgaaatccgtgttcaccaagcgcatcgacgaggtggagcaggtcgcccgcgaggtggcgaacgtgctctccatgctgacgaagcagacggtgatcgtgctcgggccgaagacggacaccgaaaagttgcgcaaaatcgaactcatcccgctcggcggcggccgcgccatcgccatcttggtgaccaactccgggcacgtggagaccgtgcacgtgcgattttcgtccgagatggaggcagacgacgtcgagacgctcgtccgcgtgctgaacgacaaggtggtcggcgtgcccatctccgagcttcggcgcacgctgtacgcggagttggctggcgaattgcgccggaccgtcgagcggttcgaggacgccatcgccgtcttgaatgaggtgtgccaagtgccggagcgcgaggaggccgtctatatcggcggcgcctccaacatgctggcgcagccggagtttcacgacgtcggcaaggcgcaacccattctcagcctgctggaacagaacgagtccatctcgaactggttcccgaaggcggaggacgggattgaggtgcgcatcggcgcggaaaacgcagtggtggagttgaaggactgcacggtcattgccaccacgtaccgtttgggtggcgtgccggtgggccatattggagtgttgggccccacgcgcatggactacaatcgcgtcatgcaaattctctcgttcacctcgcaggcgctgacggagtttttgactcggtttgcgtcgagcgggtga

SEQ ID NO: 853 - protein, 337 aa, Bacillus selenitireducens MLS10
MLTERQLLILKAIIDDYVSHAEPVGSRSVSKRDDIHFSPATIRNEMSDLEDMGFLEKTHSSSGRIPSHKGYRHYVDHLLSPGQLSKEDIGNIQDVLRSRFHELEEVVRHSAKLLSELTNYTSIVLGPEMFESKLRQIQLIPISDKQAVAIIVTDTGHVENQTVHFPERINPDDLEKVVNILNDRLRGVPLYKLNEALSKEIHAVMKQYVNRHEAMLNVFHEVFRQHAREKVYFSGKTNILAQPEFNDVERVRKILNIFEEDQLVSKLFRSDQEGMTIRIGEENHFAPFDDCTIITATYEAGGQYLGTVGILGPTRMEYPRVISIMEYLATDLSKKLS

SEQ ID NO: 854 - protein, 338 aa, Bacillus licheniformis ATCC 14580
MLTNRQLLILQVIVNDFIRSAQPVGSRTLSKKEDITFSSATIRNEMADLEELGFIEKTHSSSGRIPSEKGYRYYVDHLLSPGKLSKTDLNIIHSIFKEKIFELEKAVQKSAQVLSDLTNYTSIVLGPRLSENHLKQIQIVPIQPKKAVAILVTNTGHVENKTINFPAEVDLSDLEKLVNILNERLRGVPISELKDRIFKEVVIFLKSHIQNYDTILHALGATLDSSVQTDRLFFGGKINMLNQPEFHDIDRVKSLLSLIEKEQEILRLFQSTESGITIKIGKENDYEEMENCSLITATYTVGSKQIGSIAVIGPTRMDYSRVVGLLQHVSSDLSKALT

SEQ ID NO: 855 - protein, 338 aa, Bacillus cereus ATCC 10987
MLTERQLLILQTIIDDFIGSAQPVGSRTLAKKDEITFSSATIRNEMADLEELGFIEKTHSSSGRVPSEKGYRFYVDHLLAPQNLPNDEIVQIKDLFAERIFEAEKIAQQSAQILSELTNYTAIVLGPKLSTNKLKNVQIVPLDRQTAVAIIVTDTGHVQSKTITVPESVDLSDLEKMVNILNEKLSGVPMSELHNKIFKEIVTVLRGYVHNYDSAIKILDGTFQVPLSEKIYFGGKANMLSQPEFHDIQKVRSLLTMIDNEAEFYDILRHKQVGIQVKIGRENSSTAMEDCSLISATYSIGEEQVGTIAILGPTRMQYSRVISLLQLFTRQITDGLKK

SEQ ID NO: 856 - protein, 338 aa, Bacillus cereus AH187
MLTERQLLILQTIIDDFIGSAQPVGSRTLAKKDEITFSSATIRNEMADLEELGFIEKTHSSSGRVPSEKGYRFYVDHLLAPQNLPNDEIVQIKDLFAERIFEAEKIAQQSAQILSELTNYTAIVLGPKLSTNKLKNVQIVPLDRQTAVAIIVTDTGHVQSKTITVPESVDLSDLEKMVNILNEKLSGVPMSELHNKIFKEIVTVLRGYVHNYDSAIKILDGTFQVPLSEKIYFGGKANMLSQPEFHDIQKVRSLLTMIDNEAEFYDILRHKQVGIQVKIGRENSATAMEDCSLISATYSIGEEQLGTIAILGPTRMQYSRVISLLQLFTRQITDGLKK

SEQ ID NO: 857 - protein, 338 aa, Bacillus thuringiensis serovar konkukian str. 97-27
MLTERQLLILQTIIDDFIGSAQPVGSRTLAKKDEITYSSATIRNEMADLEELGFIEKTHSSSGRVPSEKGYRFYVDHLLAPQNLPNDEIVQIKDLFAERIFEAEKIAQQSAQILSELTNYTAIVLGPKLSTNKLKNVQIVPLDRQTAVAIIVTDTGHVQSKTITVPESVDLSDLEKMVNILNEKLSGVPMSELHNKIFKEIVTVLRGYVHNYDSAIKMLDGTFQVPLSEKIYFGGKANMLSQPEFHDIHKVRSLLTMIDNEAEFYDILRHKQVGIQVKIGRENSATAMEDCSLISATYSIGEEQLGTIAILGPTRMQYSRVISLLQLFTRQFTDGLKK

SEQ ID NO: 858 - protein, 344 aa, Artificial
  Substituion in SEQ ID NO 851
MLTPRQQLILSAIIEDYVRMAEPIGSRALAKHEEIQYSPATIRNEMADLEEMGYLTQPHASAGRFPSNKGYRFYVDNLLRLGQMDRETGEFLKSVFTKRIDEVEQVAREVANVLSMLTKQTVIVLGPKTDTEKLRKIELIPLGGGRAIAILVTNSGHVETVHVRFSSEMEADDVETLVRVLNDKVVGVPISELRRTLYAELAGELRRTVERFEDAIAVLNEVCQVPEREEAVYIGGASNMLAQPEFHDVGKAQPILSLLEQNESISNWFPKAEDGIEVRIGAENAVVELKDCTVIATTYRLGGVPVGHIGVLGPTRMDYNRVMQILSFTSQALTEFLTRFASSG

SEQ ID NO: 859 - protein, 344 aa, Artificial
  Substituion in SEQ ID NO 851
MLTPRQQLILSAIIEDYVRMAEPIGSRALAKHEEIQYSPATIRNEMADLEEMGYLTQPHASAGRFPSQKGYRFYVDNLLRLGQMDRETGEFLKSVFTKRIDEVEQVAREVANVLSMLTKQTVIVLGPKTDTEKLRKIELIPLGGGRAIAILVTNSGHVETVHVRFSSEMEADDVETLVRVLNDKVVGVPISELRRTLYAELAGEIRRTVERFEDAIAVLNEVCQVPEREEAVYIGGASNMLAQPEFHDVGKAQPILSLLEQNESISNWFPKAEDGIEVRIGAENAVVELKDCTVIATTYRLGGVPVGHIGVLGPTRMDYNRVMQILSFTSQALTEFLTRFASSG

SEQ ID NO: 860 - protein, 344 aa, Artificial
  Substituion in SEQ ID NO 851
MLTPRQQLILSAIIEDYVRMAEPIGSRALAKHEEIQYSPATIRNEMADLEEMGYLTQPHASAGRFPSQKGYRFYVDNLLRLGQMDRETGEFLKSVFTKRIDEVEQVAREVANVLSMLTKQTVIVLGPKTDTEKLRKIELIPLGGGRAIAILVTNSGHVETVHVRFSSEMEADDVETLVRVLNDKVVGVPISELRRTLYAELAGELRRTVERFEDAIAVLNEVCQVPEREEAVYIGGASNMLAQPEFHDVGKAQPILSLLEQNESISNWFPKAEDGIEVRIGAENAVVELKDCTVIATTYRLGGVPVGHIGVIGPTRMDYNRVMQILSFTSQALTEFLTRFASSG

SEQ ID NO: 861 - protein, 344 aa, Artificial
  Substituion in SEQ ID NO 851
MLTPRQQLILSAIIEDYVRMAEPIGSRALAKHEEIQYSPATIRNEMADLEEMGYLTQPHASAGRFPSQKGYRFYVDNLLRLGQMDRETGEFLKSVFTKRIDEVEQVAREVANVLSMLTKQTVIVLGPKTDTEKLRKIELIPLGGGRAIAILVTNSGHVDTVHVRFSSEMEADDVETLVRVLNDKVVGVPISELRRTLYAELAGELRRTVERFEDAIAVLNEVCQVPEREEAVYIGGASNMLAQPEFHDVGKAQPILSLLEQNESISNWFPKAEDGIEVRIGAENAVVELKDCTVIATTYRLGGVPVGHIGVLGPTRMDYNRVMQILSFTSQALTEFLTRFASSG

SEQ ID NO: 862 - protein, 344 aa, Artificial
  Substituion in SEQ ID NO 851
MLTPRQQLILSAIIEDYVRMAEPIGSRALAKHEEIQYSPATIRNEMADLEEMGYLTQPHASAGRFPSQKGYRFYVDNLLRLGQMDRETGEFLKSVFTKRIDEVEQVAREVANVLSMLTKQTVIVLGPKTDTEKLKKIELIPLGGGRAIAILVTNSGHVETVHVRFSSEMEADDVETLVRVLNDKVVGVPISELRRTLYAELAGELRRTVERFEDAIAVLNEVCQVPEREEAVYIGGASNMLAQPEFHDVGKAQPILSLLEQNESISNWFPKAEDGIEVRIGAENAVVELKDCTVIATTYRLGGVPVGHIGVLGPTRMDYNRVMQILSFTSQALTEFLTRFASSG

SEQ ID NO: 863 - DNA, 1035 bp, Artificial
  Substituion in SEQ ID NO 852
atgttgacgccccgacagcaactgattttgtccgcgatcatcgaggactacgtccggatggcggaacccatcggttcgcgggcactcgccaaacatgaggagattcaatatagcccagccaccatccgaaatgagatggcggatctggaggaaatgggctatttaacccagccacacgcctcggccggacgctttccatccaataagggctaccggttctatgtcgacaacctgttgcgcctgggacagatggatcgcgagacgggcgagtttttgaaatccgtgttcaccaagcgcatcgacgaggtggagcaggtcgcccgcgaggtggcgaacgtgctctccatgctgacgaagcagacggtgatcgtgctcgggccgaagacggacaccgaaaagttgcgcaaaatcgaactcatcccgctcggcggcggccgcgccatcgccatcttggtgaccaactccgggcacgtggagaccgtgcacgtgcgattttcgtccgagatggaggcagacgacgtcgagacgctcgtccgcgtgctgaacgacaaggtggtcggcgtgcccatctccgagcttcggcgcacgctgtacgcggagttggctggcgaattgcgccggaccgtcgagcggttcgaggacgccatcgccgtcttgaatgaggtgtgccaagtgccggagcgcgaggaggccgtctatatcggcggcgcctccaacatgctggcgcagccggagtttcacgacgtcggcaaggcgcaacccattctcagcctgctggaacagaacgagtccatctcgaactggttcccgaaggcggaggacgggattgaggtgcgcatcggcgcggaaaacgcagtggtggagttgaaggactgcacggtcattgccaccacgtaccgtttgggtggcgtgccggtgggccatattggagtgttgggccccacgcgcatggactacaatcgcgtcatgcaaattctctcgttcacctcgcaggcgctgacggagtttttgactcggtttgcgtcgagcgggtga

SEQ ID NO: 864 - DNA, 1035 bp, Artificial
  Substituion in SEQ ID NO 852
atgttgacgccccgacagcaactgattttgtccgcgatcatcgaggactacgtccggatggcggaacccatcggttcgcgggcactcgccaaacatgaggagattcaatatagcccagccaccatccgaaatgagatggcggatctggaggaaatgggctatttaacccagccacacgcctcggccggacgctttccatcccagaagggctaccggttctatgtcgacaacctgttgcgcctgggacagatggatcgcgagacgggcgagtttttgaaatccgtgttcaccaagcgcatcgacgaggtggagcaggtcgcccgcgaggtggcgaacgtgctctccatgctgacgaagcagacggtgatcgtgctcgggccgaagacggacaccgaaaagttgcgcaaaatcgaactcatcccgctcggcggcggccgcgccatcgccatcttggtgaccaactccgggcacgtggagaccgtgcacgtgcgattttcgtccgagatggaggcagacgacgtcgagacgctcgtccgcgtgctgaacgacaaggtggtcggcgtgcccatctccgagcttcggcgcacgctgtacgcggagttggctggcgaaattcgccggaccgtcgagcggttcgaggacgccatcgccgtcttgaatgaggtgtgccaagtgccggagcgcgaggaggccgtctatatcggcggcgcctccaacatgctggcgcagccggagtttcacgacgtcggcaaggcgcaacccattctcagcctgctggaacagaacgagtccatctcgaactggttcccgaaggcggaggacgggattgaggtgcgcatcggcgcggaaaacgcagtggtggagttgaaggactgcacggtcattgccaccacgtaccgtttgggtggcgtgccggtgggccatattggagtgttgggccccacgcgcatggactacaatcgcgtcatgcaaattctctcgttcacctcgcaggcgctgacggagtttttgactcggtttgcgtcgagcgggtga

SEQ ID NO: 865 - DNA, 1035 bp, Artificial
  Substituion in SEQ ID NO 852
atgttgacgccccgacagcaactgattttgtccgcgatcatcgaggactacgtccggatggcggaacccatcggttcgcgggcactcgccaaacatgaggagattcaatatagcccagccaccatccgaaatgagatggcggatctggaggaaatgggctatttaacccagccacacgcctcggccggacgctttccatcccagaagggctaccggttctatgtcgacaacctgttgcgcctgggacagatggatcgcgagacgggcgagtttttgaaatccgtgttcaccaagcgcatcgacgaggtggagcaggtcgcccgcgaggtggcgaacgtgctctccatgctgacgaagcagacggtgatcgtgctcgggccgaagacggacaccgaaaagttgcgcaaaatcgaactcatcccgctcggcggcggccgcgccatcgccatcttggtgaccaactccgggcacgtggagaccgtgcacgtgcgattttcgtccgagatggaggcagacgacgtcgagacgctcgtccgcgtgctgaacgacaaggtggtcggcgtgcccatctccgagcttcggcgcacgctgtacgcggagttggctggcgaattgcgccggaccgtcgagcggttcgaggacgccatcgccgtcttgaatgaggtgtgccaagtgccggagcgcgaggaggccgtctatatcggcggcgcctccaacatgctggcgcagccggagtttcacgacgtcggcaaggcgcaacccattctcagcctgctggaacagaacgagtccatctcgaactggttcccgaaggcggaggacgggattgaggtgcgcatcggcgcggaaaacgcagtggtggagttgaaggactgcacggtcattgccaccacgtaccgtttgggtggcgtgccggtgggccatattggagtgattggccccacgcgcatggactacaatcgcgtcatgcaaattctctcgttcacctcgcaggcgctgacggagtttttgactcggtttgcgtcgagcgggtga

SEQ ID NO: 866 - DNA, 1035 bp, Artificial
  Substituion in SEQ ID NO 852
atgttgacgccccgacagcaactgattttgtccgcgatcatcgaggactacgtccggatggcggaacccatcggttcgcgggcactcgccaaacatgaggagattcaatatagcccagccaccatccgaaatgagatggcggatctggaggaaatgggctatttaacccagccacacgcctcggccggacgctttccatcccagaagggctaccggttctatgtcgacaacctgttgcgcctgggacagatggatcgcgagacgggcgagtttttgaaatccgtgttcaccaagcgcatcgacgaggtggagcaggtcgcccgcgaggtggcgaacgtgctctccatgctgacgaagcagacggtgatcgtgctcgggccgaagacggacaccgaaaagttgcgcaaaatcgaactcatcccgctcggcggcggccgcgccatcgccatcttggtgaccaactccgggcacgtggataccgtgcacgtgcgattttcgtccgagatggaggcagacgacgtcgagacgctcgtccgcgtgctgaacgacaaggtggtcggcgtgcccatctccgagcttcggcgcacgctgtacgcggagttggctggcgaattgcgccggaccgtcgagcggttcgaggacgccatcgccgtcttgaatgaggtgtgccaagtgccggagcgcgaggaggccgtctatatcggcggcgcctccaacatgctggcgcagccggagtttcacgacgtcggcaaggcgcaacccattctcagcctgctggaacagaacgagtccatctcgaactggttcccgaaggcggaggacgggattgaggtgcgcatcggcgcggaaaacgcagtggtggagttgaaggactgcacggtcattgccaccacgtaccgtttgggtggcgtgccggtgggccatattggagtgttgggccccacgcgcatggactacaatcgcgtcatgcaaattctctcgttcacctcgcaggcgctgacggagtttttgactcggtttgcgtcgagcgggtga

SEQ ID NO: 867 - DNA, 1035 bp, Artificial
  Substituion in SEQ ID NO 852
atgttgacgccccgacagcaactgattttgtccgcgatcatcgaggactacgtccggatggcggaacccatcggttcgcgggcactcgccaaacatgaggagattcaatatagcccagccaccatccgaaatgagatggcggatctggaggaaatgggctatttaacccagccacacgcctcggccggacgctttccatcccagaagggctaccggttctatgtcgacaacctgttgcgcctgggacagatggatcgcgagacgggcgagtttttgaaatccgtgttcaccaagcgcatcgacgaggtggagcaggtcgcccgcgaggtggcgaacgtgctctccatgctgacgaagcagacggtgatcgtgctcgggccgaagacggacaccgaaaagttgaaaaaaatcgaactcatcccgctcggcggcggccgcgccatcgccatcttggtgaccaactccgggcacgtggagaccgtgcacgtgcgattttcgtccgagatggaggcagacgacgtcgagacgctcgtccgcgtgctgaacgacaaggtggtcggcgtgcccatctccgagcttcggcgcacgctgtacgcggagttggctggcgaattgcgccggaccgtcgagcggttcgaggacgccatcgccgtcttgaatgaggtgtgccaagtgccggagcgcgaggaggccgtctatatcggcggcgcctccaacatgctggcgcagccggagtttcacgacgtcggcaaggcgcaacccattctcagcctgctggaacagaacgagtccatctcgaactggttcccgaaggcggaggacgggattgaggtgcgcatcggcgcggaaaacgcagtggtggagttgaaggactgcacggtcattgccaccacgtaccgtttgggtggcgtgccggtgggccatattggagtgttgggccccacgcgcatggactacaatcgcgtcatgcaaattctctcgttcacctcgcaggcgctgacggagtttttgactcggtttgcgtcgagcgggtga

SEQ ID NO: 868 - protein, 368 aa, Alicyclobacillus acidocaldarius
MAKTNDEIRDEDQGITLQEAKQQLIELGKKQGSLTYEEISDRLSSFDMDADAMDDFFEQLAELGIDVVNERDEEGGREDDDYDLDDLSVPPGVKISDPVRMYLKEIGRVPLLSAQEEIELAKRIEQGDEEAKQRLAEANLRLVVSIAKRYVGRGMLFLDLIQEGNLGLLKAVEKFDYRKGYKFSTYATWWIRQAITRAIADQARTIRIPVHMVETINKLIRVSRQLLQELGREPTPEEIAAEMDLTPEKVREIQKIAQEPVSLETPIGEEDDSHLGDFIPDDEAPAPADAAAYELLKEQLEDVLDTLTEREENVLRLRFGLDDGRTRTLEEVGKVFGVTRERIRQIEAKALRKLRHPSRSKRLKDFLE

SEQ ID NO: 869 - DNA, 1107 bp, Alicyclobacillus acidocaldarius
atggcgaagacgaatgacgaaattcgcgacgaggatcagggtatcacccttcaagaagccaagcagcaattgatcgaactgggcaaaaagcaaggctcgttgacatatgaggagatctcggatcggctcagctcgttcgacatggacgccgacgcgatggacgatttctttgaacagttagcggaactcgggatcgacgtcgtgaacgagcgggacgaagagggcggccgcgaggacgacgattacgatctcgacgatctctccgttccgcccggcgtcaagatttccgatccggtccggatgtacctgaaggagattgggcgcgtgccgctcttgtcggcccaagaggagattgagctcgcgaagcgcattgagcagggagacgaagaggcgaagcagcgcttggcggaggccaacctgcgccttgtcgtcagcatcgcgaagcgatacgtcggacgcggtatgctgtttctcgacctgatccaggagggcaacctcgggttgctcaaggcggtcgagaagtttgactaccggaagggttacaagttcagcacgtacgcgacgtggtggatccggcaggccatcacgcgggccatcgccgatcaggcgcggaccatccgcattccggtgcacatggtggagaccatcaacaagctgatccgcgtgtcccggcagctgctccaggaattggggcgtgagcccacgccggaggagattgccgccgagatggacctgacgccggagaaggtgcgcgagattcagaagatcgcacaggaacctgtgtcgctggagacgcccattggcgaggaggacgactcgcacctcggcgatttcatcccggacgacgaggcgcccgctcccgccgacgcggcggcttacgagctcttgaaggagcagttggaggacgtgctggacacgctcacggagcgcgaggaaaacgtgctgcggttgcgcttcggactggatgacggccgcacgcgcaccctcgaagaagtcgggaaggtgttcggggtgacgcgggaacggatccgccaaattgaggcgaaggcgctgcgcaagctgcgccatccgagccgaagcaagcggctcaaggacttcctcgagtga

SEQ ID NO: 870 - protein, 359 aa, Geobacillus thermodenitrificans NG80-2
TLEQAKEQLAELGKKRGILTYEEIAERLSGFDLDSDQMDEYYEYLADQGIEVISESDIETDPDIDELVKEEEFDLNDLSVPPGVKINDPVRMYLKEIGRVPLLSAEEEIELAKRIEQGDEEAKRRLTEANLRLVVSIAKRYVGRGMLFLDLIQEGNMGLIKAVEKFDYRKGYKFSTYATWWIRQAITRAIADQARTIRIPVHMVETINKLIRVQRQLLQDLGREPTPEEIAEEMDLTPEKVREILKIAQEPVSLETPIGEEDDSHLGDFIEDQEATSPSEHAAYELLKEQLEDVLDTLTDREENVLRLRFGLDDGRTRTLEEVGKVFGVTRERIRQIEAKALRKLRHPSRSKRLKDFLE

SEQ ID NO: 871 - protein, 364 aa, Geobacillus kaustophilus HTA426
EAAGESLEQVKEQLAELGKKRGILTYEEIAERLSGFDLDSDQMDEYYEYLAEQGIEVISESDLEADPDIDDLAKEEEFDLNDLSVPPGVKINDPVRMYLKEIGRVPLLSAEEEIELAKRIEQGDEEAKRRLTEANLRLVVSIAKRYVGRGMLFLDLIQEGNMGLIKAVEKFDYRKGYKFSTYATWWIRQAITRAIADQARTIRIPVHMVETINKLIRVQRQLLQDLGREPTPEEIAEEMDLTPEKVREILKIAQEPVSLETPIGEEDDSHLGDFIEDQDATSPSEHAAYELLKEQLEDVLDTLTDREENVLRLRFGLDDGRTRTLEEVGKVFGVTRERIRQIEAKALRKLRHPSRSKRLKDFLE

SEQ ID NO: 872 - protein, 373 aa, Paenibacillus larvae subsp. larvae BRL-230010
NDQHTELETELTLEQVKDQLIELGKKRSSLTYKEIMDRLAPYDQDAEQIDDFFEHLSEMGIDVGNENDDDEDNIRPGNTDNEDEDFNFEDDLTLPPGIKINDPVRMYLKEIGRVPLLSAEDEVELAKRIEQGDEEAKRRLTEANLRLVVSIAKRYVGRGMLFLDLIQEGNMGLIKAVEKFDHTKGYKFSTYATWWIRQAITRAIADQARTIRIPVHMVETINKLIRVSRQLLQELGREPTPEEIAKEMELSTDKVREIMKIAQEPVSLETPIGEEDDSHLGDFIEDQEALAPADAAAYELLKEQLEDVLDTLTEREENVLRLRFGLDDGRTRTLEEVGKVFGVTRERIRQIEAKALRKLRHPSRSKRLKDFLE

SEQ ID NO: 873 - protein, 374 aa, Bacillus sp. NRRL B-14911
MAEKSARSKEVDSELTMEQVKEQLTEVGKKTGVLAYDDIAERLSNFELDSDQMDEFYEFLGDQGVELVGDNDDADPNVQELAKGEEEFDLNDLSVPPGVKINDPVRMYLKEIGRVDLLSAQEEISLAKRIEEGDEEAKRRLAEANLRLVVSIAKRYVGRGMLFLDLIQEGNMGLIKAVEKFDYRKGYKFSTYATWWIRQAITRAIADQARTIRIPVHMVETINKLIRVQRQLLQDLGREPTPEEIAEDMDLTPDKVREILKIAQEPVSLETPIGEEDDSHLGDFIEDQDATSPSEHAAYELLKEQLEDVLDTLTDREENVLRLRFGLDDGRTRTLEEVGKVFGVTRERIRQIEAKALRKLRHPSRSKRLKDFLE

SEQ ID NO: 874 - protein, 359 aa, Bacillus cereus subsp. cytotoxis NVH 391-98
MTLEQVKEQLTELGKKRGVLTYEEIAERMNGFEIESEQMDEYYEYLGEQGIDLVGDNDEGPNNHQITKTEEEFDLNDLSVPPGVKINDPVRMYLKEIGRVDLLSAEEEIQLATRIEEGDEEAKRRLAEANLRLVVSIAKRYVGRGMLFLDLIQEGNMGLIKAVEKFDYRKGFKFSTYATWWIRQAITRAIADQARTIRIPVHMVETINKLIRVQRQLLQDLGREPTPEEIGEEMDLAPEKVREILKIAQEPVSLETPIGEEDDSHLGDFIEDQEATSPADHAAYELLKEQLEDVLDTLTDREENVLRLRFGLDDGRTRTLEEVGKVFGVTRERIRQIEAKALRKLRHPSRSKRLKDFLE

SEQ ID NO: 875 - protein, 368 aa, Artificial
  Substituion in SEQ ID NO 868
MAKTNDEIRDEDNGITLQEAKQQLIELGKKQGSLTYEEISDRLSSFDMDADAMDDFFEQLAELGIDVVNERDEEGGREDDDYDLDDLSVPPGVKISDPVRMYLKEIGRVPLLSAQEEIELAKRIEQGDEEAKQRLAEANLRLVVSIAKRYVGRGMLFLDLIQEGNLGLLKAVEKFDYRKGYKFSTYATWWIRQAITRAIADQARTIRIPVHMVETINKLIRVSRQLLQELGREPTPEEIAAEMDLTPEKVREIQKIAQEPVSLETPIGEEDDSHLGDFIPDDEAPAPADAAAYELLKEQLEDVLDTLTEREENVLRLRFGLDDGRTRTLEEVGKVFGVTRERIRQIEAKALRKLRHPSRSKRLKDFLE

SEQ ID NO: 876 - protein, 368 aa, Artificial
  Substituion in SEQ ID NO 868
MAKTNDEIRDEDQGITLQEAKQQLIELGKKQGSLTYEEISDRLSSFDMDADAMDDFFEQLAELGIDVVNERDEEGGREDDDYDLDDLSVPPGVKISDPVRMYLKEIGRVPLLSAQEEIELARRIEQGDEEAKQRLAEANLRLVVSIAKRYVGRGMLFLDLIQEGNLGLLKAVEKFDYRKGYKFSTYATWWIRQAITRAIADQARTIRIPVHMVETINKLIRVSRQLLQELGREPTPEEIAAEMDLTPEKVREIQKIAQEPVSLETPIGEEDDSHLGDFIPDDEAPAPADAAAYELLKEQLEDVLDTLTEREENVLRLRFGLDDGRTRTLEEVGKVFGVTRERIRQIEAKALRKLRHPSRSKRLKDFLE

SEQ ID NO: 877 - protein, 368 aa, Artificial
  Substituion in SEQ ID NO 868
MAKTNDEIRDEDQGITLQEAKQQLIELGKKQGSLTYEEISDRLSSFDMDADAMDDFFEQLAELGIDVVNERDEEGGREDDDYDLDDLSVPPGVKISDPVRMYLKEIGRVPLLSAQEEIELAKRIEQGDEEAKQRLAEANLRLVVSIAKRYVGRGMLFLDLIQEGNLGLLKAVEKFDYRKGYKFSTYATWWIRQAITRAIADQARTIRIPVHMVETINKLIRVSRQLLQELGREPTPEEIAADMDLTPEKVREIQKIAQEPVSLETPIGEEDDSHLGDFIPDDEAPAPADAAAYELLKEQLEDVLDTLTEREENVLRLRFGLDDGRTRTLEEVGKVFGVTRERIRQIEAKALRKLRHPSRSKRLKDFLE

SEQ ID NO: 878 - protein, 368 aa, Artificial
  Substituion in SEQ ID NO 868
MAKTNEEIRDEDQGITLQEAKQQLIELGKKQGSLTYEEISDRLSSFDMDADAMDDFFEQLAELGIDVVNERDEEGGREDDDYDLDDLSVPPGVKISDPVRMYLKEIGRVPLLSAQEEIELAKRIEQGDEEAKQRLAEANLRLVVSIAKRYVGRGMLFLDLIQEGNLGLLKAVEKFDYRKGYKFSTYATWWIRQAITRAIADQARTIRIPVHMVETINKLIRVSRQLLQELGREPTPEEIAAEMDLTPEKVREIQKIAQEPVSLETPIGEEDDSHLGDFIPDDEAPAPADAAAYELLKEQLEDVLDTLTEREENVLRLRFGLDDGRTRTLEEVGKVFGVTRERIRQIEAKALRKLRHPSRSKRLKDFLE

SEQ ID NO: 879 - protein, 368 aa, Artificial
  Substituion in SEQ ID NO 868
MAKTNDEIRDEDQGITLQEAKQQLIELGKKQGSLTYEEISDRLSSFDMDADAMDDFFEQLAELGIDVVNERDEEGGKEDDDYDLDDLSVPPGVKISDPVRMYLKEIGRVPLLSAQEEIELAKRIEQGDEEAKQRLAEANLRLVVSIAKRYVGRGMLFLDLIQEGNLGLLKAVEKFDYRKGYKFSTYATWWIRQAITRAIADQARTIRIPVHMVETINKLIRVSRQLLQELGREPTPEEIAAEMDLTPEKVREIQKIAQEPVSLETPIGEEDDSHLGDFIPDDEAPAPADAAAYELLKEQLEDVLDTLTEREENVLRLRFGLDDGRTRTLEEVGKVFGVTRERIRQIEAKALRKLRHPSRSKRLKDFLE

SEQ ID NO: 880 - DNA, 1107 bp, Artificial
  Substituion in SEQ ID NO 869
atggcgaagacgaatgacgaaattcgcgacgaggataatggtatcacccttcaagaagccaagcagcaattgatcgaactgggcaaaaagcaaggctcgttgacatatgaggagatctcggatcggctcagctcgttcgacatggacgccgacgcgatggacgatttctttgaacagttagcggaactcgggatcgacgtcgtgaacgagcgggacgaagagggcggccgcgaggacgacgattacgatctcgacgatctctccgttccgcccggcgtcaagatttccgatccggtccggatgtacctgaaggagattgggcgcgtgccgctcttgtcggcccaagaggagattgagctcgcgaagcgcattgagcagggagacgaagaggcgaagcagcgcttggcggaggccaacctgcgccttgtcgtcagcatcgcgaagcgatacgtcggacgcggtatgctgtttctcgacctgatccaggagggcaacctcgggttgctcaaggcggtcgagaagtttgactaccggaagggttacaagttcagcacgtacgcgacgtggtggatccggcaggccatcacgcgggccatcgccgatcaggcgcggaccatccgcattccggtgcacatggtggagaccatcaacaagctgatccgcgtgtcccggcagctgctccaggaattggggcgtgagcccacgccggaggagattgccgccgagatggacctgacgccggagaaggtgcgcgagattcagaagatcgcacaggaacctgtgtcgctggagacgcccattggcgaggaggacgactcgcacctcggcgatttcatcccggacgacgaggcgcccgctcccgccgacgcggcggcttacgagctcttgaaggagcagttggaggacgtgctggacacgctcacggagcgcgaggaaaacgtgctgcggttgcgcttcggactggatgacggccgcacgcgcaccctcgaagaagtcgggaaggtgttcggggtgacgcgggaacggatccgccaaattgaggcgaaggcgctgcgcaagctgcgccatccgagccgaagcaagcggctcaaggacttcctcgagtga

SEQ ID NO: 881 - DNA, 1107 bp, Artificial
  Substituion in SEQ ID NO 869
atggcgaagacgaatgacgaaattcgcgacgaggatcagggtatcacccttcaagaagccaagcagcaattgatcgaactgggcaaaaagcaaggctcgttgacatatgaggagatctcggatcggctcagctcgttcgacatggacgccgacgcgatggacgatttctttgaacagttagcggaactcgggatcgacgtcgtgaacgagcgggacgaagagggcggccgcgaggacgacgattacgatctcgacgatctctccgttccgcccggcgtcaagatttccgatccggtccggatgtacctgaaggagattgggcgcgtgccgctcttgtcggcccaagaggagattgagctcgcgcgtcgcattgagcagggagacgaagaggcgaagcagcgcttggcggaggccaacctgcgccttgtcgtcagcatcgcgaagcgatacgtcggacgcggtatgctgtttctcgacctgatccaggagggcaacctcgggttgctcaaggcggtcgagaagtttgactaccggaagggttacaagttcagcacgtacgcgacgtggtggatccggcaggccatcacgcgggccatcgccgatcaggcgcggaccatccgcattccggtgcacatggtggagaccatcaacaagctgatccgcgtgtcccggcagctgctccaggaattggggcgtgagcccacgccggaggagattgccgccgagatggacctgacgccggagaaggtgcgcgagattcagaagatcgcacaggaacctgtgtcgctggagacgcccattggcgaggaggacgactcgcacctcggcgatttcatcccggacgacgaggcgcccgctcccgccgacgcggcggcttacgagctcttgaaggagcagttggaggacgtgctggacacgctcacggagcgcgaggaaaacgtgctgcggttgcgcttcggactggatgacggccgcacgcgcaccctcgaagaagtcgggaaggtgttcggggtgacgcgggaacggatccgccaaattgaggcgaaggcgctgcgcaagctgcgccatccgagccgaagcaagcggctcaaggacttcctcgagtga

SEQ ID NO: 882 - DNA, 1107 bp, Artificial
  Substituion in SEQ ID NO 869
atggcgaagacgaatgacgaaattcgcgacgaggatcagggtatcacccttcaagaagccaagcagcaattgatcgaactgggcaaaaagcaaggctcgttgacatatgaggagatctcggatcggctcagctcgttcgacatggacgccgacgcgatggacgatttctttgaacagttagcggaactcgggatcgacgtcgtgaacgagcgggacgaagagggcggccgcgaggacgacgattacgatctcgacgatctctccgttccgcccggcgtcaagatttccgatccggtccggatgtacctgaaggagattgggcgcgtgccgctcttgtcggcccaagaggagattgagctcgcgaagcgcattgagcagggagacgaagaggcgaagcagcgcttggcggaggccaacctgcgccttgtcgtcagcatcgcgaagcgatacgtcggacgcggtatgctgtttctcgacctgatccaggagggcaacctcgggttgctcaaggcggtcgagaagtttgactaccggaagggttacaagttcagcacgtacgcgacgtggtggatccggcaggccatcacgcgggccatcgccgatcaggcgcggaccatccgcattccggtgcacatggtggagaccatcaacaagctgatccgcgtgtcccggcagctgctccaggaattggggcgtgagcccacgccggaggagattgccgccgatatggacctgacgccggagaaggtgcgcgagattcagaagatcgcacaggaacctgtgtcgctggagacgcccattggcgaggaggacgactcgcacctcggcgatttcatcccggacgacgaggcgcccgctcccgccgacgcggcggcttacgagctcttgaaggagcagttggaggacgtgctggacacgctcacggagcgcgaggaaaacgtgctgcggttgcgcttcggactggatgacggccgcacgcgcaccctcgaagaagtcgggaaggtgttcggggtgacgcgggaacggatccgccaaattgaggcgaaggcgctgcgcaagctgcgccatccgagccgaagcaagcggctcaaggacttcctcgagtga

SEQ ID NO: 883 - DNA, 1107 bp, Artificial
  Substituion in SEQ ID NO 869
atggcgaagacgaatgaagaaattcgcgacgaggatcagggtatcacccttcaagaagccaagcagcaattgatcgaactgggcaaaaagcaaggctcgttgacatatgaggagatctcggatcggctcagctcgttcgacatggacgccgacgcgatggacgatttctttgaacagttagcggaactcgggatcgacgtcgtgaacgagcgggacgaagagggcggccgcgaggacgacgattacgatctcgacgatctctccgttccgcccggcgtcaagatttccgatccggtccggatgtacctgaaggagattgggcgcgtgccgctcttgtcggcccaagaggagattgagctcgcgaagcgcattgagcagggagacgaagaggcgaagcagcgcttggcggaggccaacctgcgccttgtcgtcagcatcgcgaagcgatacgtcggacgcggtatgctgtttctcgacctgatccaggagggcaacctcgggttgctcaaggcggtcgagaagtttgactaccggaagggttacaagttcagcacgtacgcgacgtggtggatccggcaggccatcacgcgggccatcgccgatcaggcgcggaccatccgcattccggtgcacatggtggagaccatcaacaagctgatccgcgtgtcccggcagctgctccaggaattggggcgtgagcccacgccggaggagattgccgccgagatggacctgacgccggagaaggtgcgcgagattcagaagatcgcacaggaacctgtgtcgctggagacgcccattggcgaggaggacgactcgcacctcggcgatttcatcccggacgacgaggcgcccgctcccgccgacgcggcggcttacgagctcttgaaggagcagttggaggacgtgctggacacgctcacggagcgcgaggaaaacgtgctgcggttgcgcttcggactggatgacggccgcacgcgcaccctcgaagaagtcgggaaggtgttcggggtgacgcgggaacggatccgccaaattgaggcgaaggcgctgcgcaagctgcgccatccgagccgaagcaagcggctcaaggacttcctcgagtga

SEQ ID NO: 884 - DNA, 1107 bp, Artificial
  Substituion in SEQ ID NO 869
atggcgaagacgaatgacgaaattcgcgacgaggatcagggtatcacccttcaagaagccaagcagcaattgatcgaactgggcaaaaagcaaggctcgttgacatatgaggagatctcggatcggctcagctcgttcgacatggacgccgacgcgatggacgatttctttgaacagttagcggaactcgggatcgacgtcgtgaacgagcgggacgaagagggcggcaaagaggacgacgattacgatctcgacgatctctccgttccgcccggcgtcaagatttccgatccggtccggatgtacctgaaggagattgggcgcgtgccgctcttgtcggcccaagaggagattgagctcgcgaagcgcattgagcagggagacgaagaggcgaagcagcgcttggcggaggccaacctgcgccttgtcgtcagcatcgcgaagcgatacgtcggacgcggtatgctgtttctcgacctgatccaggagggcaacctcgggttgctcaaggcggtcgagaagtttgactaccggaagggttacaagttcagcacgtacgcgacgtggtggatccggcaggccatcacgcgggccatcgccgatcaggcgcggaccatccgcattccggtgcacatggtggagaccatcaacaagctgatccgcgtgtcccggcagctgctccaggaattggggcgtgagcccacgccggaggagattgccgccgagatggacctgacgccggagaaggtgcgcgagattcagaagatcgcacaggaacctgtgtcgctggagacgcccattggcgaggaggacgactcgcacctcggcgatttcatcccggacgacgaggcgcccgctcccgccgacgcggcggcttacgagctcttgaaggagcagttggaggacgtgctggacacgctcacggagcgcgaggaaaacgtgctgcggttgcgcttcggactggatgacggccgcacgcgcaccctcgaagaagtcgggaaggtgttcggggtgacgcgggaacggatccgccaaattgaggcgaaggcgctgcgcaagctgcgccatccgagccgaagcaagcggctcaaggacttcctcgagtga

SEQ ID NO: 885 - protein, 228 aa, Alicyclobacillus acidocaldarius
MEGAMRILLVEDDRGLSDALAELLREESFQVDVAHDGEEGLYLAETAVYDALVVDVMLPGLSGYDLVRTLRDKRVHVPVLFLTALGDVDHRVQGLNAGGDDYLPKPFATEEFLARLRALLRRNRELGTDMTLRSGLLVLDPLARRAAFGNEPIKLSDKEFDLLEYLLSHRGQILMRERIFNRVWGIDSDVMDTTVDLYVHYLRKKLQPFGYDTAIRTVRNVGYMWSDP

SEQ ID NO: 886 - DNA, 687 bp, Alicyclobacillus acidocaldarius
ttggagggagctatgcgcattctcctcgttgaagacgaccggggcctgagtgatgcactcgcggaactcctacgagaggagtcgttccaggtcgatgtggcgcatgacggcgaggagggtctttacctcgcggagaccgcggtgtacgacgcgctcgtggtcgacgtcatgctgcccggcctgtcgggttacgatctcgtccgcaccttgagggacaagcgcgtgcacgtgcccgttctattcctcacggccctgggcgacgtcgatcaccgcgttcaggggctcaacgccggcggggatgactacctgccgaagccgttcgccaccgaggagtttcttgcccggctgcgcgccctgttgcgccgcaaccgggaattggggacggacatgacgctgcggtcaggtctcctcgtcttggatccgctcgcccgacgtgcggcgtttggaaatgagcccatcaagctcagcgacaaggaattcgatctgctcgaatacctgctcagccaccgcggacagattctcatgcgcgaacggatcttcaatcgcgtatggggaatcgattccgacgtgatggacacgaccgtggacctgtacgtccattacctgcgaaagaagcttcagccgttcggctacgataccgccattcgcacggtccgcaacgtcggatacatgtggagtgatccgtga

SEQ ID NO: 887 - protein, 224 aa, Bacillus thuringiensis serovar israelensis ATCC 35646
MEGESMRLLVVEDNTSLLESIVQILRDEFEVDTALNGEDGLFLALQNIYDAILLDVMMPGMDGFEVIQKIRDEKIETPVLFLTARDSLEDRVKGLDFGGDDYIVKPFQAPELKARIRALLRRSGSLTTQQTIRYKGIELFGKDKDVQVDGQGIKLTLKQYELLEYLIQNSGKILMREQIFDRVWGFDSDTTVAIVEVYVHHLRKKLEPFGYQKDIQTVRGIGYI

SEQ ID NO: 888 - protein, 224 aa, Bacillus cereus ATCC 14579
MEGESMRLLVVEDNASLLESIVQILRDEFEVDTAINGEDGLFLALQNIYDAILLDVMMPGMDGFEVIQKIRDEKIETPVLFLTARDSLEDRVKGLDFGGDDYIVKPFQAPELKARIRALLRRSGSLTTQQTIRYKGIELFGKDKDVQVDGKGMKLSLKQYELLEYLVQNSGKILMREQIFDRVWGFDSDTTVAIVEVYVHHLRKKLEPFGYQKDIQTVRGIGYI

SEQ ID NO: 889 - protein, 219 aa, Bacillus weihenstephanensis KBAB4
MRLLVVEDNASLLESIVQILRDEFEVDTAMNGEDGLFLALQNIYDAILLDVMMPEMDGFEVIQKIRDEKIETPVLFLTARDSLEDRVKGLDFGGDDYIVKPFQAPELKARIRALLRRSGSLTTQQTIRYKGIELFGKDKDIQVDGQGIKLTLKQYELLEYLIQNSGKILMREQIFDRVWGFDSDTTVAIVEVYVHHLRKKLEPFGYQKDIQTVRGIGYI

SEQ ID NO: 890 - protein, 219 aa, Bacillus cereus G9241
MRLLVVEDNASLLESIVQILRDEFEVDTALNGEEGLFLALQNIYDAILLDVMMPEMDGFEVIQKIRDEKIETPVLFLTARDSLEDRVKGLDFGGDDYIVKPFQAPELKARIRALLRRSGSLTTKQTIRYKGIELFGKDKDVQVDGQSMKLTLKQYELLEYLIQNSGKILMREQIFDRVWGFDSDTTVAIVEVYVHHLRKKLEPFGYQKDIQTVRGIGYI

SEQ ID NO: 891 - protein, 219 aa, Bacillus thuringiensis serovar konkukian str. 97-27
MRLLVVEDNASLLESIVQILRDEFEVDTALNGEEGLFLALQNIYDAILLDVMMPEMDGFEVIQKIRDEKIETPVLFLTARDSLEDRVKGLDFGGDDYIVKPFQAPELKARIRALLRRSGSLTTKQTIRYKGIELFGKDKDVQVDGQSMKLTLKQYELLEYLVQNSGKILMREQIFDRVWGFDSDTTVAIVEVYVHHLRKKLEPFGYQKDIQTVRGIGYI

SEQ ID NO: 892 - protein, 228 aa, Artificial
  Substituion in SEQ ID NO 885
MEGAMRILLVEDDRGLSDALAELLREESFQVDVAHDGEEGLYLAETAVYDALVVDVMLPGLSGYDIVRTLRDKRVHVPVLFLTALGDVDHRVQGLNAGGDDYLPKPFATEEFLARLRALLRRNRELGTDMTLRSGLLVLDPLARRAAFGNEPIKLSDKEFDLLEYLLSHRGQILMRERIFNRVWGIDSDVMDTTVDLYVHYLRKKLQPFGYDTAIRTVRNVGYMWSDP

SEQ ID NO: 893 - protein, 228 aa, Artificial
  Substituion in SEQ ID NO 885
MEGAMRILLVEDDRGLSDALAELLREESFQVDVAHDGEEGLYLAETAVYDALVVDVMLPGLSGYDLVRTLRDKRVHVPVLFLTALGDVDHRVQGLQAGGDDYLPKPFATEEFLARLRALLRRNRELGTDMTLRSGLLVLDPLARRAAFGNEPIKLSDKEFDLLEYLLSHRGQILMRERIFNRVWGIDSDVMDTTVDLYVHYLRKKLQPFGYDTAIRTVRNVGYMWSDP

SEQ ID NO: 894 - protein, 228 aa, Artificial
  Substituion in SEQ ID NO 885
MEGAMRILLVEDDRGLSDALAELLREESFQVDVAHDGEEGLYLAETAVYDALVVDVMLPGLSGYDLVRTLRDKRVHVPVLFLTALGDVDHRVQGLNAGGDDYLPKPFATEEFLARLRALLRRNRELGTDMTLRSGLLILDPLARRAAFGNEPIKLSDKEFDLLEYLLSHRGQILMRERIFNRVWGIDSDVMDTTVDLYVHYLRKKLQPFGYDTAIRTVRNVGYMWSDP

SEQ ID NO: 895 - protein, 228 aa, Artificial
  Substituion in SEQ ID NO 885
MEGAMRILLVEDDRGLSDALAELLREESFQVDVAHDGEEGLYLAETAVYDALVVDVMLPGLSGYDLVRTLRDKRVHVPVLFLTALGDVDHRVQGLNAGGDDYLPKPFATEEFLARLRALLRRNRELGTDMTIRSGLLVLDPLARRAAFGNEPIKLSDKEFDLLEYLLSHRGQILMRERIFNRVWGIDSDVMDTTVDLYVHYLRKKLQPFGYDTAIRTVRNVGYMWSDP

SEQ ID NO: 896 - protein, 228 aa, Artificial
  Substituion in SEQ ID NO 885
MEGAMRILLVEDDRGLSDALAELLREESFQVDVAHDGEEGLYLAETAVYDALVVDVMLPGLSGYDLVRTLRDKKVHVPVLFLTALGDVDHRVQGLNAGGDDYLPKPFATEEFLARLRALLRRNRELGTDMTLRSGLLVLDPLARRAAFGNEPIKLSDKEFDLLEYLLSHRGQILMRERIFNRVWGIDSDVMDTTVDLYVHYLRKKLQPFGYDTAIRTVRNVGYMWSDP

SEQ ID NO: 897 - DNA, 687 bp, Artificial
  Substituion in SEQ ID NO 886
ttggagggagctatgcgcattctcctcgttgaagacgaccggggcctgagtgatgcactcgcggaactcctacgagaggagtcgttccaggtcgatgtggcgcatgacggcgaggagggtctttacctcgcggagaccgcggtgtacgacgcgctcgtggtcgacgtcatgctgcccggcctgtcgggttacgatattgtccgcaccttgagggacaagcgcgtgcacgtgcccgttctattcctcacggccctgggcgacgtcgatcaccgcgttcaggggctcaacgccggcggggatgactacctgccgaagccgttcgccaccgaggagtttcttgcccggctgcgcgccctgttgcgccgcaaccgggaattggggacggacatgacgctgcggtcaggtctcctcgtcttggatccgctcgcccgacgtgcggcgtttggaaatgagcccatcaagctcagcgacaaggaattcgatctgctcgaatacctgctcagccaccgcggacagattctcatgcgcgaacggatcttcaatcgcgtatggggaatcgattccgacgtgatggacacgaccgtggacctgtacgtccattacctgcgaaagaagcttcagccgttcggctacgataccgccattcgcacggtccgcaacgtcggatacatgtggagtgatccgtga

SEQ ID NO: 898 - DNA, 687 bp, Artificial
  Substituion in SEQ ID NO 886
ttggagggagctatgcgcattctcctcgttgaagacgaccggggcctgagtgatgcactcgcggaactcctacgagaggagtcgttccaggtcgatgtggcgcatgacggcgaggagggtctttacctcgcggagaccgcggtgtacgacgcgctcgtggtcgacgtcatgctgcccggcctgtcgggttacgatctcgtccgcaccttgagggacaagcgcgtgcacgtgcccgttctattcctcacggccctgggcgacgtcgatcaccgcgttcaggggctccaagccggcggggatgactacctgccgaagccgttcgccaccgaggagtttcttgcccggctgcgcgccctgttgcgccgcaaccgggaattggggacggacatgacgctgcggtcaggtctcctcgtcttggatccgctcgcccgacgtgcggcgtttggaaatgagcccatcaagctcagcgacaaggaattcgatctgctcgaatacctgctcagccaccgcggacagattctcatgcgcgaacggatcttcaatcgcgtatggggaatcgattccgacgtgatggacacgaccgtggacctgtacgtccattacctgcgaaagaagcttcagccgttcggctacgataccgccattcgcacggtccgcaacgtcggatacatgtggagtgatccgtga

SEQ ID NO: 899 - DNA, 687 bp, Artificial
  Substituion in SEQ ID NO 886
ttggagggagctatgcgcattctcctcgttgaagacgaccggggcctgagtgatgcactcgcggaactcctacgagaggagtcgttccaggtcgatgtggcgcatgacggcgaggagggtctttacctcgcggagaccgcggtgtacgacgcgctcgtggtcgacgtcatgctgcccggcctgtcgggttacgatctcgtccgcaccttgagggacaagcgcgtgcacgtgcccgttctattcctcacggccctgggcgacgtcgatcaccgcgttcaggggctcaacgccggcggggatgactacctgccgaagccgttcgccaccgaggagtttcttgcccggctgcgcgccctgttgcgccgcaaccgggaattggggacggacatgacgctgcggtcaggtctcctcattttggatccgctcgcccgacgtgcggcgtttggaaatgagcccatcaagctcagcgacaaggaattcgatctgctcgaatacctgctcagccaccgcggacagattctcatgcgcgaacggatcttcaatcgcgtatggggaatcgattccgacgtgatggacacgaccgtggacctgtacgtccattacctgcgaaagaagcttcagccgttcggctacgataccgccattcgcacggtccgcaacgtcggatacatgtggagtgatccgtga

SEQ ID NO: 900 - DNA, 687 bp, Artificial
  Substituion in SEQ ID NO 886
ttggagggagctatgcgcattctcctcgttgaagacgaccggggcctgagtgatgcactcgcggaactcctacgagaggagtcgttccaggtcgatgtggcgcatgacggcgaggagggtctttacctcgcggagaccgcggtgtacgacgcgctcgtggtcgacgtcatgctgcccggcctgtcgggttacgatctcgtccgcaccttgagggacaagcgcgtgcacgtgcccgttctattcctcacggccctgggcgacgtcgatcaccgcgttcaggggctcaacgccggcggggatgactacctgccgaagccgttcgccaccgaggagtttcttgcccggctgcgcgccctgttgcgccgcaaccgggaattggggacggacatgacgattcggtcaggtctcctcgtcttggatccgctcgcccgacgtgcggcgtttggaaatgagcccatcaagctcagcgacaaggaattcgatctgctcgaatacctgctcagccaccgcggacagattctcatgcgcgaacggatcttcaatcgcgtatggggaatcgattccgacgtgatggacacgaccgtggacctgtacgtccattacctgcgaaagaagcttcagccgttcggctacgataccgccattcgcacggtccgcaacgtcggatacatgtggagtgatccgtga

SEQ ID NO: 901 - DNA, 687 bp, Artificial
  Substituion in SEQ ID NO 886
ttggagggagctatgcgcattctcctcgttgaagacgaccggggcctgagtgatgcactcgcggaactcctacgagaggagtcgttccaggtcgatgtggcgcatgacggcgaggagggtctttacctcgcggagaccgcggtgtacgacgcgctcgtggtcgacgtcatgctgcccggcctgtcgggttacgatctcgtccgcaccttgagggacaagaaagtgcacgtgcccgttctattcctcacggccctgggcgacgtcgatcaccgcgttcaggggctcaacgccggcggggatgactacctgccgaagccgttcgccaccgaggagtttcttgcccggctgcgcgccctgttgcgccgcaaccgggaattggggacggacatgacgctgcggtcaggtctcctcgtcttggatccgctcgcccgacgtgcggcgtttggaaatgagcccatcaagctcagcgacaaggaattcgatctgctcgaatacctgctcagccaccgcggacagattctcatgcgcgaacggatcttcaatcgcgtatggggaatcgattccgacgtgatggacacgaccgtggacctgtacgtccattacctgcgaaagaagcttcagccgttcggctacgataccgccattcgcacggtccgcaacgtcggatacatgtggagtgatccgtga

SEQ ID NO: 902 - protein, 463 aa, Alicyclobacillus acidocaldarius
MFRKTALRLVLLYTVVFAGILLLFSAVVYAFTDHRVRADEIATMSTAAANLRACRDEQILPGDRDDGEASPLHRGHSSGPGPDGDRLLAEVDETREQHLVYVLLSGTRVVLQTPAGSLTASEASIVARDGLGARPRGVSVAGVPYLGMKVELPRPVRIGDASANAAVILYNRAQDVAFLRELLTILSVSAGFFAVASAGVGFALASRALRPIRRSFEEQRRFVAHASHELRTPLAVMRLQIDRMFRHPGETILDMSEVIASLARETSRLQRLVNDLLTLAKADEGEAVLRLRPVDLATIAREAALRFAPLAEEKGVQLRVSAAETPIVADPDRLLELLSILVDNAIAFTPAGGWVEIDAHASGSAAVLAVRDTGRGIPPEHLPRVFDRFYQADPSRTTRGAGLGLSIAKWIAEAHGGQIRIFSPGSHGTGTEVEVRLPQSRSAEPGRGRFARLLAICYKKNSS

SEQ ID NO: 903 - DNA, 1392 bp, Alicyclobacillus acidocaldarius
gtgtttcgaaagactgcgttgcgcctcgtgctcctctatacggtcgtattcgcgggcattctcctgctgttcagcgccgtcgtctacgcgttcaccgaccaccgcgtgcgcgcggacgagatcgccacgatgagcactgccgcggccaacctgcgcgcgtgccgtgacgaacagatcctgccgggcgatcgcgacgacggcgaggcttcgccgcttcaccgaggccattcgtccggcccggggcctgacggagatcgattgctcgcggaggtggatgagacccgtgaacaacacctcgtgtacgtgctgctctcgggaacgcgggtcgtgttgcagacgccggccggaagcctcacggcgtccgaagcttccatcgtggccagggacgggctcggcgcgcggccccgcggggtgagcgtcgcgggcgtgccgtatctggggatgaaagtggaactgcctcggccagttcgaatcggcgatgcgtcggcgaatgccgccgtcatcctctacaacagggctcaggatgtcgccttcttgcgcgagcttttgaccatcctcagtgtctcggctggttttttcgccgtggcgtctgctggcgtgggcttcgcgctcgcctcccgcgcgcttcgccccattcgccgaagcttcgaagaacagcggaggttcgtcgcccacgcgtcgcatgagcttcgcacgccgctcgccgtcatgcggctgcaaatcgaccgcatgtttcgccatccgggggagaccatcttggatatgagcgaggtcatcgcctcgctcgcccgagagacgagccggctgcagaggctggtgaacgacctgctcacgctcgccaaggccgacgagggcgaggcggtgctgcggcttaggccggtcgatctcgccaccatcgcgcgggaggccgcgctcaggttcgcgccgctcgccgaagagaagggcgtccagctccgcgtgtcggctgccgagacgcccattgtcgcggatccggatcggcttctcgagctcctcagcatcttggtcgacaacgccatcgcgttcacgcccgctggcggttgggtggagatagacgcccacgcatccggcagcgccgcggttctcgccgtcagggacacgggccgggggattcctccagaacatctgcctcgcgtgttcgaccggttttatcaggccgatccgtcccgcaccacgcgcggggcgggtctcggcctgtccatcgcgaagtggattgccgaggcccacggggggcagatccgcatcttcagccctggctcgcacggcacagggacggaggtcgaagtgcgcctgccccagagccgttctgcagagcccgggaggggccgttttgcccgcctgctcgccatatgctataaaaagaatagttcttaa

SEQ ID NO: 904 - protein, 418 aa, Thermosinus carboxydivorans Nor1
MFQRTLRRLSIINSVVFLLIFLTFGAVLYGYVAYRLFDKVDDAMRFKAENFKIVNGRAILPGRVRFLFDPRIIILVRDSQGRVTSSFPSEVAELERLAALASQVDAGKVHISEVDSHAYRLISLPYRYEENVLQTERGPIVVKDVIAVSIVDSEVALLRNLFMIIVSGLVIGMLIIIMAGYYLARRAMVPIQAAWEKQQQFVADASHELRTPLAVIKSNAELMLRHPDHTIEDESIRVTNIVREVRRMTRLVADLLTLARADANQSELQLGAVSLSELVDAVSEQFKPLAQLEGHTLTVAVYEQLELVGDRERLYQLLVILLDNAVKYTPPPGHILITGVRQGSHILLTVEDSGQGIPPEDLPRVFDRFYRGDKARSREKGGTGLGLAIAKWIVEKHGGKIWVESKVGVGTKFSVLLP

SEQ ID NO: 905 - protein, 270 aa, Chloroflexus aggregans DSM 9485
GPAALQLGRVLNDQEQVLYQLLTGLVGFGIVGAVMIGIASWWLAGRALRPAEEAWTRQLRFISSASHELRAPLTLIRASAEVALRNAKDEDQRELLTDVLSESDHMRRLVDDLLTLSRLDSGSLTLQRQPITLNDFLADLHRHVSRLGEERGITITLAQARGTVIADPDRLRQILLILIDNALRYTPTGGTITLNAELAGKQVRISVRDTGCGITPEHLPHLFERFYRADQARNRSSNTNNAGLGLSIAKGLVEAHGGTIGIESEVNKGT

SEQ ID NO: 906 - protein, 239 aa, Roseiflexus castenholzii DSM 13941
LAGRALRPAQEAWERQQRFIASASHELRAPLTLIRASAEVALRDTPSDTADQYELLGDILAESDHMRRLVDDLLTLTRLDSGQLKLVIEPVNLADLLSRVHRQVARLGEQRGITIELTTVGGVVQADAERLQQVLLIALDNALRHTPSGGTITLAAAPTGRMVQITVTDTGSGIAPEHLPHIFERFYRADPARGRENGNAGLGLSIAKGLVEAMHGRITVTSALGAGTTVSVALPQGET

SEQ ID NO: 907 - protein, 226 aa, Chloroflexus aurantiacus J-10-fl
LAGRSLRPAEEAWVRQTRFIASASHELRAPLTLIRASAEVALRHADDPDQRELLSDVLSESDHMRRLVDDLLTLSRLDSGALVLQRQPVSLPSFLADLHRQVRRLGEEKGIAIQLAPITGTVLADPDRLRQVLLILIDNALRYTPSGGVITIATEPAGKQIRLSVSDNGCGIAPEHLPHLFERFYRVDVARNRSDGHAGLGLAIAKGLVEAHSGAIGIESEVNRGT

SEQ ID NO: 908 - protein, 239 aa, Geobacillus kaustophilus HTA426
MSKRALIPIEEAYERQRQFVADASHELRTPLSVVFSSVEALALEEDVMKNDFARRLLDRLREELKRITKLMNDLLTLARADAKNAALELSKQTFDFRPHAERTFQLVSELAAKKQITMHFHAPEQALVTADPDKLTQLLYILLDNAIKYTPEGGEVTLSIRTEPKQFILSVKDTGIGIPPEDIGRIFDRFYRVDKTRSRQQGGHGLGLSIAKWIVEAHGGTIHVQSQLGQGSEFLVRLP

SEQ ID NO: 909 - protein, 463 aa, Artificial
  Substituion in SEQ ID NO 902
MFRKTALRLVLLYTVVFAGILLLFSAVVYAFTDHRVRADEIATMSTAAANLRACRDEQLLPGDRDDGEASPLHRGHSSGPGPDGDRLLAEVDETREQHLVYVLLSGTRVVLQTPAGSLTASEASIVARDGLGARPRGVSVAGVPYLGMKVELPRPVRIGDASANAAVILYNRAQDVAFLRELLTILSVSAGFFAVASAGVGFALASRALRPIRRSFEEQRRFVAHASHELRTPLAVMRLQIDRMFRHPGETILDMSEVIASLARETSRLQRLVNDLLTLAKADEGEAVLRLRPVDLATIAREAALRFAPLAEEKGVQLRVSAAETPIVADPDRLLELLSILVDNAIAFTPAGGWVEIDAHASGSAAVLAVRDTGRGIPPEHLPRVFDRFYQADPSRTTRGAGLGLSIAKWIAEAHGGQIRIFSPGSHGTGTEVEVRLPQSRSAEPGRGRFARLLAICYKKNSS

SEQ ID NO: 910 - protein, 463 aa, Artificial
  Substituion in SEQ ID NO 902
MFRKTALRLVLLYTVVFAGILLLFSAVVYAFTDHRVRADEIATMSTAAANLRACRDEQILPGDRDDGEASPLHRGHSSGPGPDGDRLLAEVDETREQHLVYVLLSGTRVVLQTPAGSLTASEASIVARDGLGARPRGVSVAGVPYLGMKVELPRPVRIGDASANAAVILYNRAQDVAFLRELLTILSVSAGFFAVASAGVGFALASRALRPIRRSFEEQRRFVAHASHELRTPLAVMRLQIDRMFRHPGETILDMSEVIASLARETSRLQRLINDLLTLAKADEGEAVLRLRPVDLATIAREAALRFAPLAEEKGVQLRVSAAETPIVADPDRLLELLSILVDNAIAFTPAGGWVEIDAHASGSAAVLAVRDTGRGIPPEHLPRVFDRFYQADPSRTTRGAGLGLSIAKWIAEAHGGQIRIFSPGSHGTGTEVEVRLPQSRSAEPGRGRFARLLAICYKKNSS

SEQ ID NO: 911 - protein, 463 aa, Artificial
  Substituion in SEQ ID NO 902
MFRKTALRLVLLYTVVFAGILLLFSAVVYAFTDHRVRADEIATMSTAAANLRACRDEQILPGDRDDGEASPLHRGHSSGPGPDGDRLLAEVDETREQHLVYVLLSGTRVVLQTPAGSLTASEASIVARDGLGARPRGVSVAGVPYLGMKVELPRPVRIGDASANAAVILYNRAQDVAFLRELLTILSVSAGFFAVASAGVGFALASRALRPIRRSFEEQRRFVAHASHELRTPLAVMRLQIDRMFRHPGETILDMSEVIASLARETSRLQRLVNDLLTLAKADEGEAVLRLRPVDLATIAREAALRFAPLAEEKGVQLRVSAAETPIVADPDRLLELLSILVDNAIAFTPAGGWVEIDAHASGSAAVLAVRDTGRGIPPEHLPRVFDRFYQADPSRTTKGAGLGLSIAKWIAEAHGGQIRIFSPGSHGTGTEVEVRLPQSRSAEPGRGRFARLLAICYKKNSS

SEQ ID NO: 912 - protein, 463 aa, Artificial
  Substituion in SEQ ID NO 902
MFRKTALRLVLLYTVVFAGILLLFSAVVYAFTDHRVRADEIATMSTAAANLRACRDEQILPGDRDDGEASPLHRGHSSGPGPDGDRLLAEVDETREQHLVYVLLSGTRVVLQTPAGSLTASEASIVARDGLGARPRGVSVAGVPYLGMKVELPRPVRIGDASANAAVILYNRAQDVAFLRELLTILSVSAGFFAVASAGVGFALASRALRPIRKSFEEQRRFVAHASHELRTPLAVMRLQIDRMFRHPGETILDMSEVIASLARETSRLQRLVNDLLTLAKADEGEAVLRLRPVDLATIAREAALRFAPLAEEKGVQLRVSAAETPIVADPDRLLELLSILVDNAIAFTPAGGWVEIDAHASGSAAVLAVRDTGRGIPPEHLPRVFDRFYQADPSRTTRGAGLGLSIAKWIAEAHGGQIRIFSPGSHGTGTEVEVRLPQSRSAEPGRGRFARLLAICYKKNSS

SEQ ID NO: 913 - protein, 463 aa, Artificial
  Substituion in SEQ ID NO 902
MFRKTALRLVLLYTVVFAGILLLFSAVVYAFTDHRVRADEIATMSTAAANLRACRDEQILPGDRDDGEASPLHRGHSSGPGPDGDRLLAEVDETREQHLVYVLLSGTRVVLQTPAGSLTASEASIVARDGLGARPRGVSVAGVPYLGMKVELPRPVRIGDASANAAVILYNRANDVAFLRELLTILSVSAGFFAVASAGVGFALASRALRPIRRSFEEQRRFVAHASHELRTPLAVMRLQIDRMFRHPGETILDMSEVIASLARETSRLQRLVNDLLTLAKADEGEAVLRLRPVDLATIAREAALRFAPLAEEKGVQLRVSAAETPIVADPDRLLELLSILVDNAIAFTPAGGWVEIDAHASGSAAVLAVRDTGRGIPPEHLPRVFDRFYQADPSRTTRGAGLGLSIAKWIAEAHGGQIRIFSPGSHGTGTEVEVRLPQSRSAEPGRGRFARLLAICYKKNSS

SEQ ID NO: 914 - DNA, 1392 bp, Artificial
  Substituion in SEQ ID NO 903
gtgtttcgaaagactgcgttgcgcctcgtgctcctctatacggtcgtattcgcgggcattctcctgctgttcagcgccgtcgtctacgcgttcaccgaccaccgcgtgcgcgcggacgagatcgccacgatgagcactgccgcggccaacctgcgcgcgtgccgtgacgaacagttactgccgggcgatcgcgacgacggcgaggcttcgccgcttcaccgaggccattcgtccggcccggggcctgacggagatcgattgctcgcggaggtggatgagacccgtgaacaacacctcgtgtacgtgctgctctcgggaacgcgggtcgtgttgcagacgccggccggaagcctcacggcgtccgaagcttccatcgtggccagggacgggctcggcgcgcggccccgcggggtgagcgtcgcgggcgtgccgtatctggggatgaaagtggaactgcctcggccagttcgaatcggcgatgcgtcggcgaatgccgccgtcatcctctacaacagggctcaggatgtcgccttcttgcgcgagcttttgaccatcctcagtgtctcggctggttttttcgccgtggcgtctgctggcgtgggcttcgcgctcgcctcccgcgcgcttcgccccattcgccgaagcttcgaagaacagcggaggttcgtcgcccacgcgtcgcatgagcttcgcacgccgctcgccgtcatgcggctgcaaatcgaccgcatgtttcgccatccgggggagaccatcttggatatgagcgaggtcatcgcctcgctcgcccgagagacgagccggctgcagaggctggtgaacgacctgctcacgctcgccaaggccgacgagggcgaggcggtgctgcggcttaggccggtcgatctcgccaccatcgcgcgggaggccgcgctcaggttcgcgccgctcgccgaagagaagggcgtccagctccgcgtgtcggctgccgagacgcccattgtcgcggatccggatcggcttctcgagctcctcagcatcttggtcgacaacgccatcgcgttcacgcccgctggcggttgggtggagatagacgcccacgcatccggcagcgccgcggttctcgccgtcagggacacgggccgggggattcctccagaacatctgcctcgcgtgttcgaccggttttatcaggccgatccgtcccgcaccacgcgcggggcgggtctcggcctgtccatcgcgaagtggattgccgaggcccacggggggcagatccgcatcttcagccctggctcgcacggcacagggacggaggtcgaagtgcgcctgccccagagccgttctgcagagcccgggaggggccgttttgcccgcctgctcgccatatgctataaaaagaatagttcttaa

SEQ ID NO: 915 - DNA, 1392 bp, Artificial
  Substituion in SEQ ID NO 903
gtgtttcgaaagactgcgttgcgcctcgtgctcctctatacggtcgtattcgcgggcattctcctgctgttcagcgccgtcgtctacgcgttcaccgaccaccgcgtgcgcgcggacgagatcgccacgatgagcactgccgcggccaacctgcgcgcgtgccgtgacgaacagatcctgccgggcgatcgcgacgacggcgaggcttcgccgcttcaccgaggccattcgtccggcccggggcctgacggagatcgattgctcgcggaggtggatgagacccgtgaacaacacctcgtgtacgtgctgctctcgggaacgcgggtcgtgttgcagacgccggccggaagcctcacggcgtccgaagcttccatcgtggccagggacgggctcggcgcgcggccccgcggggtgagcgtcgcgggcgtgccgtatctggggatgaaagtggaactgcctcggccagttcgaatcggcgatgcgtcggcgaatgccgccgtcatcctctacaacagggctcaggatgtcgccttcttgcgcgagcttttgaccatcctcagtgtctcggctggttttttcgccgtggcgtctgctggcgtgggcttcgcgctcgcctcccgcgcgcttcgccccattcgccgaagcttcgaagaacagcggaggttcgtcgcccacgcgtcgcatgagcttcgcacgccgctcgccgtcatgcggctgcaaatcgaccgcatgtttcgccatccgggggagaccatcttggatatgagcgaggtcatcgcctcgctcgcccgagagacgagccggctgcagaggctgattaacgacctgctcacgctcgccaaggccgacgagggcgaggcggtgctgcggcttaggccggtcgatctcgccaccatcgcgcgggaggccgcgctcaggttcgcgccgctcgccgaagagaagggcgtccagctccgcgtgtcggctgccgagacgcccattgtcgcggatccggatcggcttctcgagctcctcagcatcttggtcgacaacgccatcgcgttcacgcccgctggcggttgggtggagatagacgcccacgcatccggcagcgccgcggttctcgccgtcagggacacgggccgggggattcctccagaacatctgcctcgcgtgttcgaccggttttatcaggccgatccgtcccgcaccacgcgcggggcgggtctcggcctgtccatcgcgaagtggattgccgaggcccacggggggcagatccgcatcttcagccctggctcgcacggcacagggacggaggtcgaagtgcgcctgccccagagccgttctgcagagcccgggaggggccgttttgcccgcctgctcgccatatgctataaaaagaatagttcttaa

SEQ ID NO: 916 - DNA, 1392 bp, Artificial
  Substituion in SEQ ID NO 903
gtgtttcgaaagactgcgttgcgcctcgtgctcctctatacggtcgtattcgcgggcattctcctgctgttcagcgccgtcgtctacgcgttcaccgaccaccgcgtgcgcgcggacgagatcgccacgatgagcactgccgcggccaacctgcgcgcgtgccgtgacgaacagatcctgccgggcgatcgcgacgacggcgaggcttcgccgcttcaccgaggccattcgtccggcccggggcctgacggagatcgattgctcgcggaggtggatgagacccgtgaacaacacctcgtgtacgtgctgctctcgggaacgcgggtcgtgttgcagacgccggccggaagcctcacggcgtccgaagcttccatcgtggccagggacgggctcggcgcgcggccccgcggggtgagcgtcgcgggcgtgccgtatctggggatgaaagtggaactgcctcggccagttcgaatcggcgatgcgtcggcgaatgccgccgtcatcctctacaacagggctcaggatgtcgccttcttgcgcgagcttttgaccatcctcagtgtctcggctggttttttcgccgtggcgtctgctggcgtgggcttcgcgctcgcctcccgcgcgcttcgccccattcgccgaagcttcgaagaacagcggaggttcgtcgcccacgcgtcgcatgagcttcgcacgccgctcgccgtcatgcggctgcaaatcgaccgcatgtttcgccatccgggggagaccatcttggatatgagcgaggtcatcgcctcgctcgcccgagagacgagccggctgcagaggctggtgaacgacctgctcacgctcgccaaggccgacgagggcgaggcggtgctgcggcttaggccggtcgatctcgccaccatcgcgcgggaggccgcgctcaggttcgcgccgctcgccgaagagaagggcgtccagctccgcgtgtcggctgccgagacgcccattgtcgcggatccggatcggcttctcgagctcctcagcatcttggtcgacaacgccatcgcgttcacgcccgctggcggttgggtggagatagacgcccacgcatccggcagcgccgcggttctcgccgtcagggacacgggccgggggattcctccagaacatctgcctcgcgtgttcgaccggttttatcaggccgatccgtcccgcaccacgaaaggggcgggtctcggcctgtccatcgcgaagtggattgccgaggcccacggggggcagatccgcatcttcagccctggctcgcacggcacagggacggaggtcgaagtgcgcctgccccagagccgttctgcagagcccgggaggggccgttttgcccgcctgctcgccatatgctataaaaagaatagttcttaa

SEQ ID NO: 917 - DNA, 1392 bp, Artificial
  Substituion in SEQ ID NO 903
gtgtttcgaaagactgcgttgcgcctcgtgctcctctatacggtcgtattcgcgggcattctcctgctgttcagcgccgtcgtctacgcgttcaccgaccaccgcgtgcgcgcggacgagatcgccacgatgagcactgccgcggccaacctgcgcgcgtgccgtgacgaacagatcctgccgggcgatcgcgacgacggcgaggcttcgccgcttcaccgaggccattcgtccggcccggggcctgacggagatcgattgctcgcggaggtggatgagacccgtgaacaacacctcgtgtacgtgctgctctcgggaacgcgggtcgtgttgcagacgccggccggaagcctcacggcgtccgaagcttccatcgtggccagggacgggctcggcgcgcggccccgcggggtgagcgtcgcgggcgtgccgtatctggggatgaaagtggaactgcctcggccagttcgaatcggcgatgcgtcggcgaatgccgccgtcatcctctacaacagggctcaggatgtcgccttcttgcgcgagcttttgaccatcctcagtgtctcggctggttttttcgccgtggcgtctgctggcgtgggcttcgcgctcgcctcccgcgcgcttcgccccattcgcaaaagcttcgaagaacagcggaggttcgtcgcccacgcgtcgcatgagcttcgcacgccgctcgccgtcatgcggctgcaaatcgaccgcatgtttcgccatccgggggagaccatcttggatatgagcgaggtcatcgcctcgctcgcccgagagacgagccggctgcagaggctggtgaacgacctgctcacgctcgccaaggccgacgagggcgaggcggtgctgcggcttaggccggtcgatctcgccaccatcgcgcgggaggccgcgctcaggttcgcgccgctcgccgaagagaagggcgtccagctccgcgtgtcggctgccgagacgcccattgtcgcggatccggatcggcttctcgagctcctcagcatcttggtcgacaacgccatcgcgttcacgcccgctggcggttgggtggagatagacgcccacgcatccggcagcgccgcggttctcgccgtcagggacacgggccgggggattcctccagaacatctgcctcgcgtgttcgaccggttttatcaggccgatccgtcccgcaccacgcgcggggcgggtctcggcctgtccatcgcgaagtggattgccgaggcccacggggggcagatccgcatcttcagccctggctcgcacggcacagggacggaggtcgaagtgcgcctgccccagagccgttctgcagagcccgggaggggccgttttgcccgcctgctcgccatatgctataaaaagaatagttcttaa

SEQ ID NO: 918 - DNA, 1392 bp, Artificial
  Substituion in SEQ ID NO 903
gtgtttcgaaagactgcgttgcgcctcgtgctcctctatacggtcgtattcgcgggcattctcctgctgttcagcgccgtcgtctacgcgttcaccgaccaccgcgtgcgcgcggacgagatcgccacgatgagcactgccgcggccaacctgcgcgcgtgccgtgacgaacagatcctgccgggcgatcgcgacgacggcgaggcttcgccgcttcaccgaggccattcgtccggcccggggcctgacggagatcgattgctcgcggaggtggatgagacccgtgaacaacacctcgtgtacgtgctgctctcgggaacgcgggtcgtgttgcagacgccggccggaagcctcacggcgtccgaagcttccatcgtggccagggacgggctcggcgcgcggccccgcggggtgagcgtcgcgggcgtgccgtatctggggatgaaagtggaactgcctcggccagttcgaatcggcgatgcgtcggcgaatgccgccgtcatcctctacaacagggctaatgatgtcgccttcttgcgcgagcttttgaccatcctcagtgtctcggctggttttttcgccgtggcgtctgctggcgtgggcttcgcgctcgcctcccgcgcgcttcgccccattcgccgaagcttcgaagaacagcggaggttcgtcgcccacgcgtcgcatgagcttcgcacgccgctcgccgtcatgcggctgcaaatcgaccgcatgtttcgccatccgggggagaccatcttggatatgagcgaggtcatcgcctcgctcgcccgagagacgagccggctgcagaggctggtgaacgacctgctcacgctcgccaaggccgacgagggcgaggcggtgctgcggcttaggccggtcgatctcgccaccatcgcgcgggaggccgcgctcaggttcgcgccgctcgccgaagagaagggcgtccagctccgcgtgtcggctgccgagacgcccattgtcgcggatccggatcggcttctcgagctcctcagcatcttggtcgacaacgccatcgcgttcacgcccgctggcggttgggtggagatagacgcccacgcatccggcagcgccgcggttctcgccgtcagggacacgggccgggggattcctccagaacatctgcctcgcgtgttcgaccggttttatcaggccgatccgtcccgcaccacgcgcggggcgggtctcggcctgtccatcgcgaagtggattgccgaggcccacggggggcagatccgcatcttcagccctggctcgcacggcacagggacggaggtcgaagtgcgcctgccccagagccgttctgcagagcccgggaggggccgttttgcccgcctgctcgccatatgctataaaaagaatagttcttaa

SEQ ID NO: 919 - protein, 109 aa, Alicyclobacillus acidocaldarius
MYSLFEAIATPAESTFGAPRGAYGRMARSHYRCHHHHIRRECKMANNSGSNRTLVPQASKALDQMKYEIATEFGVNLGPDTTSRQNGSVGGEITKRLVAYAEQSLAGRA

SEQ ID NO: 920 - DNA, 330 bp, Alicyclobacillus acidocaldarius
atgtacagcctcttcgaggcaatcgcaacgccagccgagtcaacatttggcgcgccgcgcggagcatacggtcgaatggcccggtcacactacaggtgtcatcaccaccacataaggagggaatgcaagatggcaaacaactcgggtagcaatcgcacgctcgttccgcaggcttcgaaggcgctggatcagatgaagtacgagatcgcgacggagttcggggtcaaccttggcccggacaccacctcccgccagaacggctcggtgggtggcgagatcacgaagcgcctcgtggcgtacgcggagcaaagcctcgcgggccgcgcgtaa

SEQ ID NO: 921 - protein, 65 aa, Bacillus amyloliquefaciens FZB42
QQSNSGNSNQLLVPGAAQAIDQMKYEIASEFGVNLGPETTSRANGSVGGEITKRLVSFAQQSMGG

SEQ ID NO: 922 - protein, 65 aa, Bacillus amyloliquefaciens FZB42
MANNNSSNQLVVPGAAQAIDQMKYEIASEFGVNLGGETTSRANGSVGGEITKRLVSFAQQNMGGQ

SEQ ID NO: 923 - protein, 65 aa, Bacillus coagulans 36D1
QMANNSNSNQLLVSGAEQALDQMKYEIAQEFGVNLGADTTSRANGSVGGEITKRLVQMAEQQLGG

SEQ ID NO: 924 - protein, 64 aa, Bacillus sp. NRRL B-14911
MANNNSSNQLLVPGVSQALDQMKYEIANEFGVNLGAETTARANGSVGGEITKRLVQMAEQQLGG

SEQ ID NO: 925 - protein, 64 aa, Bacillus pumilus SAFR-032
MANSNSSNQLLVPGAEQAIDQMKYEIASEFGVNLGAETTARANGSVGGEITKRLVSYAQQHMGG

SEQ ID NO: 926 - protein, 109 aa, Artificial
  Substituion in SEQ ID NO 919
MYSLFEAIATPAESTFGAPRGAYGRMARSHYRCHHHHIRRECKMANNSGSNRTIVPQASKALDQMKYEIATEFGVNLGPDTTSRQNGSVGGEITKRLVAYAEQSLAGRA

SEQ ID NO: 927 - protein, 109 aa, Artificial
  Substituion in SEQ ID NO 919
MYSLFEAIATPAESTFGAPRGAYGRMARSHYRCHHHHIRRECKMANNSGSNRTLVPQASKALDQMKYEIATEFGVNLGPDTTSRQNGSVGGEITKRLVAYADQSLAGRA

SEQ ID NO: 928 - protein, 109 aa, Artificial
  Substituion in SEQ ID NO 919
MYSLFEAIATPAESTFGAPRGAYGRMARSHYRCHHHHIRRECKMANNSGSNRTLVPQASKALDQMKYEIATEFGVNLGPDTTSRNNGSVGGEITKRLVAYAEQSLAGRA

SEQ ID NO: 929 - protein, 109 aa, Artificial
  Substituion in SEQ ID NO 919
MYSLFEAIATPAESTFGAPKGAYGRMARSHYRCHHHHIRRECKMANNSGSNRTLVPQASKALDQMKYEIATEFGVNLGPDTTSRQNGSVGGEITKRLVAYAEQSLAGRA

SEQ ID NO: 930 - protein, 109 aa, Artificial
  Substituion in SEQ ID NO 919
MYSLFEAIATPAESTFGAPRGAYGRMARSHYRCHHHHIKRECKMANNSGSNRTLVPQASKALDQMKYEIATEFGVNLGPDTTSRQNGSVGGEITKRLVAYAEQSLAGRA

SEQ ID NO: 931 - DNA, 330 bp, Artificial
  Substituion in SEQ ID NO 920
atgtacagcctcttcgaggcaatcgcaacgccagccgagtcaacatttggcgcgccgcgcggagcatacggtcgaatggcccggtcacactacaggtgtcatcaccaccacataaggagggaatgcaagatggcaaacaactcgggtagcaatcgcacgattgttccgcaggcttcgaaggcgctggatcagatgaagtacgagatcgcgacggagttcggggtcaaccttggcccggacaccacctcccgccagaacggctcggtgggtggcgagatcacgaagcgcctcgtggcgtacgcggagcaaagcctcgcgggccgcgcgtaa

SEQ ID NO: 932 - DNA, 330 bp, Artificial
  Substituion in SEQ ID NO 920
atgtacagcctcttcgaggcaatcgcaacgccagccgagtcaacatttggcgcgccgcgcggagcatacggtcgaatggcccggtcacactacaggtgtcatcaccaccacataaggagggaatgcaagatggcaaacaactcgggtagcaatcgcacgctcgttccgcaggcttcgaaggcgctggatcagatgaagtacgagatcgcgacggagttcggggtcaaccttggcccggacaccacctcccgccagaacggctcggtgggtggcgagatcacgaagcgcctcgtggcgtacgcggatcaaagcctcgcgggccgcgcgtaa

SEQ ID NO: 933 - DNA, 330 bp, Artificial
  Substituion in SEQ ID NO 920
atgtacagcctcttcgaggcaatcgcaacgccagccgagtcaacatttggcgcgccgcgcggagcatacggtcgaatggcccggtcacactacaggtgtcatcaccaccacataaggagggaatgcaagatggcaaacaactcgggtagcaatcgcacgctcgttccgcaggcttcgaaggcgctggatcagatgaagtacgagatcgcgacggagttcggggtcaaccttggcccggacaccacctcccgcaataacggctcggtgggtggcgagatcacgaagcgcctcgtggcgtacgcggagcaaagcctcgcgggccgcgcgtaa

SEQ ID NO: 934 - DNA, 330 bp, Artificial
  Substituion in SEQ ID NO 920
atgtacagcctcttcgaggcaatcgcaacgccagccgagtcaacatttggcgcgccgaaaggagcatacggtcgaatggcccggtcacactacaggtgtcatcaccaccacataaggagggaatgcaagatggcaaacaactcgggtagcaatcgcacgctcgttccgcaggcttcgaaggcgctggatcagatgaagtacgagatcgcgacggagttcggggtcaaccttggcccggacaccacctcccgccagaacggctcggtgggtggcgagatcacgaagcgcctcgtggcgtacgcggagcaaagcctcgcgggccgcgcgtaa

SEQ ID NO: 935 - DNA, 330 bp, Artificial
  Substituion in SEQ ID NO 920
atgtacagcctcttcgaggcaatcgcaacgccagccgagtcaacatttggcgcgccgcgcggagcatacggtcgaatggcccggtcacactacaggtgtcatcaccaccacataaaaagggaatgcaagatggcaaacaactcgggtagcaatcgcacgctcgttccgcaggcttcgaaggcgctggatcagatgaagtacgagatcgcgacggagttcggggtcaaccttggcccggacaccacctcccgccagaacggctcggtgggtggcgagatcacgaagcgcctcgtggcgtacgcggagcaaagcctcgcgggccgcgcgtaa

SEQ ID NO: 936 - protein, 127 aa, Alicyclobacillus acidocaldarius
MIVMGNHEQICPRFEWAFALLGKRWTGLIIRVLLEGPKRFKDISDMIPNMSDRMLAERFKELERAGLVVRRVYAETPVRIVYELTPKGEALRPVMEAVQKWGDEWVTDSDCDEYQRRYKCSSRDRAL

SEQ ID NO: 937 - DNA, 384 bp, Alicyclobacillus acidocaldarius
atgatcgtcatgggcaaccatgagcagatttgcccccgattcgaatgggcgtttgcgttgctcggcaagcgctggaccgggcttatcattcgcgtcttgctcgagggacccaagcgctttaaagatatctcggatatgattcccaacatgagcgaccgcatgttggccgagcgattcaaagagctcgagcgagccggcctggtcgttcggcgggtgtacgcagagacgcccgtgcggattgtgtacgagttgacgccgaagggcgaggcgcttcgcccggtcatggaagctgtccagaagtggggcgacgagtgggtcaccgactcggattgcgatgaatatcagcgccgatacaagtgttcatcgcgagatcgcgcactgtag

SEQ ID NO: 938 - protein, 96 aa, Paenibacillus larvae subsp. larvae BRL-230010
LCPRFEHAFEILGKRWTGLIIRVLLSGPKRFKDISDVIPGMSDRMLSERFKELEAADIVVRKVYPETPVRIEYELTEKGKALRPVMDELQKWAEKW

SEQ ID NO: 939 - protein, 97 aa, Clostridium acetobutylicum ATCC 824
KLCPHFEAAFELLGKRWTGLIIHSLLKGAKRFSDIQDIIPNLSARMLTERFRELEKQGIVVRKVYAETPVRIEYELTEKGRELESVMQEIQKWAEKW

SEQ ID NO: 940 - protein, 96 aa, Clostridium botulinum A str. ATCC 3502
MCPKFENAFELLGKRWTGLIIRTLLNGQKRFSDIAEAIPNMSARMLTERFKELEEEGIIIRKVYPETPVRIEYELTEKGLDLQAVMDEIQKWAEKW

SEQ ID NO: 941 - protein, 96 aa, Clostridium beijerinckii NCIMB 8052
MCPRFENAFELLGKRWTGLIIRTLLNGQNRFSDIEEAIPNMSARMLTERFKELEKEGIIIRKVYPETPVRIEYELTEKGRDLQSAMDEIQKWAEKW

SEQ ID NO: 942 - protein, 103 aa, Bacillus cereus subsp. cytotoxis NVH 391-98
MEHNSCLCPKFESAFTLLSKKWTGLIIKSLLEEPKRFREIADIIPNMSDRMLSERLKELESEGIVVRNVYPEVPVRIEYGLTDKGKALESVMNEVQNWAEKWV

SEQ ID NO: 943 - protein, 127 aa, Artificial
  Substituion in SEQ ID NO 936
MIVMGNHEQICPRFEWAFALLGKRWTGLIIRVLLEGPKRFKDISDMIPNMSDRMLAERFKELEKAGLVVRRVYAETPVRIVYELTPKGEALRPVMEAVQKWGDEWVTDSDCDEYQRRYKCSSRDRAL

SEQ ID NO: 944 - protein, 127 aa, Artificial
  Substituion in SEQ ID NO 936
MIVMGNHEQICPRFEWAFALLGKRWTGLIIRVLLEGPKRFKDISDMIPNMSDRMLAERFKELERAGLVVRRVYAETPVRIVYELTPKGEALRPVMEAVQKWGDEWVTDSDCDEYQRRYKCSSRDKAL

SEQ ID NO: 945 - protein, 127 aa, Artificial
  Substituion in SEQ ID NO 936
MIVMGNHEQICPRFEWAFALLGKRWTGLIIRVLLEGPKRFKEISDMIPNMSDRMLAERFKELERAGLVVRRVYAETPVRIVYELTPKGEALRPVMEAVQKWGDEWVTDSDCDEYQRRYKCSSRDRAL

SEQ ID NO: 946 - protein, 127 aa, Artificial
  Substituion in SEQ ID NO 936
MIVMGNHEQICPRFEWAFALLGKRWTGLIIRVLLEGPKRFKDISDMIPNMSDRMLAERFKELERAGLVVRRVYAETPVRIVYELTPKGEALRPIMEAVQKWGDEWVTDSDCDEYQRRYKCSSRDRAL

SEQ ID NO: 947 - protein, 127 aa, Artificial
  Substituion in SEQ ID NO 936
MIVMGNHEQICPRFEWAFALLGKRWTGLIIRVLLEGPRRFKDISDMIPNMSDRMLAERFKELERAGLVVRRVYAETPVRIVYELTPKGEALRPVMEAVQKWGDEWVTDSDCDEYQRRYKCSSRDRAL

SEQ ID NO: 948 - DNA, 384 bp, Artificial
  Substituion in SEQ ID NO 937
atgatcgtcatgggcaaccatgagcagatttgcccccgattcgaatgggcgtttgcgttgctcggcaagcgctggaccgggcttatcattcgcgtcttgctcgagggacccaagcgctttaaagatatctcggatatgattcccaacatgagcgaccgcatgttggccgagcgattcaaagagctcgagaaagccggcctggtcgttcggcgggtgtacgcagagacgcccgtgcggattgtgtacgagttgacgccgaagggcgaggcgcttcgcccggtcatggaagctgtccagaagtggggcgacgagtgggtcaccgactcggattgcgatgaatatcagcgccgatacaagtgttcatcgcgagatcgcgcactgtag

SEQ ID NO: 949 - DNA, 384 bp, Artificial
  Substituion in SEQ ID NO 937
atgatcgtcatgggcaaccatgagcagatttgcccccgattcgaatgggcgtttgcgttgctcggcaagcgctggaccgggcttatcattcgcgtcttgctcgagggacccaagcgctttaaagatatctcggatatgattcccaacatgagcgaccgcatgttggccgagcgattcaaagagctcgagcgagccggcctggtcgttcggcgggtgtacgcagagacgcccgtgcggattgtgtacgagttgacgccgaagggcgaggcgcttcgcccggtcatggaagctgtccagaagtggggcgacgagtgggtcaccgactcggattgcgatgaatatcagcgccgatacaagtgttcatcgcgagataaagcactgtag

SEQ ID NO: 950 - DNA, 384 bp, Artificial
  Substituion in SEQ ID NO 937
atgatcgtcatgggcaaccatgagcagatttgcccccgattcgaatgggcgtttgcgttgctcggcaagcgctggaccgggcttatcattcgcgtcttgctcgagggacccaagcgctttaaagaaatctcggatatgattcccaacatgagcgaccgcatgttggccgagcgattcaaagagctcgagcgagccggcctggtcgttcggcgggtgtacgcagagacgcccgtgcggattgtgtacgagttgacgccgaagggcgaggcgcttcgcccggtcatggaagctgtccagaagtggggcgacgagtgggtcaccgactcggattgcgatgaatatcagcgccgatacaagtgttcatcgcgagatcgcgcactgtag

SEQ ID NO: 951 - DNA, 384 bp, Artificial
  Substituion in SEQ ID NO 937
atgatcgtcatgggcaaccatgagcagatttgcccccgattcgaatgggcgtttgcgttgctcggcaagcgctggaccgggcttatcattcgcgtcttgctcgagggacccaagcgctttaaagatatctcggatatgattcccaacatgagcgaccgcatgttggccgagcgattcaaagagctcgagcgagccggcctggtcgttcggcgggtgtacgcagagacgcccgtgcggattgtgtacgagttgacgccgaagggcgaggcgcttcgcccgattatggaagctgtccagaagtggggcgacgagtgggtcaccgactcggattgcgatgaatatcagcgccgatacaagtgttcatcgcgagatcgcgcactgtag

SEQ ID NO: 952 - DNA, 384 bp, Artificial
  Substituion in SEQ ID NO 937
atgatcgtcatgggcaaccatgagcagatttgcccccgattcgaatgggcgtttgcgttgctcggcaagcgctggaccgggcttatcattcgcgtcttgctcgagggaccccgtcgctttaaagatatctcggatatgattcccaacatgagcgaccgcatgttggccgagcgattcaaagagctcgagcgagccggcctggtcgttcggcgggtgtacgcagagacgcccgtgcggattgtgtacgagttgacgccgaagggcgaggcgcttcgcccggtcatggaagctgtccagaagtggggcgacgagtgggtcaccgactcggattgcgatgaatatcagcgccgatacaagtgttcatcgcgagatcgcgcactgtag

SEQ ID NO: 953 - protein, 159 aa, Alicyclobacillus acidocaldarius
MRGDMDALTQRFAQSLGVLAQEFGPHLLNRLHTGLTAGQFFTMQMIRREGRLKVSQLAERLEVTPSAITVMIDRLEHHGYVSRVRDEEDRRVVVIELTEAGRAKLAEVERAWFEMMRQMVSRIEPGAFKQCVSALETMVAAAKQLRMESYGEETPRQEV

SEQ ID NO: 954 - DNA, 480 bp, Alicyclobacillus acidocaldarius
atgagaggggacatggatgcgctgacccagcggtttgcacagtcgctcggggtgctggcgcaggagttcggcccgcatttgctgaaccgtctgcacacgggcctcaccgcgggtcagtttttcaccatgcagatgatccggcgcgaagggcggctcaaggtgtcgcagctcgcggaacgcttggaggtgacgccgagcgccatcaccgtgatgatcgaccgcctcgagcatcatggctacgtctcgcgggtccgggacgaggaggacaggcgggtggtcgtgattgaactgacggaggccgggcgcgccaagctcgccgaggtggagcgggcgtggttcgaaatgatgcggcagatggtgtcgcggatcgaacctggggcgtttaagcagtgcgtctcggcgctcgagacgatggtcgctgcggcgaaacaactgcgcatggaatcgtacggggaagagactcctcgtcaggaggtatga

SEQ ID NO: 955 - protein, 158 aa, Bacillus amyloliquefaciens FZB42
DQYVSDIQKSLQTLLQNIQPEMVESMAKHEVTPAQLFVLASLKKHGSCKVSEIAERMEVKPSAVTLMADRLEQKGLIVRKHNQQDRRVIDISLTKKGETKFEDVVEGRKAILARNLSVLTDDELIQSVNIIRKVAEAAENTRLIKKKTNRKEELPKHE

SEQ ID NO: 956 - protein, 139 aa, Bacillus subtilis subsp. subtilis str. 168
DQLMSDIQLSLQALFQKIQPEMLESMEKQGVTPAQLFVLASLKKHGSLKVSEIAERMEVKPSAVTLMADRLEQKNLIARTHNTKDRRVIDLSLTDEGDIKFEEVLAGRKAIMARYLSFLTEEEMLQAAHITAKLAQAAE

SEQ ID NO: 957 - protein, 130 aa, Bacillus pseudofirmus
RLDQAFYKAMKTLGPKVYEKLEHNLTGEQFFVLNTLEQKGRITSSQLAEELQVKPSAITAMVDRLLKNDFVIRERDEKDRRAVYVRISDEGRRALKSSVKKRNIIMEKYMSKLTEEEMEQLTTVLEKLTS

SEQ ID NO: 958 - protein, 99 aa, Bacillus Subtilis
DQLSDIQLSLQALFQKIQPELESEKQGVTPAQLFVLASLKKHGSLKVSEIAEREVKPSAVTLADRLEQKNLIARTHNTKDRRVIDLSLTDEGDIKFEEV

SEQ ID NO: 959 - protein, 92 aa, Bacillus weihenstephanensis KBAB4
SGLTPPQFYILKILDHYGASRATQLAEKMYVKPSAITVMTDRLIDHGLVERYHDDNDRRVVVIELTKKGKTTVEEAMAARNEHIAKYFSHLE

SEQ ID NO: 960 - protein, 159 aa, Artificial
  Substituion in SEQ ID NO 953
MRGDMDALTQRFAQSLGVIAQEFGPHLLNRLHTGLTAGQFFTMQMIRREGRLKVSQLAERLEVTPSAITVMIDRLEHHGYVSRVRDEEDRRVVVIELTEAGRAKLAEVERAWFEMMRQMVSRIEPGAFKQCVSALETMVAAAKQLRMESYGEETPRQEV

SEQ ID NO: 961 - protein, 159 aa, Artificial
  Substituion in SEQ ID NO 953
MRGDMDALTQRFAQSLGVLAQEFGPHLLNRLHTGLTAGQFFTMQMIRREGRLKVSQLAERLEVTPSAITVMLDRLEHHGYVSRVRDEEDRRVVVIELTEAGRAKLAEVERAWFEMMRQMVSRIEPGAFKQCVSALETMVAAAKQLRMESYGEETPRQEV

SEQ ID NO: 962 - protein, 159 aa, Artificial
  Substituion in SEQ ID NO 953
MRGDMDALTQRFAQSLGVLAQDFGPHLLNRLHTGLTAGQFFTMQMIRREGRLKVSQLAERLEVTPSAITVMIDRLEHHGYVSRVRDEEDRRVVVIELTEAGRAKLAEVERAWFEMMRQMVSRIEPGAFKQCVSALETMVAAAKQLRMESYGEETPRQEV

SEQ ID NO: 963 - protein, 159 aa, Artificial
  Substituion in SEQ ID NO 953
MRGDMDALTQRFAQSLGVLAQEFGPHLLNRLHTGLTAGQFFTMQMIRREGRLKVSQLAERLEVTPSAITVMIDRLEHHGYVSRVRDEEDRRVVVIELTEAGRAKLAEVERAWFEMMRQMVSRIEPGAFKQCVSALETMIAAAKQLRMESYGEETPRQEV

SEQ ID NO: 964 - protein, 159 aa, Artificial
  Substituion in SEQ ID NO 953
MRGDMDALTQRFAQSLGVLAQEFGPHLLNRLHTGLTAGQFFTMQMIRREGRLKVSQLAERLEVTPSAITVMIDRLEHHGYVSRVRDEEDRRVVVIEITEAGRAKLAEVERAWFEMMRQMVSRIEPGAFKQCVSALETMVAAAKQLRMESYGEETPRQEV

SEQ ID NO: 965 - DNA, 480 bp, Artificial
  Substituion in SEQ ID NO 954
atgagaggggacatggatgcgctgacccagcggtttgcacagtcgctcggggtgattgcgcaggagttcggcccgcatttgctgaaccgtctgcacacgggcctcaccgcgggtcagtttttcaccatgcagatgatccggcgcgaagggcggctcaaggtgtcgcagctcgcggaacgcttggaggtgacgccgagcgccatcaccgtgatgatcgaccgcctcgagcatcatggctacgtctcgcgggtccgggacgaggaggacaggcgggtggtcgtgattgaactgacggaggccgggcgcgccaagctcgccgaggtggagcgggcgtggttcgaaatgatgcggcagatggtgtcgcggatcgaacctggggcgtttaagcagtgcgtctcggcgctcgagacgatggtcgctgcggcgaaacaactgcgcatggaatcgtacggggaagagactcctcgtcaggaggtatga

SEQ ID NO: 966 - DNA, 480 bp, Artificial
  Substituion in SEQ ID NO 954
atgagaggggacatggatgcgctgacccagcggtttgcacagtcgctcggggtgctggcgcaggagttcggcccgcatttgctgaaccgtctgcacacgggcctcaccgcgggtcagtttttcaccatgcagatgatccggcgcgaagggcggctcaaggtgtcgcagctcgcggaacgcttggaggtgacgccgagcgccatcaccgtgatgttagaccgcctcgagcatcatggctacgtctcgcgggtccgggacgaggaggacaggcgggtggtcgtgattgaactgacggaggccgggcgcgccaagctcgccgaggtggagcgggcgtggttcgaaatgatgcggcagatggtgtcgcggatcgaacctggggcgtttaagcagtgcgtctcggcgctcgagacgatggtcgctgcggcgaaacaactgcgcatggaatcgtacggggaagagactcctcgtcaggaggtatga

SEQ ID NO: 967 - DNA, 480 bp, Artificial
  Substituion in SEQ ID NO 954
atgagaggggacatggatgcgctgacccagcggtttgcacagtcgctcggggtgctggcgcaggatttcggcccgcatttgctgaaccgtctgcacacgggcctcaccgcgggtcagtttttcaccatgcagatgatccggcgcgaagggcggctcaaggtgtcgcagctcgcggaacgcttggaggtgacgccgagcgccatcaccgtgatgatcgaccgcctcgagcatcatggctacgtctcgcgggtccgggacgaggaggacaggcgggtggtcgtgattgaactgacggaggccgggcgcgccaagctcgccgaggtggagcgggcgtggttcgaaatgatgcggcagatggtgtcgcggatcgaacctggggcgtttaagcagtgcgtctcggcgctcgagacgatggtcgctgcggcgaaacaactgcgcatggaatcgtacggggaagagactcctcgtcaggaggtatga

SEQ ID NO: 968 - DNA, 480 bp, Artificial
  Substituion in SEQ ID NO 954
atgagaggggacatggatgcgctgacccagcggtttgcacagtcgctcggggtgctggcgcaggagttcggcccgcatttgctgaaccgtctgcacacgggcctcaccgcgggtcagtttttcaccatgcagatgatccggcgcgaagggcggctcaaggtgtcgcagctcgcggaacgcttggaggtgacgccgagcgccatcaccgtgatgatcgaccgcctcgagcatcatggctacgtctcgcgggtccgggacgaggaggacaggcgggtggtcgtgattgaactgacggaggccgggcgcgccaagctcgccgaggtggagcgggcgtggttcgaaatgatgcggcagatggtgtcgcggatcgaacctggggcgtttaagcagtgcgtctcggcgctcgagacgatgattgctgcggcgaaacaactgcgcatggaatcgtacggggaagagactcctcgtcaggaggtatga

SEQ ID NO: 969 - DNA, 480 bp, Artificial
  Substituion in SEQ ID NO 954
atgagaggggacatggatgcgctgacccagcggtttgcacagtcgctcggggtgctggcgcaggagttcggcccgcatttgctgaaccgtctgcacacgggcctcaccgcgggtcagtttttcaccatgcagatgatccggcgcgaagggcggctcaaggtgtcgcagctcgcggaacgcttggaggtgacgccgagcgccatcaccgtgatgatcgaccgcctcgagcatcatggctacgtctcgcgggtccgggacgaggaggacaggcgggtggtcgtgattgaaattacggaggccgggcgcgccaagctcgccgaggtggagcgggcgtggttcgaaatgatgcggcagatggtgtcgcggatcgaacctggggcgtttaagcagtgcgtctcggcgctcgagacgatggtcgctgcggcgaaacaactgcgcatggaatcgtacggggaagagactcctcgtcaggaggtatga

SEQ ID NO: 970 - protein, 249 aa, Alicyclobacillus acidocaldarius
MGPSRVPLWPPAEEALLMSFSASLIAMSNPILDAILRHPFVRGIAEGNLSKAAAIRYVSQDQPYLETYLRVFAHAAALAPRHEDVADFHGRMSLLLGGETQAHDNLLRYAGATPHDVEGQPKLPTLHHYESHLLASAARGDFAELVAAILPCHHVYVEIGQRLEPILEEKPDHPFAAWIRFYADPGMQDATHRLFAMIDREAAHFSTERARRVEAAFVASCHLEYRFFDMAYRGESWLPKEALSDVSTP

SEQ ID NO: 971 - DNA, 750 bp, Alicyclobacillus acidocaldarius
atgggaccctcccgtgttcccctttggcctccggcagaggaggcgcttctgatgtccttttccgcatcgctgattgccatgtccaaccccatcctcgacgccatcctgcgccatccgttcgtgcgaggaatcgccgaagggaacctctcgaaagcggcggccattcgctacgtcagccaggaccagccgtatctggagacctacctgcgcgtcttcgcacacgccgcggcgcttgcgcctaggcacgaagacgtggccgacttccacgggcgcatgtcccttctcctcggcggcgaaacccaggcacacgacaacctgctgcgctacgcaggggcgacgccgcacgatgtggagggccagccgaagttgcccaccttgcaccactacgagagccacctcctggcctcggcggcgcgcggcgacttcgcggaactcgtggcggccatcctgccgtgccatcacgtgtatgtcgagatcggccagcggctcgaacccatcctcgaggagaagccggatcacccgttcgcggcctggatccgcttctacgccgatcccggcatgcaagacgccacacatcgcctcttcgcgatgatcgatcgggaggccgcgcacttctcgaccgagcgggcccggcgggtcgaggcggcgtttgtcgcgagctgccacctcgagtaccggttcttcgacatggcctaccgcggcgagtcgtggctcccgaaggaggcgttgagcgatgtttcgacaccctga

SEQ ID NO: 972 - protein, 219 aa, Bacillus pumilus SAFR-032
MTFTAQLREETEPLFEAIYQHPFVRGLAEGKLEKKQIIHYVKQDAEYLQAFIKIYAAALSRCTDKEDIAFFHQQIEFVLDSETHPHQNLCRVAGVSYDGLQGAPLAPSAHHYIHHMLQVAKEGTLGEMIAVLLPCPWTYWEIGKRMLTDVQPDPSHPFYEWITFYGGLTDSITVELCKRLDQLAEAASEKEKEKMKQHFILSCQLEYKFWDMAFTVEEW

SEQ ID NO: 973 - protein, 220 aa, Bacillus clausii KSM-K16
MSFTAELRKTADPIYKAIFSHPFVQGIGKGSLPADSLIHYVKQDFEYLNTFMQIYGIAISRCENREDMAMFAEQIGFILHSETHPHHNFCKVAGVRYEDLQYEPLAPTAHHYTRHMLDVAHRGSLAEILAVLLPCPWTYQAIGDYLYETFQPKANHPFFDWISFYRSNGEMGVTKQFCKRLDELAAHATEQEKERMQDHFLKSCQLEYSFWEMAYVKEKW

SEQ ID NO: 974 - protein, 219 aa, Bacillus licheniformis ATCC 14580
MSFSAELRREADPIFEAIFEHPFVLGLASGRLEKEQLIHYVKQDYEYLNAFIQIYGIAISKCQNRKDMEMFHEQISFVLDSEVHPHKNLCRAAGVEYETLQGYPLAPSAHHYVRHMLTAAHEGTLGEILAVLLPCPWTYWEIGKKLMKDVQPDPSHPFYDWICFYGNRTDSITTKFCARLDEWAETAGKAEKEKMKELFLQSCQLEYGFWEMAYTVEDW

SEQ ID NO: 975 - protein, 225 aa, Frankia alni ACN14a
FSARLWASTEPVYEAILRHPFLTGLTDGTLPRAAFAHFVIQDAHYLRDYARALAVCAAKAPTEDDVRALANDAAEAVAAEQAMHVDLLDALGGPAPGDPAPGGTPPGGVATVAPTTRAYTSYLLATVYGGSFLEGLAAVLPCYWIYARVGARLLADSSPDPVYARWIAAYGDPAFQAVADRVVALTDRVGAFASEPELVRAADHFAVTARYEWMFWDAAWRRETW

SEQ ID NO: 976 - protein, 219 aa, Pediococcus pentosaceus ATCC 25745
FSARLKAIAQPVLADIENHPFVRGIQAGAVPAAALMVYVEQDTCFLDAFAKVYAGALSKCTTKDQMRFFEEQIRYTLNDEAGAHQILCDIAGQKLSDHQHAKQRPITYLYNEHLFNALRTGDLIDLIAAMLPCPWTYTEISQQIVDGAAPDNPFLPWIEFYQPQPGQIDGSMVKTLFGMVDELAIGLSEERQHEIEQRFLRSCELEYEFWEQAYYQKDW

SEQ ID NO: 977 - protein, 249 aa, Artificial
  Substituion in SEQ ID NO 970
MGPSRVPLWPPAEEALIMSFSASLIAMSNPILDAILRHPFVRGIAEGNLSKAAAIRYVSQDQPYLETYLRVFAHAAALAPRHEDVADFHGRMSLLLGGETQAHDNLLRYAGATPHDVEGQPKLPTLHHYESHLLASAARGDFAELVAAILPCHHVYVEIGQRLEPILEEKPDHPFAAWIRFYADPGMQDATHRLFAMIDREAAHFSTERARRVEAAFVASCHLEYRFFDMAYRGESWLPKEALSDVSTP

SEQ ID NO: 978 - protein, 249 aa, Artificial
  Substituion in SEQ ID NO 970
MGPSRVPLWPPAEEALLMSFSASLIAMSNPILDAILRHPFVRGIAEGNLSKAAAIRYVSQDQPYLETYLRVFAHAAALAPRHEDVADFHGRMSLLLGGETQAHDNLLRYAGATPHDVEGQPKLPTLHHYESHLLASAARGDFADLVAAILPCHHVYVEIGQRLEPILEEKPDHPFAAWIRFYADPGMQDATHRLFAMIDREAAHFSTERARRVEAAFVASCHLEYRFFDMAYRGESWLPKEALSDVSTP

SEQ ID NO: 979 - protein, 249 aa, Artificial
  Substituion in SEQ ID NO 970
MGPSRVPLWPPAEEALLMSFSASLIAMSNPILDAILRHPFVRGIAEGNLSKAAAIRYVSQDQPYLETYLRVFAHAAALAPRHEDVADFHGRMSLLLGGETQAHDNLLRYAGATPHDVEGQPKLPTLHHYESHLLASAARGDFAELVAAILPCHHVYVEIGQRLEPILEEKPDHPFAAWIRFYADPGMQDATHRLFAMIDREAAHFSTERARRVEAAFVASCHLEYRFFDMAYKGESWLPKEALSDVSTP

SEQ ID NO: 980 - protein, 249 aa, Artificial
  Substituion in SEQ ID NO 970
MGPSRVPLWPPAEEALLMSFSASLIAMSNPILDAILRHPFVRGIAEGNLSKAAAIRYVSQDQPYLETYLRVFAHAAALAPRHEDVADFHGRMSLLLGGETQAHDNLLRYAGATPHDVEGQPKLPTLHHYESHLLASAARGDFAELVAAILPCHHVYVEIGQRLEPILEEKPDHPFAAWIRFYADPGMQDATHRLFAMIDREAAHFSTERARRVEAAFVASCHLEYRFFDMAYRGESWLPKEALSDISTP

SEQ ID NO: 981 - protein, 249 aa, Artificial
  Substituion in SEQ ID NO 970
MGPSRVPLWPPAEEALLMSFSASLIAMSNPILDAILRHPFVRGIAEGNLSKAAAIRYVSQDQPYLETYLRVFAHAAALAPRHEDVADFHGRMSLLLGGETQAHDNLLRYAGATPHDVEGQPKLPTLHHYESHLLASAARGDFAELVAAILPCHHVYVEIGQRLEPILEERPDHPFAAWIRFYADPGMQDATHRLFAMIDREAAHFSTERARRVEAAFVASCHLEYRFFDMAYRGESWLPKEALSDVSTP

SEQ ID NO: 982 - DNA, 750 bp, Artificial
  Substituion in SEQ ID NO 971
atgggaccctcccgtgttcccctttggcctccggcagaggaggcgcttattatgtccttttccgcatcgctgattgccatgtccaaccccatcctcgacgccatcctgcgccatccgttcgtgcgaggaatcgccgaagggaacctctcgaaagcggcggccattcgctacgtcagccaggaccagccgtatctggagacctacctgcgcgtcttcgcacacgccgcggcgcttgcgcctaggcacgaagacgtggccgacttccacgggcgcatgtcccttctcctcggcggcgaaacccaggcacacgacaacctgctgcgctacgcaggggcgacgccgcacgatgtggagggccagccgaagttgcccaccttgcaccactacgagagccacctcctggcctcggcggcgcgcggcgacttcgcggaactcgtggcggccatcctgccgtgccatcacgtgtatgtcgagatcggccagcggctcgaacccatcctcgaggagaagccggatcacccgttcgcggcctggatccgcttctacgccgatcccggcatgcaagacgccacacatcgcctcttcgcgatgatcgatcgggaggccgcgcacttctcgaccgagcgggcccggcgggtcgaggcggcgtttgtcgcgagctgccacctcgagtaccggttcttcgacatggcctaccgcggcgagtcgtggctcccgaaggaggcgttgagcgatgtttcgacaccctga

SEQ ID NO: 983 - DNA, 750 bp, Artificial
  Substituion in SEQ ID NO 971
atgggaccctcccgtgttcccctttggcctccggcagaggaggcgcttctgatgtccttttccgcatcgctgattgccatgtccaaccccatcctcgacgccatcctgcgccatccgttcgtgcgaggaatcgccgaagggaacctctcgaaagcggcggccattcgctacgtcagccaggaccagccgtatctggagacctacctgcgcgtcttcgcacacgccgcggcgcttgcgcctaggcacgaagacgtggccgacttccacgggcgcatgtcccttctcctcggcggcgaaacccaggcacacgacaacctgctgcgctacgcaggggcgacgccgcacgatgtggagggccagccgaagttgcccaccttgcaccactacgagagccacctcctggcctcggcggcgcgcggcgacttcgcggatctcgtggcggccatcctgccgtgccatcacgtgtatgtcgagatcggccagcggctcgaacccatcctcgaggagaagccggatcacccgttcgcggcctggatccgcttctacgccgatcccggcatgcaagacgccacacatcgcctcttcgcgatgatcgatcgggaggccgcgcacttctcgaccgagcgggcccggcgggtcgaggcggcgtttgtcgcgagctgccacctcgagtaccggttcttcgacatggcctaccgcggcgagtcgtggctcccgaaggaggcgttgagcgatgtttcgacaccctga

SEQ ID NO: 984 - DNA, 750 bp, Artificial
  Substituion in SEQ ID NO 971
atgggaccctcccgtgttcccctttggcctccggcagaggaggcgcttctgatgtccttttccgcatcgctgattgccatgtccaaccccatcctcgacgccatcctgcgccatccgttcgtgcgaggaatcgccgaagggaacctctcgaaagcggcggccattcgctacgtcagccaggaccagccgtatctggagacctacctgcgcgtcttcgcacacgccgcggcgcttgcgcctaggcacgaagacgtggccgacttccacgggcgcatgtcccttctcctcggcggcgaaacccaggcacacgacaacctgctgcgctacgcaggggcgacgccgcacgatgtggagggccagccgaagttgcccaccttgcaccactacgagagccacctcctggcctcggcggcgcgcggcgacttcgcggaactcgtggcggccatcctgccgtgccatcacgtgtatgtcgagatcggccagcggctcgaacccatcctcgaggagaagccggatcacccgttcgcggcctggatccgcttctacgccgatcccggcatgcaagacgccacacatcgcctcttcgcgatgatcgatcgggaggccgcgcacttctcgaccgagcgggcccggcgggtcgaggcggcgtttgtcgcgagctgccacctcgagtaccggttcttcgacatggcctacaaaggcgagtcgtggctcccgaaggaggcgttgagcgatgtttcgacaccctga

SEQ ID NO: 985 - DNA, 750 bp, Artificial
  Substituion in SEQ ID NO 971
atgggaccctcccgtgttcccctttggcctccggcagaggaggcgcttctgatgtccttttccgcatcgctgattgccatgtccaaccccatcctcgacgccatcctgcgccatccgttcgtgcgaggaatcgccgaagggaacctctcgaaagcggcggccattcgctacgtcagccaggaccagccgtatctggagacctacctgcgcgtcttcgcacacgccgcggcgcttgcgcctaggcacgaagacgtggccgacttccacgggcgcatgtcccttctcctcggcggcgaaacccaggcacacgacaacctgctgcgctacgcaggggcgacgccgcacgatgtggagggccagccgaagttgcccaccttgcaccactacgagagccacctcctggcctcggcggcgcgcggcgacttcgcggaactcgtggcggccatcctgccgtgccatcacgtgtatgtcgagatcggccagcggctcgaacccatcctcgaggagaagccggatcacccgttcgcggcctggatccgcttctacgccgatcccggcatgcaagacgccacacatcgcctcttcgcgatgatcgatcgggaggccgcgcacttctcgaccgagcgggcccggcgggtcgaggcggcgtttgtcgcgagctgccacctcgagtaccggttcttcgacatggcctaccgcggcgagtcgtggctcccgaaggaggcgttgagcgatatttcgacaccctga

SEQ ID NO: 986 - DNA, 750 bp, Artificial
  Substituion in SEQ ID NO 971
atgggaccctcccgtgttcccctttggcctccggcagaggaggcgcttctgatgtccttttccgcatcgctgattgccatgtccaaccccatcctcgacgccatcctgcgccatccgttcgtgcgaggaatcgccgaagggaacctctcgaaagcggcggccattcgctacgtcagccaggaccagccgtatctggagacctacctgcgcgtcttcgcacacgccgcggcgcttgcgcctaggcacgaagacgtggccgacttccacgggcgcatgtcccttctcctcggcggcgaaacccaggcacacgacaacctgctgcgctacgcaggggcgacgccgcacgatgtggagggccagccgaagttgcccaccttgcaccactacgagagccacctcctggcctcggcggcgcgcggcgacttcgcggaactcgtggcggccatcctgccgtgccatcacgtgtatgtcgagatcggccagcggctcgaacccatcctcgaggagcgtccggatcacccgttcgcggcctggatccgcttctacgccgatcccggcatgcaagacgccacacatcgcctcttcgcgatgatcgatcgggaggccgcgcacttctcgaccgagcgggcccggcgggtcgaggcggcgtttgtcgcgagctgccacctcgagtaccggttcttcgacatggcctaccgcggcgagtcgtggctcccgaaggaggcgttgagcgatgtttcgacaccctga

SEQ ID NO: 987 - protein, 231 aa, Alicyclobacillus acidocaldarius
MGTWQDESVIKVLVVDDHELFRRGVVTVLRSTPGIYVVGEAGNGREAIECFQTLQPDVTLLDIHMPVCNGLETARKMREANPNTKILMLTVSETEEMLFEAVKSGASGYVLKSVSPERLIECVRQVYEGEPVVPSSLAMKMIAEFSRTAETRMPSSESVTELTEREREVLQYLSAGASNKEIARALFISENTVRNHVRHILDKLHLSNRAQAAAYAVRNGIARGRQLTSDV

SEQ ID NO: 988 - DNA, 696 bp, Alicyclobacillus acidocaldarius
atggggacatggcaagatgagagcgtaatcaaagtcttagtggttgatgatcacgagttatttcggcgtggggtcgtaacagtgcttcgttcgacaccagggatctacgtcgtaggagaggcgggaaatggccgtgaagcgatcgaatgctttcagacgctgcaaccggacgttacgcttctagatattcacatgcccgtgtgcaacggtctggaaacagcccgaaagatgcgagaagcaaatccgaacacgaagatcctcatgctgacggtgtcggaaacagaggagatgctgttcgaagctgtgaaaagtggagcgtctgggtatgtgttgaaatcggtaagtccagaacggttgatcgagtgtgttcgtcaagtctatgagggggaacctgtcgttccgagcagccttgcgatgaaaatgattgctgaattctcacgtactgctgagacacgtatgccttccagtgagtcggtaacggaattgacggagcgcgaacgagaagttcttcaatatcttagtgcgggggccagcaacaaagaaattgcccgggcacttttcattagtgaaaacacagttcgcaatcatgttcggcacatcctagacaagttgcatttgtcgaatcgcgctcaagctgccgcatacgcggtgcgcaatggtattgctcgagggcgtcaacttacaagcgatgtatga

SEQ ID NO: 989 - protein, 212 aa, Thermobifida fusca YX
IKVLVVDDHEFFRRGLVSVLAEEPDIEVVGEAGDGEEAVARAKELRPDVVLLDVRMPKRSGIAACAGIKEAVPDAKIVMLTMSDEEEDLFEAIKAGATGYLLKEISVVELPEAVRAVCKGQSFINPSMATKLINEFAALARKGKDRRSQPTKPPRLTERETEVLRLVARGLNNRDIADRLYISDNTVKNHVRNILEKLQLHSRTEAAVYAIR

SEQ ID NO: 990 - protein, 211 aa, Symbiobacterium thermophilum IAM 14863
MKVLIVDDHLMLRKGVLSVLSNTDLEVIGEASNGQEALELVPKLKPDLVLMDINMPVLDGVEATRKLKQMYPDLKVVILTVSEIDKDLFEAIKAGADGYLLKNLGPEELVSSLRAAISGEAPISSVMAAKMLKEFRQPRANTTGKQPGQQLSPREIEVLRLASTGLTYKEIAAKLYVAESTVKNHMRHILEKLHLRNRSEAVGYAIRTGLA

SEQ ID NO: 991 - protein, 218 aa, Frankia sp. CcI3
EGSALIRVLVVDDHELFLQGLQTVLEIEEDISVVGRAGNGQEALTLASGTSPDIVLMDVRMPGRDGIAAAGAIKRAVPRTRIVMLTVSDEESDLFEAIKAGAVGYLLKSIPPHEVADAVRAVHNGQSLISPSMASKLMVEFATMARGTEDRPRAHAPHLTARELEVLKLVAEGRANREIARKLFISENTVKNHVRNILDKLQLHSRMEAVMYAVRQGL

SEQ ID NO: 992 - protein, 218 aa, Frankia sp. EAN1pec
RDVMPIRVLVVDDHELFLQGLQTVLETEEDISVVGRAADGQEALTLASGTTPDIVLMDVRMPGRDGIAAAGAIKRAVPRTRIVMLTVSDEESDLFEAIKAGAVGYLLKSIPPHEVADAVRAVHNGQSLISPSMASKLMVEFATMARGGEDRPRAHAPHLTARELEVLKLVAEGRANREIARKLFISENTVKNHVRNILDKLQLHSRMEAVMYAVRQGL

SEQ ID NO: 993 - protein, 216 aa, Streptomyces coelicolor A3(2)
EEPIRVLVVDDHALFRRGLEIVLAAEEDIQVVGEAGDGAEAVEKAADLLPDIVLMDVRMPKRGGIEACTSIKEVAPSAKIIMLTISDEEADLYDAIKAGATGYLLKEISTDEVATAIRAVADGQSQISPSMASKLLTEFKSMIQRTDERRLVPAPRLTDRELEVLKLVATGMNNRDIAKELFISENTVKNHVRNILEKLQLHSRMEAVVYAMREKI

SEQ ID NO: 994 - protein, 231 aa, Artificial
  Substituion in SEQ ID NO 987
MGTWQDESVIKVLVVDDHELFRRGVVTVLRSTPGIYVVGEAGNGREAIECFQTLQPDVTLLDIHMPVCNGLETARKMREANPNTKILMLTVSETEEMLFEAVKSGASGYVLKSVSPERLIECVRQVYEGEPVVPSSLAMKMIAEFSRTAETRMPSSESVTELTEREREVLQYLSAGASNKEIARALFISENTVRNHVRHILDKLHLSNRAQAAAYAVRQGIARGRQLTSDV

SEQ ID NO: 995 - protein, 231 aa, Artificial
  Substituion in SEQ ID NO 987
MGTWQDESVIKVLVVDDHELFRRGVVTVLRSTPGIYVVGEAGNGREAIECFQTLQPDVTLLDIHMPVCNGLETARKMREAQPNTKILMLTVSETEEMLFEAVKSGASGYVLKSVSPERLIECVRQVYEGEPVVPSSLAMKMIAEFSRTAETRMPSSESVTELTEREREVLQYLSAGASNKEIARALFISENTVRNHVRHILDKLHLSNRAQAAAYAVRNGIARGRQLTSDV

SEQ ID NO: 996 - protein, 231 aa, Artificial
  Substituion in SEQ ID NO 987
MGTWNDESVIKVLVVDDHELFRRGVVTVLRSTPGIYVVGEAGNGREAIECFQTLQPDVTLLDIHMPVCNGLETARKMREANPNTKILMLTVSETEEMLFEAVKSGASGYVLKSVSPERLIECVRQVYEGEPVVPSSLAMKMIAEFSRTAETRMPSSESVTELTEREREVLQYLSAGASNKEIARALFISENTVRNHVRHILDKLHLSNRAQAAAYAVRNGIARGRQLTSDV

SEQ ID NO: 997 - protein, 231 aa, Artificial
  Substituion in SEQ ID NO 987
MGTWQDESVIKVLVVDDHELFRRGVVTVLRSTPGIYVVGEAGNGREAIECFQTLQPDVTLLDIHMPVCNGLETARKMREANPNTKILMLTVSETEEMLFEAVKSGASGYVLKSVSPERLIECVRQVYEGEPVVPSSLAMKMLAEFSRTAETRMPSSESVTELTEREREVLQYLSAGASNKEIARALFISENTVRNHVRHILDKLHLSNRAQAAAYAVRNGIARGRQLTSDV

SEQ ID NO: 998 - protein, 231 aa, Artificial
  Substituion in SEQ ID NO 987
MGTWQDESVIKVLVVDDHELFRRGVVTVLRSTPGIYVVGEAGNGREAIECFQTLQPDVTLLDIHMPVCNGLETARKMREANPNTKILMLTVSETEEMLFEAVKSGASGYVLKSVSPERLIECVRQIYEGEPVVPSSLAMKMIAEFSRTAETRMPSSESVTELTEREREVLQYLSAGASNKEIARALFISENTVRNHVRHILDKLHLSNRAQAAAYAVRNGIARGRQLTSDV

SEQ ID NO: 999 - DNA, 696 bp, Artificial
  Substituion in SEQ ID NO 988
atggggacatggcaagatgagagcgtaatcaaagtcttagtggttgatgatcacgagttatttcggcgtggggtcgtaacagtgcttcgttcgacaccagggatctacgtcgtaggagaggcgggaaatggccgtgaagcgatcgaatgctttcagacgctgcaaccggacgttacgcttctagatattcacatgcccgtgtgcaacggtctggaaacagcccgaaagatgcgagaagcaaatccgaacacgaagatcctcatgctgacggtgtcggaaacagaggagatgctgttcgaagctgtgaaaagtggagcgtctgggtatgtgttgaaatcggtaagtccagaacggttgatcgagtgtgttcgtcaagtctatgagggggaacctgtcgttccgagcagccttgcgatgaaaatgattgctgaattctcacgtactgctgagacacgtatgccttccagtgagtcggtaacggaattgacggagcgcgaacgagaagttcttcaatatcttagtgcgggggccagcaacaaagaaattgcccgggcacttttcattagtgaaaacacagttcgcaatcatgttcggcacatcctagacaagttgcatttgtcgaatcgcgctcaagctgccgcatacgcggtgcgccaaggtattgctcgagggcgtcaacttacaagcgatgtatga

SEQ ID NO: 1000 - DNA, 696 bp, Artificial
  Substituion in SEQ ID NO 988
atggggacatggcaagatgagagcgtaatcaaagtcttagtggttgatgatcacgagttatttcggcgtggggtcgtaacagtgcttcgttcgacaccagggatctacgtcgtaggagaggcgggaaatggccgtgaagcgatcgaatgctttcagacgctgcaaccggacgttacgcttctagatattcacatgcccgtgtgcaacggtctggaaacagcccgaaagatgcgagaagcacaaccgaacacgaagatcctcatgctgacggtgtcggaaacagaggagatgctgttcgaagctgtgaaaagtggagcgtctgggtatgtgttgaaatcggtaagtccagaacggttgatcgagtgtgttcgtcaagtctatgagggggaacctgtcgttccgagcagccttgcgatgaaaatgattgctgaattctcacgtactgctgagacacgtatgccttccagtgagtcggtaacggaattgacggagcgcgaacgagaagttcttcaatatcttagtgcgggggccagcaacaaagaaattgcccgggcacttttcattagtgaaaacacagttcgcaatcatgttcggcacatcctagacaagttgcatttgtcgaatcgcgctcaagctgccgcatacgcggtgcgcaatggtattgctcgagggcgtcaacttacaagcgatgtatga

SEQ ID NO: 1001 - DNA, 696 bp, Artificial
  Substituion in SEQ ID NO 988
atggggacatggaatgatgagagcgtaatcaaagtcttagtggttgatgatcacgagttatttcggcgtggggtcgtaacagtgcttcgttcgacaccagggatctacgtcgtaggagaggcgggaaatggccgtgaagcgatcgaatgctttcagacgctgcaaccggacgttacgcttctagatattcacatgcccgtgtgcaacggtctggaaacagcccgaaagatgcgagaagcaaatccgaacacgaagatcctcatgctgacggtgtcggaaacagaggagatgctgttcgaagctgtgaaaagtggagcgtctgggtatgtgttgaaatcggtaagtccagaacggttgatcgagtgtgttcgtcaagtctatgagggggaacctgtcgttccgagcagccttgcgatgaaaatgattgctgaattctcacgtactgctgagacacgtatgccttccagtgagtcggtaacggaattgacggagcgcgaacgagaagttcttcaatatcttagtgcgggggccagcaacaaagaaattgcccgggcacttttcattagtgaaaacacagttcgcaatcatgttcggcacatcctagacaagttgcatttgtcgaatcgcgctcaagctgccgcatacgcggtgcgcaatggtattgctcgagggcgtcaacttacaagcgatgtatga

SEQ ID NO: 1002 - DNA, 696 bp, Artificial
  Substituion in SEQ ID NO 988
atggggacatggcaagatgagagcgtaatcaaagtcttagtggttgatgatcacgagttatttcggcgtggggtcgtaacagtgcttcgttcgacaccagggatctacgtcgtaggagaggcgggaaatggccgtgaagcgatcgaatgctttcagacgctgcaaccggacgttacgcttctagatattcacatgcccgtgtgcaacggtctggaaacagcccgaaagatgcgagaagcaaatccgaacacgaagatcctcatgctgacggtgtcggaaacagaggagatgctgttcgaagctgtgaaaagtggagcgtctgggtatgtgttgaaatcggtaagtccagaacggttgatcgagtgtgttcgtcaagtctatgagggggaacctgtcgttccgagcagccttgcgatgaaaatgttagctgaattctcacgtactgctgagacacgtatgccttccagtgagtcggtaacggaattgacggagcgcgaacgagaagttcttcaatatcttagtgcgggggccagcaacaaagaaattgcccgggcacttttcattagtgaaaacacagttcgcaatcatgttcggcacatcctagacaagttgcatttgtcgaatcgcgctcaagctgccgcatacgcggtgcgcaatggtattgctcgagggcgtcaacttacaagcgatgtatga

SEQ ID NO: 1003 - DNA, 696 bp, Artificial
  Substituion in SEQ ID NO 988
atggggacatggcaagatgagagcgtaatcaaagtcttagtggttgatgatcacgagttatttcggcgtggggtcgtaacagtgcttcgttcgacaccagggatctacgtcgtaggagaggcgggaaatggccgtgaagcgatcgaatgctttcagacgctgcaaccggacgttacgcttctagatattcacatgcccgtgtgcaacggtctggaaacagcccgaaagatgcgagaagcaaatccgaacacgaagatcctcatgctgacggtgtcggaaacagaggagatgctgttcgaagctgtgaaaagtggagcgtctgggtatgtgttgaaatcggtaagtccagaacggttgatcgagtgtgttcgtcaaatttatgagggggaacctgtcgttccgagcagccttgcgatgaaaatgattgctgaattctcacgtactgctgagacacgtatgccttccagtgagtcggtaacggaattgacggagcgcgaacgagaagttcttcaatatcttagtgcgggggccagcaacaaagaaattgcccgggcacttttcattagtgaaaacacagttcgcaatcatgttcggcacatcctagacaagttgcatttgtcgaatcgcgctcaagctgccgcatacgcggtgcgcaatggtattgctcgagggcgtcaacttacaagcgatgtatga

SEQ ID NO: 1004 - protein, 701 aa, Alicyclobacillus acidocaldarius
MIVREAVHALWVALGVISALEFLNMRSSWLRRNHVYEFFTDWLPYGLIWIWIGWVDGVGNVVMPLYATLSCALHTPNRWNRKISLLGMMIPAALYVIHERHFDPVESEILIGIAAGYVVFHNRVRASYWAYGCANIVATGFCVLHMTPFTFGTFEETLIVSTIFALYEHDALIRARYKEERGLDPLTGLYNRRGAEEWLNLHEGNAGIAVLVDLDDFKFINDFFGHDAGDEVLRKVGGLLLRFVSSPGIGVRWGGDEFLILAEHETAQSAEQFVEELFSQLSSLELSLNERRLRLRCSVGVAYGPLGDLLITEADRALLRVKQSGKAHVEWYHSTIENQGEQLDINQYAFQKAFHQLTEFCSAPCLATDLEFRIIDLNEAYERVSGYTRHALRGQKPSMLAFGDWNRRWYPEIHETLQRGRSWTGILHNQREDGTIWSGEMVISPVRIGEITAGYWCMVRRVFSGDKVRTELLNYEIQVDQDTAEYIENIFLQVLAEVAEWGDPELHAHVLRVRRYTNWLAAKLADRKLIDPRDVPILSSASIAHDIGKVAIAREILFKPNTLDDVEHLYIQRHTEIGEQILQSVLDKLDDMHVHAKRVVEYAKVIAGSHHEWWNGKGYPRGLRGNDIPLPGRLVAITDVLDALLSRRPYKEPWSLEEVRNYIESHRGLQFDPKLVTILLEEWAAFEDLVKEVTLYEVRES

SEQ ID NO: 1005 - DNA, 2106 bp, Alicyclobacillus acidocaldarius
ttgatcgtccgagaagctgtgcatgctttatgggttgcattgggtgtgattagtgcgttggagtttcttaacatgcggtcatcatggctgcgacgtaatcacgtttatgaattctttacagattggcttccctatggactgatttggatatggattggttgggtcgatggagtcggcaatgtggtcatgccactgtatgccacgttatcgtgtgccctgcacacaccgaatcgctggaatcgaaagatcagtctgcttggtatgatgattccagccgcgctttatgtcatacatgaaagacattttgatccggtggaaagcgagatattgataggcatagcggccggttatgttgtgtttcacaacagggttcgagcgtcgtattgggcgtacggatgtgcaaacattgttgcaactggattctgcgttttgcatatgaccccttttacattcggaacgttcgaagaaacattgattgtatcgactatttttgcgttgtacgagcacgatgccttgattcgtgcacgatacaaagaggagcgagggcttgatcctcttactggactgtacaatcgtagaggcgctgaagaatggttaaacttgcatgagggcaacgcgggtatcgcagttttggtggatctggatgattttaagttcatcaatgatttctttgggcatgacgctggagatgaagttttgcgcaaggtcggcggattgcttttgcgtttcgtttcatctcctggaataggcgttcggtgggggggagacgagtttttaattctcgctgagcacgaaacagcacaaagtgctgagcaatttgtggaggaattatttagtcaattgtcttccctggaactttccttaaacgaacgtcgacttcgtctacgatgtagtgtaggtgtagcatatggacctcttggtgatttacttatcacagaagcagacagggcactactacgcgtgaagcagtcaggtaaagcgcatgtagagtggtatcattctacgatcgaaaaccaaggggaacaactggacatcaatcagtacgcgtttcaaaaggcgtttcatcagttaacagagttctgttccgcgccctgtcttgcgactgatctggaattccgcattatcgacttgaacgaagcttatgagcgagtttcaggatatacacgtcatgcgttgcgcggacaaaaaccgagtatgcttgcatttggagattggaatcgtcggtggtatcccgagattcacgagacattacagcgaggacgtagttggacggggattcttcataatcagcgtgaagatggaacgatatggtcgggggaaatggtcatttcgccggttcgcattggtgaaattacagcaggctattggtgtatggtgcgaagagtgttctctggggacaaggtacgtacagagttactaaactatgagatccaagtagatcaagatacggctgaatatatagaaaatatatttttgcaggtgctagctgaggttgctgaatggggcgatcctgaattgcatgcacacgtattacgtgtgcgccgatacacaaattggctggccgctaagcttgcggaccgcaagttgattgacccaagagatgtcccgatcctgtcgtctgcgagtattgcacatgatattggtaaagtggctatcgcgcgcgagattttgtttaagccaaatactctggatgatgtggagcatttatacatccaacgacataccgagattggtgaacaaattttgcaatccgttttggacaaactcgatgatatgcacgtacacgccaaacgcgtagtggaatacgctaaggtcatcgctggtagccatcacgaatggtggaacggtaaagggtatccacgtggtctacgaggaaatgacatacctttgcctggacgactcgttgcgattactgatgttctcgatgcactcctgagccgtcgtccgtataaggaaccatggtctcttgaagaggtgcgaaactacattgaatcacatcgcggtcttcaatttgatccgaaattggtcacgatccttctcgaagaatgggcggcgtttgaagacctcgtgaaggaagtcacactgtatgaggtgagagaatcatga

SEQ ID NO: 1006 - protein, 295 aa, Arcobacter butzleri RM4018
TDLKGVITHASSAFCKISGYEKKELIGKPHNIIRHPETSKETFKKMWEEIQKEKKFTTELKNLRKDGTYYWVVAEIEPKYDKKGNHIGYFAVREDITANKEIEEIQKEIIFTMGSIAESRSKETSEHIERVAKYTELIALELGLEPKEAKMLKLASPMHDIGKIAIPDYILNKPAKLTPEEFEIVKTHTIKGYEMLNLSERPLLKTAAIIALTHHEKYDGTGYPKGLKGEEIPLYGRITAIADVFDALAHERCYKKAWRVDKIVEYIKEERGKHFDPKLVDLFFENFDKILEIKK

SEQ ID NO: 1007 - protein, 508 aa, Ruminococcus obeum ATCC 29174
YNRELYTDALTGIYNRRYYEERIKNSDMTAGIAMIDLDDFKIYNDTFGHDAGDLALTTVVGIVKANVRRTDMLIRMGGDEFLLVMPDITDQIFADKLKQIQEKIHDTKVPGYSQLRLSVSIGGVLSAPGSTVENAIHKADQFMYQAKTCKNMVVTEHDEEVQDKAEGGETSKTYKYRILIVDDSEMNRAILSEILSEEYDIVEADSGESCIDKLRQYEREISLVLLDIVMPGMDGFGVLNYMNRHHYLEDIPVIMISSEDSTEVVRRAYEMGVSDYINRPFDAGVVHRRVYNTIKLYAKQRRLITLITNQVYEKEKNNRMMVEILSQIVEFRNGESGSHVLNINILTGMILESLVQKTDKYNITWSERLLITTASALHDIGKIGIDDKILNKPGKLTDEEFKIMQNHTIIGARILKNMEGYEDEELMMVAYQICRWHHERYDGRGYPDGLKGDEIPISAQVVSLADVYDALVGERVYKKAYSHEKAVQMILNGECGAFNPILLECLID

SEQ ID NO: 1008 - protein, 200 aa, Vibrio vulnificus YJ016
ENLNLLLDVRETSKELVYNLANAVEARSKETGAHVQRVSLISEKLAQLYGLSDFEVNLIKHASPLHDVGKVAIPDNILHKPSKLDAQEWEIMKKHVEYGVNILSKSKRRLFAIAKEIAGTHHEKWDGSGYPMGLKGEAIPISGRITGLADVFDALGAKRSYKEPWSDEQIRQEIEAQKGKHFDPRLVDLLLENWQAFIDI

SEQ ID NO: 1009 - protein, 200 aa, Vibrio vulnificus CMCP6
ENLNLLLDVRETSKELVYNLANAVEARSKETGAHVQRVSLISEKLAQLYGLSDFEVNLIKHASPLHDVGKVAIPDNILHKPGKLDAQEWEIMKKHVEYGVNILSKSKRRLFAIAKEIAGTHHEKWDGSGYPMGLQGEAIPISGRITGLADVFDALGAKRSYKEPWSDEQIRQEIEAQKGKHFDPRLVDLLLENWQAFIDI

SEQ ID NO: 1010 - protein, 215 aa, Methylobacterium sp. 4-46
RAYREQEERAAWLAREVAAAVSLVEAREREIVTLLMRAAEHRDTDTGDHVARVAGYVGLIAEAMGFPPDRGRLISLASTMHDVGKIAIPDAILLKRGPLSAAERREMERHAERGERMLESSSSEVVRLAAEIAGTHHERWDGTGYPRGLKGEEIPLSGRIVAVADVFDALTSARPYKAAWSLEAARDHVRAQAGTHFDPAVVEAFLGRWPAVEAL

SEQ ID NO: 1011 - protein, 701 aa, Artificial
  Substituion in SEQ ID NO 1004
MIVREAVHALWVALGVISALEFLNMRSSWLRRNHVYEFFTDWLPYGLIWIWIGWVDGVGNVVMPLYATLSCALHTPNRWNRKISLLGMMIPAALYVIHERHFDPVESEILIGIAAGYVVFHNRVRASYWAYGCANIVATGFCVLHMTPFTFGTFEETLIVSTIFALYEHDALIRARYKEERGLEPLTGLYNRRGAEEWLNLHEGNAGIAVLVDLDDFKFINDFFGHDAGDEVLRKVGGLLLRFVSSPGIGVRWGGDEFLILAEHETAQSAEQFVEELFSQLSSLELSLNERRLRLRCSVGVAYGPLGDLLITEADRALLRVKQSGKAHVEWYHSTIENQGEQLDINQYAFQKAFHQLTEFCSAPCLATDLEFRIIDLNEAYERVSGYTRHALRGQKPSMLAFGDWNRRWYPEIHETLQRGRSWTGILHNQREDGTIWSGEMVISPVRIGEITAGYWCMVRRVFSGDKVRTELLNYEIQVDQDTAEYIENIFLQVLAEVAEWGDPELHAHVLRVRRYTNWLAAKLADRKLIDPRDVPILSSASIAHDIGKVAIAREILFKPNTLDDVEHLYIQRHTEIGEQILQSVLDKLDDMHVHAKRVVEYAKVIAGSHHEWWNGKGYPRGLRGNDIPLPGRLVAITDVLDALLSRRPYKEPWSLEEVRNYIESHRGLQFDPKLVTILLEEWAAFEDLVKEVTLYEVRES

SEQ ID NO: 1012 - protein, 701 aa, Artificial
  Substituion in SEQ ID NO 1004
MIVREAVHALWVALGVISALEFLNMRSSWLRRNHVYEFFTDWLPYGLIWIWIGWVDGVGNVVMPLYATLSCALHTPNRWNRKISLLGMMIPAALYVIHERHFDPVESEILIGIAAGYVVFHNRVRASYWAYGCANIVATGFCVLHMTPFTFGTFEETLIVSTIFALYEHDALIRARYKEERGLDPLTGLYNRRGAEEWLNLHEGNAGIAVLVDLDDFKFINDFFGHDAGDEVLRKVGGLLLRFVSSPGIGVRWGGDEFLILAEHETAQSAEQFVEELFSQLSSLELSLNERRLRLRCSVGVAYGPLGDLLITEADRALLRVKQSGKAHVEWYHSTIENQGEQLDINQYAFQKAFHQLTEFCSAPCLATDLEFRIIDLNEAYERVSGYTRHALRGQKPSMLAFGDWNRRWYPEIHETLQRGRSWTGILHNQREDGTIWSGEMVISPVRIGEITAGYWCMVRRVFSGDKVRTELLNYEIQVDQDTAEYIENIFLNVLAEVAEWGDPELHAHVLRVRRYTNWLAAKLADRKLIDPRDVPILSSASIAHDIGKVAIAREILFKPNTLDDVEHLYIQRHTEIGEQILQSVLDKLDDMHVHAKRVVEYAKVIAGSHHEWWNGKGYPRGLRGNDIPLPGRLVAITDVLDALLSRRPYKEPWSLEEVRNYIESHRGLQFDPKLVTILLEEWAAFEDLVKEVTLYEVRES

SEQ ID NO: 1013 - protein, 701 aa, Artificial
  Substituion in SEQ ID NO 1004
MIVREAVHALWVALGVISALEFLNMRSSWLRRNHVYEFFTDWLPYGLIWIWIGWVDGVGNVVMPLYATLSCALHTPNRWNRKISLLGMMIPAALYVIHERHFDPVESEILIGIAAGYVVFHNRVRASYWAYGCANIVATGFCVLHMTPFTFGTFEETLIVSTIFALYEHDALIRARYKEERGLDPLTGLYNRRGAEEWLNLHEGNAGIAVLVDLDDFKFINDFFGHDAGDEVLRKVGGLLLRFVSSPGIGVRWGGDEFLILAEHETAQSAEQFVEELFSQLSSLELSLNERRLRLRCSVGVAYGPLGDLLITEADRALLRVKQSGKAHVEWYHSTIENQGEQLDINQYAFQKAFHQLTEFCSAPCLATDLEFRIIDLNEAYERVSGYTRHALRGQKPSMLAFGDWNRRWYPEIHETLQRGRSWTGILHNQREDGTIWSGEMVISPVRIGEITAGYWCMVRRVFSGDKVRTELLNYEIQVDQDTAEYIENIFLQVLAEVAEWGDPELHAHVLRVRRYTNWLAAKLADRKLIDPRDVPILSSASIAHDIGKVAIAREILFKPNTLDDVEHLYIQRHTEIGEQILQSVLDKLDDMHVHAKRVVEYAKVIAGSHHEWWNGKGYPRGLRGNDIPLPGRLVAITDVLDALLSRRPYKEPWSLEEVRNYIESHRGLQFDPKLVTILLEEWAAFEDLVKDVTLYEVRES

SEQ ID NO: 1014 - protein, 701 aa, Artificial
  Substituion in SEQ ID NO 1004
MIVREAVHALWVALGVISALEFLNMRSSWLRRNHVYEFFTDWLPYGLIWIWIGWVDGVGNVVMPLYATLSCALHTPNRWNRKISLLGMMIPAALYVIHERHFDPVESEILIGIAAGYVVFHNRIRASYWAYGCANIVATGFCVLHMTPFTFGTFEETLIVSTIFALYEHDALIRARYKEERGLDPLTGLYNRRGAEEWLNLHEGNAGIAVLVDLDDFKFINDFFGHDAGDEVLRKVGGLLLRFVSSPGIGVRWGGDEFLILAEHETAQSAEQFVEELFSQLSSLELSLNERRLRLRCSVGVAYGPLGDLLITEADRALLRVKQSGKAHVEWYHSTIENQGEQLDINQYAFQKAFHQLTEFCSAPCLATDLEFRIIDLNEAYERVSGYTRHALRGQKPSMLAFGDWNRRWYPEIHETLQRGRSWTGILHNQREDGTIWSGEMVISPVRIGEITAGYWCMVRRVFSGDKVRTELLNYEIQVDQDTAEYIENIFLQVLAEVAEWGDPELHAHVLRVRRYTNWLAAKLADRKLIDPRDVPILSSASIAHDIGKVAIAREILFKPNTLDDVEHLYIQRHTEIGEQILQSVLDKLDDMHVHAKRVVEYAKVIAGSHHEWWNGKGYPRGLRGNDIPLPGRLVAITDVLDALLSRRPYKEPWSLEEVRNYIESHRGLQFDPKLVTILLEEWAAFEDLVKEVTLYEVRES

SEQ ID NO: 1015 - protein, 701 aa, Artificial
  Substituion in SEQ ID NO 1004
MIVREAVHALWVALGVISALEFLNMRSSWLRRNHVYEFFTDWLPYGLIWIWIGWVDGVGNVVMPLYATLSCALHTPNRWNRKISLLGMMIPAALYVIHERHFDPVESEILIGIAAGYVVFHNRVRASYWAYGCANIVATGFCVLHMTPFTFGTFEETLIVSTIFALYEHDALIRARYKEERGLDPLTGLYNRRGAEEWLNLHEGNAGIAVLVDLDDFKFINDFFGHDAGDEVLRKVGGLLLRFVSSPGIGVRWGGDEFLILAEHETAQSAEQFVEELFSQLSSLELSLNERRLRLRCSVGVAYGPLGDLLITEADRALLRVKQSGKAHVEWYHSTIENQGEQLDINQYAFQKAFHQLTEFCSAPCLATDLEFRIIDLNEAYERVSGYTRHALRGQKPSMLAFGDWNRRWYPEIHETLQRGRSWTGILHNQREDGTIWSGEMVISPVRIGEITAGYWCMVRRVFSGDKVRTELLNYEIQVDQDTAEYIENIFLQVLAEVAEWGDPELHAHVLRVRRYTQWLAAKLADRKLIDPRDVPILSSASIAHDIGKVAIAREILFKPNTLDDVEHLYIQRHTEIGEQILQSVLDKLDDMHVHAKRVVEYAKVIAGSHHEWWNGKGYPRGLRGNDIPLPGRLVAITDVLDALLSRRPYKEPWSLEEVRNYIESHRGLQFDPKLVTILLEEWAAFEDLVKEVTLYEVRES

SEQ ID NO: 1016 - DNA, 2106 bp, Artificial
  Substituion in SEQ ID NO 1005
ttgatcgtccgagaagctgtgcatgctttatgggttgcattgggtgtgattagtgcgttggagtttcttaacatgcggtcatcatggctgcgacgtaatcacgtttatgaattctttacagattggcttccctatggactgatttggatatggattggttgggtcgatggagtcggcaatgtggtcatgccactgtatgccacgttatcgtgtgccctgcacacaccgaatcgctggaatcgaaagatcagtctgcttggtatgatgattccagccgcgctttatgtcatacatgaaagacattttgatccggtggaaagcgagatattgataggcatagcggccggttatgttgtgtttcacaacagggttcgagcgtcgtattgggcgtacggatgtgcaaacattgttgcaactggattctgcgttttgcatatgaccccttttacattcggaacgttcgaagaaacattgattgtatcgactatttttgcgttgtacgagcacgatgccttgattcgtgcacgatacaaagaggagcgagggcttgaacctcttactggactgtacaatcgtagaggcgctgaagaatggttaaacttgcatgagggcaacgcgggtatcgcagttttggtggatctggatgattttaagttcatcaatgatttctttgggcatgacgctggagatgaagttttgcgcaaggtcggcggattgcttttgcgtttcgtttcatctcctggaataggcgttcggtgggggggagacgagtttttaattctcgctgagcacgaaacagcacaaagtgctgagcaatttgtggaggaattatttagtcaattgtcttccctggaactttccttaaacgaacgtcgacttcgtctacgatgtagtgtaggtgtagcatatggacctcttggtgatttacttatcacagaagcagacagggcactactacgcgtgaagcagtcaggtaaagcgcatgtagagtggtatcattctacgatcgaaaaccaaggggaacaactggacatcaatcagtacgcgtttcaaaaggcgtttcatcagttaacagagttctgttccgcgccctgtcttgcgactgatctggaattccgcattatcgacttgaacgaagcttatgagcgagtttcaggatatacacgtcatgcgttgcgcggacaaaaaccgagtatgcttgcatttggagattggaatcgtcggtggtatcccgagattcacgagacattacagcgaggacgtagttggacggggattcttcataatcagcgtgaagatggaacgatatggtcgggggaaatggtcatttcgccggttcgcattggtgaaattacagcaggctattggtgtatggtgcgaagagtgttctctggggacaaggtacgtacagagttactaaactatgagatccaagtagatcaagatacggctgaatatatagaaaatatatttttgcaggtgctagctgaggttgctgaatggggcgatcctgaattgcatgcacacgtattacgtgtgcgccgatacacaaattggctggccgctaagcttgcggaccgcaagttgattgacccaagagatgtcccgatcctgtcgtctgcgagtattgcacatgatattggtaaagtggctatcgcgcgcgagattttgtttaagccaaatactctggatgatgtggagcatttatacatccaacgacataccgagattggtgaacaaattttgcaatccgttttggacaaactcgatgatatgcacgtacacgccaaacgcgtagtggaatacgctaaggtcatcgctggtagccatcacgaatggtggaacggtaaagggtatccacgtggtctacgaggaaatgacatacctttgcctggacgactcgttgcgattactgatgttctcgatgcactcctgagccgtcgtccgtataaggaaccatggtctcttgaagaggtgcgaaactacattgaatcacatcgcggtcttcaatttgatccgaaattggtcacgatccttctcgaagaatgggcggcgtttgaagacctcgtgaaggaagtcacactgtatgaggtgagagaatcatga

SEQ ID NO: 1017 - DNA, 2106 bp, Artificial
  Substituion in SEQ ID NO 1005
ttgatcgtccgagaagctgtgcatgctttatgggttgcattgggtgtgattagtgcgttggagtttcttaacatgcggtcatcatggctgcgacgtaatcacgtttatgaattctttacagattggcttccctatggactgatttggatatggattggttgggtcgatggagtcggcaatgtggtcatgccactgtatgccacgttatcgtgtgccctgcacacaccgaatcgctggaatcgaaagatcagtctgcttggtatgatgattccagccgcgctttatgtcatacatgaaagacattttgatccggtggaaagcgagatattgataggcatagcggccggttatgttgtgtttcacaacagggttcgagcgtcgtattgggcgtacggatgtgcaaacattgttgcaactggattctgcgttttgcatatgaccccttttacattcggaacgttcgaagaaacattgattgtatcgactatttttgcgttgtacgagcacgatgccttgattcgtgcacgatacaaagaggagcgagggcttgatcctcttactggactgtacaatcgtagaggcgctgaagaatggttaaacttgcatgagggcaacgcgggtatcgcagttttggtggatctggatgattttaagttcatcaatgatttctttgggcatgacgctggagatgaagttttgcgcaaggtcggcggattgcttttgcgtttcgtttcatctcctggaataggcgttcggtgggggggagacgagtttttaattctcgctgagcacgaaacagcacaaagtgctgagcaatttgtggaggaattatttagtcaattgtcttccctggaactttccttaaacgaacgtcgacttcgtctacgatgtagtgtaggtgtagcatatggacctcttggtgatttacttatcacagaagcagacagggcactactacgcgtgaagcagtcaggtaaagcgcatgtagagtggtatcattctacgatcgaaaaccaaggggaacaactggacatcaatcagtacgcgtttcaaaaggcgtttcatcagttaacagagttctgttccgcgccctgtcttgcgactgatctggaattccgcattatcgacttgaacgaagcttatgagcgagtttcaggatatacacgtcatgcgttgcgcggacaaaaaccgagtatgcttgcatttggagattggaatcgtcggtggtatcccgagattcacgagacattacagcgaggacgtagttggacggggattcttcataatcagcgtgaagatggaacgatatggtcgggggaaatggtcatttcgccggttcgcattggtgaaattacagcaggctattggtgtatggtgcgaagagtgttctctggggacaaggtacgtacagagttactaaactatgagatccaagtagatcaagatacggctgaatatatagaaaatatatttttgaatgtgctagctgaggttgctgaatggggcgatcctgaattgcatgcacacgtattacgtgtgcgccgatacacaaattggctggccgctaagcttgcggaccgcaagttgattgacccaagagatgtcccgatcctgtcgtctgcgagtattgcacatgatattggtaaagtggctatcgcgcgcgagattttgtttaagccaaatactctggatgatgtggagcatttatacatccaacgacataccgagattggtgaacaaattttgcaatccgttttggacaaactcgatgatatgcacgtacacgccaaacgcgtagtggaatacgctaaggtcatcgctggtagccatcacgaatggtggaacggtaaagggtatccacgtggtctacgaggaaatgacatacctttgcctggacgactcgttgcgattactgatgttctcgatgcactcctgagccgtcgtccgtataaggaaccatggtctcttgaagaggtgcgaaactacattgaatcacatcgcggtcttcaatttgatccgaaattggtcacgatccttctcgaagaatgggcggcgtttgaagacctcgtgaaggaagtcacactgtatgaggtgagagaatcatga

SEQ ID NO: 1018 - DNA, 2106 bp, Artificial
  Substituion in SEQ ID NO 1005
ttgatcgtccgagaagctgtgcatgctttatgggttgcattgggtgtgattagtgcgttggagtttcttaacatgcggtcatcatggctgcgacgtaatcacgtttatgaattctttacagattggcttccctatggactgatttggatatggattggttgggtcgatggagtcggcaatgtggtcatgccactgtatgccacgttatcgtgtgccctgcacacaccgaatcgctggaatcgaaagatcagtctgcttggtatgatgattccagccgcgctttatgtcatacatgaaagacattttgatccggtggaaagcgagatattgataggcatagcggccggttatgttgtgtttcacaacagggttcgagcgtcgtattgggcgtacggatgtgcaaacattgttgcaactggattctgcgttttgcatatgaccccttttacattcggaacgttcgaagaaacattgattgtatcgactatttttgcgttgtacgagcacgatgccttgattcgtgcacgatacaaagaggagcgagggcttgatcctcttactggactgtacaatcgtagaggcgctgaagaatggttaaacttgcatgagggcaacgcgggtatcgcagttttggtggatctggatgattttaagttcatcaatgatttctttgggcatgacgctggagatgaagttttgcgcaaggtcggcggattgcttttgcgtttcgtttcatctcctggaataggcgttcggtgggggggagacgagtttttaattctcgctgagcacgaaacagcacaaagtgctgagcaatttgtggaggaattatttagtcaattgtcttccctggaactttccttaaacgaacgtcgacttcgtctacgatgtagtgtaggtgtagcatatggacctcttggtgatttacttatcacagaagcagacagggcactactacgcgtgaagcagtcaggtaaagcgcatgtagagtggtatcattctacgatcgaaaaccaaggggaacaactggacatcaatcagtacgcgtttcaaaaggcgtttcatcagttaacagagttctgttccgcgccctgtcttgcgactgatctggaattccgcattatcgacttgaacgaagcttatgagcgagtttcaggatatacacgtcatgcgttgcgcggacaaaaaccgagtatgcttgcatttggagattggaatcgtcggtggtatcccgagattcacgagacattacagcgaggacgtagttggacggggattcttcataatcagcgtgaagatggaacgatatggtcgggggaaatggtcatttcgccggttcgcattggtgaaattacagcaggctattggtgtatggtgcgaagagtgttctctggggacaaggtacgtacagagttactaaactatgagatccaagtagatcaagatacggctgaatatatagaaaatatatttttgcaggtgctagctgaggttgctgaatggggcgatcctgaattgcatgcacacgtattacgtgtgcgccgatacacaaattggctggccgctaagcttgcggaccgcaagttgattgacccaagagatgtcccgatcctgtcgtctgcgagtattgcacatgatattggtaaagtggctatcgcgcgcgagattttgtttaagccaaatactctggatgatgtggagcatttatacatccaacgacataccgagattggtgaacaaattttgcaatccgttttggacaaactcgatgatatgcacgtacacgccaaacgcgtagtggaatacgctaaggtcatcgctggtagccatcacgaatggtggaacggtaaagggtatccacgtggtctacgaggaaatgacatacctttgcctggacgactcgttgcgattactgatgttctcgatgcactcctgagccgtcgtccgtataaggaaccatggtctcttgaagaggtgcgaaactacattgaatcacatcgcggtcttcaatttgatccgaaattggtcacgatccttctcgaagaatgggcggcgtttgaagacctcgtgaaggatgtcacactgtatgaggtgagagaatcatga

SEQ ID NO: 1019 - DNA, 2106 bp, Artificial
  Substituion in SEQ ID NO 1005
ttgatcgtccgagaagctgtgcatgctttatgggttgcattgggtgtgattagtgcgttggagtttcttaacatgcggtcatcatggctgcgacgtaatcacgtttatgaattctttacagattggcttccctatggactgatttggatatggattggttgggtcgatggagtcggcaatgtggtcatgccactgtatgccacgttatcgtgtgccctgcacacaccgaatcgctggaatcgaaagatcagtctgcttggtatgatgattccagccgcgctttatgtcatacatgaaagacattttgatccggtggaaagcgagatattgataggcatagcggccggttatgttgtgtttcacaacaggattcgagcgtcgtattgggcgtacggatgtgcaaacattgttgcaactggattctgcgttttgcatatgaccccttttacattcggaacgttcgaagaaacattgattgtatcgactatttttgcgttgtacgagcacgatgccttgattcgtgcacgatacaaagaggagcgagggcttgatcctcttactggactgtacaatcgtagaggcgctgaagaatggttaaacttgcatgagggcaacgcgggtatcgcagttttggtggatctggatgattttaagttcatcaatgatttctttgggcatgacgctggagatgaagttttgcgcaaggtcggcggattgcttttgcgtttcgtttcatctcctggaataggcgttcggtgggggggagacgagtttttaattctcgctgagcacgaaacagcacaaagtgctgagcaatttgtggaggaattatttagtcaattgtcttccctggaactttccttaaacgaacgtcgacttcgtctacgatgtagtgtaggtgtagcatatggacctcttggtgatttacttatcacagaagcagacagggcactactacgcgtgaagcagtcaggtaaagcgcatgtagagtggtatcattctacgatcgaaaaccaaggggaacaactggacatcaatcagtacgcgtttcaaaaggcgtttcatcagttaacagagttctgttccgcgccctgtcttgcgactgatctggaattccgcattatcgacttgaacgaagcttatgagcgagtttcaggatatacacgtcatgcgttgcgcggacaaaaaccgagtatgcttgcatttggagattggaatcgtcggtggtatcccgagattcacgagacattacagcgaggacgtagttggacggggattcttcataatcagcgtgaagatggaacgatatggtcgggggaaatggtcatttcgccggttcgcattggtgaaattacagcaggctattggtgtatggtgcgaagagtgttctctggggacaaggtacgtacagagttactaaactatgagatccaagtagatcaagatacggctgaatatatagaaaatatatttttgcaggtgctagctgaggttgctgaatggggcgatcctgaattgcatgcacacgtattacgtgtgcgccgatacacaaattggctggccgctaagcttgcggaccgcaagttgattgacccaagagatgtcccgatcctgtcgtctgcgagtattgcacatgatattggtaaagtggctatcgcgcgcgagattttgtttaagccaaatactctggatgatgtggagcatttatacatccaacgacataccgagattggtgaacaaattttgcaatccgttttggacaaactcgatgatatgcacgtacacgccaaacgcgtagtggaatacgctaaggtcatcgctggtagccatcacgaatggtggaacggtaaagggtatccacgtggtctacgaggaaatgacatacctttgcctggacgactcgttgcgattactgatgttctcgatgcactcctgagccgtcgtccgtataaggaaccatggtctcttgaagaggtgcgaaactacattgaatcacatcgcggtcttcaatttgatccgaaattggtcacgatccttctcgaagaatgggcggcgtttgaagacctcgtgaaggaagtcacactgtatgaggtgagagaatcatga

SEQ ID NO: 1020 - DNA, 2106 bp, Artificial
  Substituion in SEQ ID NO 1005
ttgatcgtccgagaagctgtgcatgctttatgggttgcattgggtgtgattagtgcgttggagtttcttaacatgcggtcatcatggctgcgacgtaatcacgtttatgaattctttacagattggcttccctatggactgatttggatatggattggttgggtcgatggagtcggcaatgtggtcatgccactgtatgccacgttatcgtgtgccctgcacacaccgaatcgctggaatcgaaagatcagtctgcttggtatgatgattccagccgcgctttatgtcatacatgaaagacattttgatccggtggaaagcgagatattgataggcatagcggccggttatgttgtgtttcacaacagggttcgagcgtcgtattgggcgtacggatgtgcaaacattgttgcaactggattctgcgttttgcatatgaccccttttacattcggaacgttcgaagaaacattgattgtatcgactatttttgcgttgtacgagcacgatgccttgattcgtgcacgatacaaagaggagcgagggcttgatcctcttactggactgtacaatcgtagaggcgctgaagaatggttaaacttgcatgagggcaacgcgggtatcgcagttttggtggatctggatgattttaagttcatcaatgatttctttgggcatgacgctggagatgaagttttgcgcaaggtcggcggattgcttttgcgtttcgtttcatctcctggaataggcgttcggtgggggggagacgagtttttaattctcgctgagcacgaaacagcacaaagtgctgagcaatttgtggaggaattatttagtcaattgtcttccctggaactttccttaaacgaacgtcgacttcgtctacgatgtagtgtaggtgtagcatatggacctcttggtgatttacttatcacagaagcagacagggcactactacgcgtgaagcagtcaggtaaagcgcatgtagagtggtatcattctacgatcgaaaaccaaggggaacaactggacatcaatcagtacgcgtttcaaaaggcgtttcatcagttaacagagttctgttccgcgccctgtcttgcgactgatctggaattccgcattatcgacttgaacgaagcttatgagcgagtttcaggatatacacgtcatgcgttgcgcggacaaaaaccgagtatgcttgcatttggagattggaatcgtcggtggtatcccgagattcacgagacattacagcgaggacgtagttggacggggattcttcataatcagcgtgaagatggaacgatatggtcgggggaaatggtcatttcgccggttcgcattggtgaaattacagcaggctattggtgtatggtgcgaagagtgttctctggggacaaggtacgtacagagttactaaactatgagatccaagtagatcaagatacggctgaatatatagaaaatatatttttgcaggtgctagctgaggttgctgaatggggcgatcctgaattgcatgcacacgtattacgtgtgcgccgatacacacaatggctggccgctaagcttgcggaccgcaagttgattgacccaagagatgtcccgatcctgtcgtctgcgagtattgcacatgatattggtaaagtggctatcgcgcgcgagattttgtttaagccaaatactctggatgatgtggagcatttatacatccaacgacataccgagattggtgaacaaattttgcaatccgttttggacaaactcgatgatatgcacgtacacgccaaacgcgtagtggaatacgctaaggtcatcgctggtagccatcacgaatggtggaacggtaaagggtatccacgtggtctacgaggaaatgacatacctttgcctggacgactcgttgcgattactgatgttctcgatgcactcctgagccgtcgtccgtataaggaaccatggtctcttgaagaggtgcgaaactacattgaatcacatcgcggtcttcaatttgatccgaaattggtcacgatccttctcgaagaatgggcggcgtttgaagacctcgtgaaggaagtcacactgtatgaggtgagagaatcatga

SEQ ID NO: 1021 - protein, 70 aa, Alicyclobacillus acidocaldarius
MKLSMKLPTVTKQWSVIRRYQECKPDLVTMDLTMPNVDGIQAIKKIRAIDPDAKPFQIDRVISAVDKALN

SEQ ID NO: 1022 - DNA, 213 bp, Alicyclobacillus acidocaldarius
atgaagttgtcgatgaagctgccgacggtaaccaagcagtggagcgttatcaggcgttatcaggagtgcaaacctgatcttgtaacaatggatttaaccatgccaaatgtagatggtattcaagcgatcaagaaaattcgggctattgaccctgacgccaaaccgtttcaaattgaccgagtaataagcgctgtcgacaaagccctgaattga

SEQ ID NO: 1023 - protein, 80 aa, Clostridium phytofermentans ISDg
VERYNETKPDLVMMDITMPEMDGIQALKKIKSVDPNATVIMCSAMGQQAMVIESIQSGAKDFIVKPFQADRVLEAVKKAI

SEQ ID NO: 1024 - protein, 80 aa, Bacillus coagulans 36D1
IEKYKEHRPDLVTMDITMPEVDGISALKEIKKIDPDAKVIMCSAMGQQAMVIDAIQAGAKDFIVKPFQADRVIEAIQKTL

SEQ ID NO: 1025 - protein, 80 aa, Syntrophomonas wolfei subsp. wolfei str. Goettingen
IEKYKELKPDLVTMDITMPEMDGIAAVKEIKAVDPAARIIMCSAMGQQAMVIDAIQAGAKDFIVKPFQPERVIEAVSKAL

SEQ ID NO: 1026 - protein, 80 aa, Bacillus halodurans C-125
VEKYKELSPDLVTMDITMPEKDGIAALKDIRAIDPNAKVIMCSAMGQQAMVIDAIQAGAKDFIVKPFQADRVIDAIQKTL

SEQ ID NO: 1027 - protein, 80 aa, Bacillus sp. B14905
VEKYNELKPDLVTMDITMPEMDGIAALKAIKGSDPSATVIMCSAMGQQAMVIDAIQAGAKDFIVKPFQADRVIEAIQKAL

SEQ ID NO: 1028 - protein, 70 aa, Artificial
  Substituion in SEQ ID NO 1021
MKLSMKLPTVTKQWSVIRRYQECKPDLVTMDLTMPNVDGIQAIKKIRAIDPDAKPFQIDRVISAIDKALN

SEQ ID NO: 1029 - protein, 70 aa, Artificial
  Substituion in SEQ ID NO 1021
MKLSMKLPTVTKQWSVIRKYQECKPDLVTMDLTMPNVDGIQAIKKIRAIDPDAKPFQIDRVISAVDKALN

SEQ ID NO: 1030 - protein, 70 aa, Artificial
  Substituion in SEQ ID NO 1021
MKLSMKLPTVTKQWSVIKRYQECKPDLVTMDLTMPNVDGIQAIKKIRAIDPDAKPFQIDRVISAVDKALN

SEQ ID NO: 1031 - protein, 70 aa, Artificial
  Substituion in SEQ ID NO 1021
MKLSMKLPTITKQWSVIRRYQECKPDLVTMDLTMPNVDGIQAIKKIRAIDPDAKPFQIDRVISAVDKALN

SEQ ID NO: 1032 - protein, 70 aa, Artificial
  Substituion in SEQ ID NO 1021
MKLSMKLPTVTKQWSVIRRYQECKPDLVTMDLTMPNVDGIQALKKIRAIDPDAKPFQIDRVISAVDKALN

SEQ ID NO: 1033 - DNA, 213 bp, Artificial
  Substituion in SEQ ID NO 1022
atgaagttgtcgatgaagctgccgacggtaaccaagcagtggagcgttatcaggcgttatcaggagtgcaaacctgatcttgtaacaatggatttaaccatgccaaatgtagatggtattcaagcgatcaagaaaattcgggctattgaccctgacgccaaaccgtttcaaattgaccgagtaataagcgctattgacaaagccctgaattga

SEQ ID NO: 1034 - DNA, 213 bp, Artificial
  Substituion in SEQ ID NO 1022
atgaagttgtcgatgaagctgccgacggtaaccaagcagtggagcgttatcaggaaatatcaggagtgcaaacctgatcttgtaacaatggatttaaccatgccaaatgtagatggtattcaagcgatcaagaaaattcgggctattgaccctgacgccaaaccgtttcaaattgaccgagtaataagcgctgtcgacaaagccctgaattga

SEQ ID NO: 1035 - DNA, 213 bp, Artificial
  Substituion in SEQ ID NO 1022
atgaagttgtcgatgaagctgccgacggtaaccaagcagtggagcgttatcaaacgttatcaggagtgcaaacctgatcttgtaacaatggatttaaccatgccaaatgtagatggtattcaagcgatcaagaaaattcgggctattgaccctgacgccaaaccgtttcaaattgaccgagtaataagcgctgtcgacaaagccctgaattga

SEQ ID NO: 1036 - DNA, 213 bp, Artificial
  Substituion in SEQ ID NO 1022
atgaagttgtcgatgaagctgccgacgattaccaagcagtggagcgttatcaggcgttatcaggagtgcaaacctgatcttgtaacaatggatttaaccatgccaaatgtagatggtattcaagcgatcaagaaaattcgggctattgaccctgacgccaaaccgtttcaaattgaccgagtaataagcgctgtcgacaaagccctgaattga

SEQ ID NO: 1037 - DNA, 213 bp, Artificial
  Substituion in SEQ ID NO 1022
atgaagttgtcgatgaagctgccgacggtaaccaagcagtggagcgttatcaggcgttatcaggagtgcaaacctgatcttgtaacaatggatttaaccatgccaaatgtagatggtattcaagcgttaaagaaaattcgggctattgaccctgacgccaaaccgtttcaaattgaccgagtaataagcgctgtcgacaaagccctgaattga

SEQ ID NO: 1038 - protein, 384 aa, Alicyclobacillus acidocaldarius
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAVRAFHVDEKVSEYEALYREVMAAERGEHAHPRPGA

SEQ ID NO: 1039 - DNA, 1155 bp, Alicyclobacillus acidocaldarius
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccgtgcgagcgtttcatgtggatgagaaggtcagcgagtacgaggctttgtatcgcgaggtgatggcggctgaacgcggcgagcatgcgcatccccgccccggcgcgtga

SEQ ID NO: 1040 - protein, 370 aa, Paenibacillus larvae subsp. larvae BRL-230010
LKIGITCYPSLGGSGVVATELGKLLAEQGHEVHFIAHSMPFRLGRFDKNVFYHEVEVSDYYVFKYPPYDLSLASKLAQVARMQELDLLHVHYAIPHAVCALLAKQMVGDHLKVVTTLHGTDITVLAQDASISNMIRFAINESDAVTAVSEDLIRETRQTLDIQKPIHKIYNFVDKRMYYPRPVEDLKREVTRPGEKLFIHISNFRPVKRVHDVVQIFARVHREIPSRLLLVGEGLELSRIVSEVRELGLQDFVEFWGKQDDVAQVISLADVMLLPSEKESFGLVALEAMACGVPTVGSNAGGIPELITHGETGFMAEVGDVDTMSKYTIRLLEDEELLKRVSEACVQRARKKFCNDSLRARYEQVYYEVL

SEQ ID NO: 1041 - protein, 374 aa, Bacillus pumilus SAFR-032
LKVGITCYPSVGGSGIIATELGKRLAEKGHDVHFITSSIPFRLNKVYPNIYFHEVDVNQYAVFQYPPYDLALASKLAEVARREKLDIIHAHYAVPHAVCAYLAKQMTGHSVKVVTTLHGTDITVLGYDPSLKEVIRFAIESSDRVTAVSHSLAAQTYDLIKPNKKIETIHNFVDERVYLRDDHNVLKRHYGLLDHEKVVIHVSNFRKVKRVHDVIHVFKKISEQVNAKLLLIGDGPEKSVVCELVKKLGLTDRVLFLGKQEKVEELYSISDLKLLLSEKESFGLVLLEAMACGVPCIGTDVGGIPEVITHGETGFLVPLGDIDAAAKHAVSILKDKALHEQVSAAAQSSVQAHFSSEKIVSEYEELYLELIEGD

SEQ ID NO: 1042 - protein, 371 aa, Bacillus sp. NRRL B-14911
LKIGITCYPTVGGSGVVATELGKLLAERGHEIHFISSSLPFRLNRMYHNIFYHQVEVSQYSVFQYPPYDIALASKMAEVINREKLDLMHVHYAVPHAVCAILAKQMSGRDVKIATTLHGTDITVLGYEPSLKDSIRFGIEKSDRVTAVSKSLISQTNELIHPEKEIQAVYNFIDHRVYQKTGSDHLKKEYGITEDEKTVIHVSNFRAVKRVQDVVKVFARIESEMPAKLLLVGDGPEMSNVCKLVKELGLKEKVLFLGKQDKVEELYSISDLMLLLSEKESFGLVALEAMACGVPCIGTNIGGIPEVISDGETGYICKLGDIGSMAEKAAGLLADADKHTSFSHRAVQTAREKFSAEQIVSEYERLYFDML

SEQ ID NO: 1043 - protein, 375 aa, Bacillus cereus ATCC 14579
LKIGITCYPSVGGSGVVGTELGKQLAERGHEIHFITSGLPFRLNKVYPNIYFHEVTVNQYSVFQYPPYDLALASKMAEVAQRENLDILHVHYAIPHAICAYLAKQMIGERIKIVTTLHGTDITVLGSDPSLNNLIRFGIEQSDVVTAVSHSLINETHELVKPSKEIQTVYNFIDERVYFKRNMSQLKKEYGISESEKVLIHISNFRKVKRVQDVVQAFAKIVKEVDAKLLLVGDGPEFCTILQIVKNLHIEDRVLFLGKQDNVAELLAMSDLMLLLSEKESFGLVLLEAMACGVPCIGTRVGGIPEVIQHGETGYLCEVGDTTGVANQAIQLLKDEELHRNMGERARESVYEQFRSEKIVSQYETIYYDVLRDDK

SEQ ID NO: 1044 - protein, 375 aa, Bacillus anthracis str. Ames
LKIGITCYPSVGGSGVVGTELGKQLAERGHEIHFITSGLPFRLNKVYPNIYFHEVTVNQYSVFQYPPYDLALASKMAEVAQRENLDILHVHYAIPHAICAYLAKQMIGERIKIVTTLHGTDITVLGSDPSLNNLIRFGIEQSDVVTAVSHSLINETHELVKPNKDIQTVYNFIDERVYFKRDMTQLKKEYGISESEKILIHISNFRKVKRVQDVVQAFAKIVTEVDAKLLLVGDGPEFCTILQLVKNLHIEDRVLFLGKQDNVAELLAMSDLMLLLSEKESFGLVLLEAMACGVPCIGTRVGGIPEVIQHGDTGYLCEVGDTTGVADQAIQLLKDEELHRNMGERARESVYEQFRSEKIVSQYETIYYDVLRDDK

SEQ ID NO: 1045 - protein, 384 aa, Artificial
  Substituion in SEQ ID NO 1038
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAVRAFHVDEKVSEYEALYREVMAAERGDHAHPRPGA

SEQ ID NO: 1046 - protein, 384 aa, Artificial
  Substituion in SEQ ID NO 1038
MRVGISCYPTVGGSGAVATELGKALARRGHDVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAVRAFHVDEKVSEYEALYREVMAAERGEHAHPRPGA

SEQ ID NO: 1047 - protein, 384 aa, Artificial
  Substituion in SEQ ID NO 1038
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGELKRHFAPNGERVLLHISNFRPVKRLHDVLAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAVRAFHVDEKVSEYEALYREVMAAERGEHAHPRPGA

SEQ ID NO: 1048 - protein, 384 aa, Artificial
  Substituion in SEQ ID NO 1038
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAVKAFHVDEKVSEYEALYREVMAAERGEHAHPRPGA

SEQ ID NO: 1049 - protein, 384 aa, Artificial
  Substituion in SEQ ID NO 1038
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARDRAVRAFHVDEKVSEYEALYREVMAAERGEHAHPRPGA

SEQ ID NO: 1050 - DNA, 1155 bp, Artificial
  Substituion in SEQ ID NO 1039
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccgtgcgagcgtttcatgtggatgagaaggtcagcgagtacgaggctttgtatcgcgaggtgatggcggctgaacgcggcgatcatgcgcatccccgccccggcgcgtga

SEQ ID NO: 1051 - DNA, 1155 bp, Artificial
  Substituion in SEQ ID NO 1039
ttgcgcgtgggtatcagctgttatccgacggtgggcggatccggagcggtggccaccgagcttggcaaggcgctcgcgcggcggggacacgatgtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccgtgcgagcgtttcatgtggatgagaaggtcagcgagtacgaggctttgtatcgcgaggtgatggcggctgaacgcggcgagcatgcgcatccccgccccggcgcgtga

SEQ ID NO: 1052 - DNA, 1155 bp, Artificial
  Substituion in SEQ ID NO 1039
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgttagccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccgtgcgagcgtttcatgtggatgagaaggtcagcgagtacgaggctttgtatcgcgaggtgatggcggctgaacgcggcgagcatgcgcatccccgccccggcgcgtga

SEQ ID NO: 1053 - DNA, 1155 bp, Artificial
  Substituion in SEQ ID NO 1039
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccgtgaaagcgtttcatgtggatgagaaggtcagcgagtacgaggctttgtatcgcgaggtgatggcggctgaacgcggcgagcatgcgcatccccgccccggcgcgtga

SEQ ID NO: 1054 - DNA, 1155 bp, Artificial
  Substituion in SEQ ID NO 1039
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgatcgagccgtgcgagcgtttcatgtggatgagaaggtcagcgagtacgaggctttgtatcgcgaggtgatggcggctgaacgcggcgagcatgcgcatccccgccccggcgcgtga

SEQ ID NO: 1055 - protein, 248 aa, Alicyclobacillus acidocaldarius
MGQQDGGKLSPLWHACGITVPDDKSTGGVAHVEVPSQGYTEEECYRRLRDAIIDGTLMPSQRLVEMDLARWLGASRATIRTVLARLEQEGLVERERYRGARVRHVSHEEAVEILEVRMALECLIARYAALRATDEDVRRLEDIISWMRRQYEGNDLLSYSDGNARLHRTIAEISRHNTAKRLLDTLNSQSVRYQYRTILAPNRSAASMQEHERIVDAIRRRDPDSAEQAMRVHLSQVCDTLRSMRQGF

SEQ ID NO: 1056 - DNA, 747 bp, Alicyclobacillus acidocaldarius
gtggggcaacaagacggtggaaagctttcaccactatggcacgcctgtggtataactgttccagatgacaagtcgaccggaggcgttgcccacgtggaagtcccaagtcagggttataccgaagaggagtgttacaggcgcctgcgcgacgccatcatcgacggtacgctgatgccgtctcagcggctcgtggaaatggatctcgcgcgctggctgggcgcgagccgagctaccattcgcactgtcctcgcccgcctggaacaggagggcttggtggaacgcgagcggtaccgcggtgcccgcgttcgccacgtctcccacgaggaagcggtggagatcctggaggtccgcatggcgctcgaatgcctgatcgcgcggtacgctgcgctccgggcgacggacgaagacgtgcggcggctggaagacatcatctcctggatgcggcgccagtacgaggggaacgacttgctctcgtactccgacggcaacgcgagactccatcggaccatcgccgagatctctcggcacaacaccgccaagcgattgctcgacacgctcaattctcaaagcgttcgataccagtaccgcaccatcttggcgccgaatcgatcggctgcctccatgcaagagcacgagcgaatcgtggacgcgattcgccgacgcgatccggactcggcggagcaggccatgcgcgttcatctaagccaagtctgcgacacgctccgcagcatgcgccagggattttag

SEQ ID NO: 1057 - protein, 205 aa, Rubrobacter xylanophilus DSM 9941
GSLSDVAYEKLYGDITGGRLQPNERLIELDIARELGVSRAAVRNALIRLEQEGLVKREPNRGARVRLVSEEEAVEILEARMALECVAVRHAALNRTQEDIAGLREILSQMESRLEAGDLLGASDLNGQFHRRLVEISNHATISKLLKMLNSQLIRFQYRTILTPGRPASSLAEHRAIFEAVEAGDPERAEQAMRRHLSGVTEALR

SEQ ID NO: 1058 - protein, 209 aa, Streptomyces avermitilis MA-4680
PSTGEQAKQHALTQLRQAILHGEMAPAQRLVENELAEQFGVTRASIRAALIDLAAEGLVERIRNRGSRVRVVTVEEAVAITECRMVLEGLCAAKAAVAASDEQLTELADLGAAMTKAVADGEPVTYSELNHELHDRIREFSGQQTAVELLERLNAQLVRHRFQLALRPGRPQHSLNEHLSMIEAIRDRDPQAAEVAVRAHLTSVIEALR

SEQ ID NO: 1059 - protein, 196 aa, Streptomyces ambofaciens ATCC 23877
QLRQAILRGDMAPAQRLVENELAEQFGVTRASIRAALIDLESQGLVERIRNRGSRVRVVTVEEAVAITECRLVLEGLCAAKAASAVDDGQLGELKDLGTAMRKAVADGEPLVYSDLNHELHARIREFSGQRTAVELLERLNAQLVRHRFQLALRPGRPQQSLNEHLAMIEAIEARDPQAAEAAVRAHLTSVIEALR

SEQ ID NO: 1060 - protein, 210 aa, Metallosphaera sedula DSM 5348
TRGKKSDYIYERLKTDIQRGKFLPGQRLVEDALAKEYGSSRNTIRLALTRLENDGIVKRTTSGVIVSFIDLKEAVEILEVREVIEGFLARKAATRISEESLQRLESTLMEMKTALENREFLRYSQLNERFHSIIYEASGNTTAQLLLSTLKLKMIRYQFRTVMVPGRAEVSWNEHFRIFQALKNHDENEAELWARTHVKNVRELIQNNKE

SEQ ID NO: 1061 - protein, 203 aa, Syntrophomonas wolfei subsp. wolfei str. Goettingen
VDLDSYKPLRELVLEAIREAIKNGVLKPRERLMEIQLAEELGVSRTPIREALRKLELEGFIVMVPRKGAYVADISLKDVADVFEIRAALEALAAGLAAERITDEELEAMERLLVEKVEAISSNDMDKLVDVDTKFHEAIYRASRNQRLFAIINNLREQIQRFRSTSLSYPGRMQQSMQEHRDIVEAIQSRDIQLSRQLAQEHI

SEQ ID NO: 1062 - protein, 248 aa, Artificial
  Substituion in SEQ ID NO 1055
MGQQDGGKLSPLWHACGITVPDDKSTGGVAHVEVPSQGYTEEECYRRLRDAIIDGTLMPSQRLVEMDLARWLGASRATIRTVLARLEQEGLVERERYRGARVRHVSHEEAVEILEVRMALECLIARYAALRATDEDVRRLEDIISWMRRQYEGNDLLSYSDGNARLHRTIAEISRHNTAKRLLDTLNSQSVRYQYRTILAPNRSAASMQEHERIVDALRRRDPDSAEQAMRVHLSQVCDTLRSMRQGF

SEQ ID NO: 1063 - protein, 248 aa, Artificial
  Substituion in SEQ ID NO 1055
MGQQDGGKLSPLWHACGITVPDDKSTGGVAHVEVPSQGYTEEECYRRLRDAIIDGTLMPSQRLVEMDLARWLGASRATIRTVLARLEQEGLVERERYRGARVRHVSHEEAVEILEVRMALECLIARYAALRATDEDVRRLEDIISWMRRQYEGNDLISYSDGNARLHRTIAEISRHNTAKRLLDTLNSQSVRYQYRTILAPNRSAASMQEHERIVDAIRRRDPDSAEQAMRVHLSQVCDTLRSMRQGF

SEQ ID NO: 1064 - protein, 248 aa, Artificial
  Substituion in SEQ ID NO 1055
MGQQDGGKLSPLWHACGITVPDDKSTGGVAHVEVPSQGYTEEECYRRLRDAIIDGTLMPSQRLVEMDLARWLGASRATIRTVLARLEQEGLVEREKYRGARVRHVSHEEAVEILEVRMALECLIARYAALRATDEDVRRLEDIISWMRRQYEGNDLLSYSDGNARLHRTIAEISRHNTAKRLLDTLNSQSVRYQYRTILAPNRSAASMQEHERIVDAIRRRDPDSAEQAMRVHLSQVCDTLRSMRQGF

SEQ ID NO: 1065 - protein, 248 aa, Artificial
  Substituion in SEQ ID NO 1055
MGQQDGGKLSPLWHACGITVPDDKSTGGVAHVEVPSQGYTEEECYRRLRDAIIDGTLMPSQRLVEMDLARWLGASRATIRTVLARLEQEGLVERERYRGARVRHVSHEEAVEILEVRMALECLIARYAALRATDEDVRRLEDIISWMRRQYEGNDLLSYSDGNARLHRTIAEISRHNTAKRLLDTLNSQSVRYQYRTILAPNRSAASMQEHERIVDAIRKRDPDSAEQAMRVHLSQVCDTLRSMRQGF

SEQ ID NO: 1066 - protein, 248 aa, Artificial
  Substituion in SEQ ID NO 1055
MGQQDGGKLSPLWHACGITVPDDKSTGGVAHVEVPSQGYTEEECYRRLRDAIIDGTLMPSQRLVEMDLARWLGASRATIRTVLARLEQEGLVERERYRGARVRHVSHEEAVEILEVRMALECLIARYAALRATDEDVRRLEDIISWMRRQYEGNDLLSYSDGNARLHRTIAEISRHNTAKRILDTLNSQSVRYQYRTILAPNRSAASMQEHERIVDAIRRRDPDSAEQAMRVHLSQVCDTLRSMRQGF

SEQ ID NO: 1067 - DNA, 747 bp, Artificial
  Substituion in SEQ ID NO 1056
gtggggcaacaagacggtggaaagctttcaccactatggcacgcctgtggtataactgttccagatgacaagtcgaccggaggcgttgcccacgtggaagtcccaagtcagggttataccgaagaggagtgttacaggcgcctgcgcgacgccatcatcgacggtacgctgatgccgtctcagcggctcgtggaaatggatctcgcgcgctggctgggcgcgagccgagctaccattcgcactgtcctcgcccgcctggaacaggagggcttggtggaacgcgagcggtaccgcggtgcccgcgttcgccacgtctcccacgaggaagcggtggagatcctggaggtccgcatggcgctcgaatgcctgatcgcgcggtacgctgcgctccgggcgacggacgaagacgtgcggcggctggaagacatcatctcctggatgcggcgccagtacgaggggaacgacttgctctcgtactccgacggcaacgcgagactccatcggaccatcgccgagatctctcggcacaacaccgccaagcgattgctcgacacgctcaattctcaaagcgttcgataccagtaccgcaccatcttggcgccgaatcgatcggctgcctccatgcaagagcacgagcgaatcgtggacgcgttacgccgacgcgatccggactcggcggagcaggccatgcgcgttcatctaagccaagtctgcgacacgctccgcagcatgcgccagggattttag

SEQ ID NO: 1068 - DNA, 747 bp, Artificial
  Substituion in SEQ ID NO 1056
gtggggcaacaagacggtggaaagctttcaccactatggcacgcctgtggtataactgttccagatgacaagtcgaccggaggcgttgcccacgtggaagtcccaagtcagggttataccgaagaggagtgttacaggcgcctgcgcgacgccatcatcgacggtacgctgatgccgtctcagcggctcgtggaaatggatctcgcgcgctggctgggcgcgagccgagctaccattcgcactgtcctcgcccgcctggaacaggagggcttggtggaacgcgagcggtaccgcggtgcccgcgttcgccacgtctcccacgaggaagcggtggagatcctggaggtccgcatggcgctcgaatgcctgatcgcgcggtacgctgcgctccgggcgacggacgaagacgtgcggcggctggaagacatcatctcctggatgcggcgccagtacgaggggaacgacttgatttcgtactccgacggcaacgcgagactccatcggaccatcgccgagatctctcggcacaacaccgccaagcgattgctcgacacgctcaattctcaaagcgttcgataccagtaccgcaccatcttggcgccgaatcgatcggctgcctccatgcaagagcacgagcgaatcgtggacgcgattcgccgacgcgatccggactcggcggagcaggccatgcgcgttcatctaagccaagtctgcgacacgctccgcagcatgcgccagggattttag

SEQ ID NO: 1069 - DNA, 747 bp, Artificial
  Substituion in SEQ ID NO 1056
gtggggcaacaagacggtggaaagctttcaccactatggcacgcctgtggtataactgttccagatgacaagtcgaccggaggcgttgcccacgtggaagtcccaagtcagggttataccgaagaggagtgttacaggcgcctgcgcgacgccatcatcgacggtacgctgatgccgtctcagcggctcgtggaaatggatctcgcgcgctggctgggcgcgagccgagctaccattcgcactgtcctcgcccgcctggaacaggagggcttggtggaacgcgagaaataccgcggtgcccgcgttcgccacgtctcccacgaggaagcggtggagatcctggaggtccgcatggcgctcgaatgcctgatcgcgcggtacgctgcgctccgggcgacggacgaagacgtgcggcggctggaagacatcatctcctggatgcggcgccagtacgaggggaacgacttgctctcgtactccgacggcaacgcgagactccatcggaccatcgccgagatctctcggcacaacaccgccaagcgattgctcgacacgctcaattctcaaagcgttcgataccagtaccgcaccatcttggcgccgaatcgatcggctgcctccatgcaagagcacgagcgaatcgtggacgcgattcgccgacgcgatccggactcggcggagcaggccatgcgcgttcatctaagccaagtctgcgacacgctccgcagcatgcgccagggattttag

SEQ ID NO: 1070 - DNA, 747 bp, Artificial
  Substituion in SEQ ID NO 1056
gtggggcaacaagacggtggaaagctttcaccactatggcacgcctgtggtataactgttccagatgacaagtcgaccggaggcgttgcccacgtggaagtcccaagtcagggttataccgaagaggagtgttacaggcgcctgcgcgacgccatcatcgacggtacgctgatgccgtctcagcggctcgtggaaatggatctcgcgcgctggctgggcgcgagccgagctaccattcgcactgtcctcgcccgcctggaacaggagggcttggtggaacgcgagcggtaccgcggtgcccgcgttcgccacgtctcccacgaggaagcggtggagatcctggaggtccgcatggcgctcgaatgcctgatcgcgcggtacgctgcgctccgggcgacggacgaagacgtgcggcggctggaagacatcatctcctggatgcggcgccagtacgaggggaacgacttgctctcgtactccgacggcaacgcgagactccatcggaccatcgccgagatctctcggcacaacaccgccaagcgattgctcgacacgctcaattctcaaagcgttcgataccagtaccgcaccatcttggcgccgaatcgatcggctgcctccatgcaagagcacgagcgaatcgtggacgcgattcgcaaacgcgatccggactcggcggagcaggccatgcgcgttcatctaagccaagtctgcgacacgctccgcagcatgcgccagggattttag

SEQ ID NO: 1071 - DNA, 747 bp, Artificial
  Substituion in SEQ ID NO 1056
gtggggcaacaagacggtggaaagctttcaccactatggcacgcctgtggtataactgttccagatgacaagtcgaccggaggcgttgcccacgtggaagtcccaagtcagggttataccgaagaggagtgttacaggcgcctgcgcgacgccatcatcgacggtacgctgatgccgtctcagcggctcgtggaaatggatctcgcgcgctggctgggcgcgagccgagctaccattcgcactgtcctcgcccgcctggaacaggagggcttggtggaacgcgagcggtaccgcggtgcccgcgttcgccacgtctcccacgaggaagcggtggagatcctggaggtccgcatggcgctcgaatgcctgatcgcgcggtacgctgcgctccgggcgacggacgaagacgtgcggcggctggaagacatcatctcctggatgcggcgccagtacgaggggaacgacttgctctcgtactccgacggcaacgcgagactccatcggaccatcgccgagatctctcggcacaacaccgccaagcgaattctcgacacgctcaattctcaaagcgttcgataccagtaccgcaccatcttggcgccgaatcgatcggctgcctccatgcaagagcacgagcgaatcgtggacgcgattcgccgacgcgatccggactcggcggagcaggccatgcgcgttcatctaagccaagtctgcgacacgctccgcagcatgcgccagggattttag

SEQ ID NO: 1072 - protein, 198 aa, Alicyclobacillus acidocaldarius
MTSGLAEKRREKYEAILKAALKMFAEHGFFNSQVSKIAREAGVADGTIYLYFKNKEDILISLFREKLGSLVRKFHEHVHEDDRADEAIRKICELHFTELEKDVQLAKVTQLELRQSSRELHSEISKALKPYIQLIEDVLVRGIEQGIFRRDLDVKLTRLLIFGAMDEVVSSWLISGRRYSLSAQVDKTVDFFLRGLRA

SEQ ID NO: 1073 - DNA, 597 bp, Alicyclobacillus acidocaldarius
atgacaagtggattggcggagaaaaggagagaaaagtacgaggcaatcctcaaagcggcgctgaaaatgtttgcggaacacggtttcttcaattcgcaggtgtccaaaattgcccgcgaggcgggcgtagcggacgggaccatttatctgtactttaaaaacaaggaggacatcttgatctccttgtttcgggagaagctcggcagtctcgtgcgcaagttccacgagcacgtgcacgaggacgatcgcgcggacgaagccatccgcaagatctgcgagcttcatttcaccgaactcgagaaggatgttcaactcgccaaagtcacgcagcttgagctccgccagagttcgcgcgaattgcacagcgagatcagcaaggcgctgaaaccttatattcagctgattgaggacgtgctggtgcgggggatcgaacaaggcatcttccgccgcgacttggacgtgaagctcacgcggttgttgatctttggcgccatggacgaggtggtatcgtcctggctcatctcgggcaggcggtattccctgtcggcccaagtcgacaaaaccgtcgacttctttctccgaggtcttcgcgcctga

SEQ ID NO: 1074 - protein, 192 aa, Paenibacillus larvae subsp. larvae BRL-230010
MTSKKREKYQLILDAALKVFAEHGFHRSQVSKIAKAAGVADGTIYLYFKRKEDILISLFREKLGELVSKFNQSIETSTDMKQALYHICRIHYTELEQDVDLAFVTQIELRQSSLELRREIGKAVKPYIVLIEQLLLKGIEEEVFRPDLDVKLTRSLIFGAMDEVVTSWLVSGRKYSLSDQVEGTVQFFLRGI

SEQ ID NO: 1075 - protein, 191 aa, Geobacillus thermodenitrificans NG80-2
REKPKFKQIIDAAVVVIAEHGYHQAQVSKIAKQAGVADGTIYLYFKNKEDILISLFQEKMGSFIEKIEQEIEGISSPLEKLYVLVRTHFSALADDPHMAVVTQLELRQSNKELRQRINEVLKGYLRLIDSIIIEGMEKGEFRNDLDVRLTRQMIFGTIDETVTTWVMNEQKYDLAALAEPVYELLAKGCAA

SEQ ID NO: 1076 - protein, 191 aa, Geobacillus kaustophilus HTA426
REKPKFKQIIDAAVVVIAEHGYHQAQVSKIAKQAGVADGTIYLYFKNKEDILISLFQEKMGAFIEKIEQETEGISSPLEKLYVLVKTHFSALAADPHMAVVTQLELRQSNKELRHRINEVLKGYLRLIDRIIMEGMEKGEFRQDLDVRLTRQMIFGTLDETVTTWVMNEQKYDLAALADPVYELLVKGCAA

SEQ ID NO: 1077 - protein, 193 aa, Bacillus halodurans C-125
MGKKKGPKYDQIIDAAVQVIAEHGYHQAQVSKIAKAAGVADGTIYLYFNNKEDVLISLFQEKMGRFVDKIRSQMNEATDVEEKLKILVNMHFKQLAADHKLAIVTQLELRQSNTELRLKINEVLKGYLNLLDELLMEGKEKGYFFQELDTRLARQMIFGTLDEVVTNWVMKDCKYDLTALVKPVHQLLLGGLR

SEQ ID NO: 1078 - protein, 192 aa, Carboxydothermus hydrogenoformans Z-2901
MAKKSIDKYEAILDAAAKIIGEVGYHKAQISKIAREANVAEGTIYLYFKNKQDLLLSLFQKRYGEFISNLKVEIAAAKTPLDKLKKLITMHLENSEKDRNFAQVTQIELRQADRDLRQKLSELLKDYFYIIESVIEEGKEQGIFRKDISTKVIRRMIFGTLDETVSSWLLSSRRYSLAKLSDDVFQLFCYGI

SEQ ID NO: 1079 - protein, 198 aa, Artificial
  Substituion in SEQ ID NO 1072
MTSGLAEKRREKYEAILKAALKMFAEHGFFNSQVSKIAREAGVADGTIYLYFKNKEDILISLFREKLGSLVRKFHEHVHEDDRADEAIKKICELHFTELEKDVQLAKVTQLELRQSSRELHSEISKALKPYIQLIEDVLVRGIEQGIFRRDLDVKLTRLLIFGAMDEVVSSWLISGRRYSLSAQVDKTVDFFLRGLRA

SEQ ID NO: 1080 - protein, 198 aa, Artificial
  Substituion in SEQ ID NO 1072
MTSGLAEKRREKYDAILKAALKMFAEHGFFNSQVSKIAREAGVADGTIYLYFKNKEDILISLFREKLGSLVRKFHEHVHEDDRADEAIRKICELHFTELEKDVQLAKVTQLELRQSSRELHSEISKALKPYIQLIEDVLVRGIEQGIFRRDLDVKLTRLLIFGAMDEVVSSWLISGRRYSLSAQVDKTVDFFLRGLRA

SEQ ID NO: 1081 - protein, 198 aa, Artificial
  Substituion in SEQ ID NO 1072
MTSGLAEKRREKYEAILKAALKMFAEHGFFNSQVSKIAREAGVADGTIYLYFKNKEDILISLFREKLGSLVRKFHEHVHEDDRADEAIRKICELHFTELEKDVQLAKVTQLELRQSSKELHSEISKALKPYIQLIEDVLVRGIEQGIFRRDLDVKLTRLLIFGAMDEVVSSWLISGRRYSLSAQVDKTVDFFLRGLRA

SEQ ID NO: 1082 - protein, 198 aa, Artificial
  Substituion in SEQ ID NO 1072
MTSGLAEKRREKYEAILKAALKMFAEHGFFNSQVSKIAREAGVADGTIYLYFKNKEDILISLFREKLGSLVRKFHEHVHEDDRADEAIRKICELHFTELEKDVQLAKVTQLELRQSSRELHSEISKALKPYIQLIEDVLVRGIEQGIFRRDLDVKLTRLLIFGAMDEVVSSWLISGRRYSLSAQVDKTIDFFLRGLRA

SEQ ID NO: 1083 - protein, 198 aa, Artificial
  Substituion in SEQ ID NO 1072
MTSGLAEKRREKYEAILKAALKMFAEHGFFNSQVSKIAREAGVADGTIYLYFKNKEDILISLFREKLGSLVRKFHEHVHEDDRADEAIRKICELHFTELEKDVQLAKVTQLELRQSSRELHSEISKALKPYIQLIEDVLVRGIEQGIFRRDLDVKLTRLLIFGAMDEVVSSWLISGRRYSLSAQVDKTVEFFLRGLRA

SEQ ID NO: 1084 - DNA, 597 bp, Artificial
  Substituion in SEQ ID NO 1073
atgacaagtggattggcggagaaaaggagagaaaagtacgaggcaatcctcaaagcggcgctgaaaatgtttgcggaacacggtttcttcaattcgcaggtgtccaaaattgcccgcgaggcgggcgtagcggacgggaccatttatctgtactttaaaaacaaggaggacatcttgatctccttgtttcgggagaagctcggcagtctcgtgcgcaagttccacgagcacgtgcacgaggacgatcgcgcggacgaagccatcaaaaagatctgcgagcttcatttcaccgaactcgagaaggatgttcaactcgccaaagtcacgcagcttgagctccgccagagttcgcgcgaattgcacagcgagatcagcaaggcgctgaaaccttatattcagctgattgaggacgtgctggtgcgggggatcgaacaaggcatcttccgccgcgacttggacgtgaagctcacgcggttgttgatctttggcgccatggacgaggtggtatcgtcctggctcatctcgggcaggcggtattccctgtcggcccaagtcgacaaaaccgtcgacttctttctccgaggtcttcgcgcctga

SEQ ID NO: 1085 - DNA, 597 bp, Artificial
  Substituion in SEQ ID NO 1073
atgacaagtggattggcggagaaaaggagagaaaagtacgatgcaatcctcaaagcggcgctgaaaatgtttgcggaacacggtttcttcaattcgcaggtgtccaaaattgcccgcgaggcgggcgtagcggacgggaccatttatctgtactttaaaaacaaggaggacatcttgatctccttgtttcgggagaagctcggcagtctcgtgcgcaagttccacgagcacgtgcacgaggacgatcgcgcggacgaagccatccgcaagatctgcgagcttcatttcaccgaactcgagaaggatgttcaactcgccaaagtcacgcagcttgagctccgccagagttcgcgcgaattgcacagcgagatcagcaaggcgctgaaaccttatattcagctgattgaggacgtgctggtgcgggggatcgaacaaggcatcttccgccgcgacttggacgtgaagctcacgcggttgttgatctttggcgccatggacgaggtggtatcgtcctggctcatctcgggcaggcggtattccctgtcggcccaagtcgacaaaaccgtcgacttctttctccgaggtcttcgcgcctga

SEQ ID NO: 1086 - DNA, 597 bp, Artificial
  Substituion in SEQ ID NO 1073
atgacaagtggattggcggagaaaaggagagaaaagtacgaggcaatcctcaaagcggcgctgaaaatgtttgcggaacacggtttcttcaattcgcaggtgtccaaaattgcccgcgaggcgggcgtagcggacgggaccatttatctgtactttaaaaacaaggaggacatcttgatctccttgtttcgggagaagctcggcagtctcgtgcgcaagttccacgagcacgtgcacgaggacgatcgcgcggacgaagccatccgcaagatctgcgagcttcatttcaccgaactcgagaaggatgttcaactcgccaaagtcacgcagcttgagctccgccagagttcgaaagaattgcacagcgagatcagcaaggcgctgaaaccttatattcagctgattgaggacgtgctggtgcgggggatcgaacaaggcatcttccgccgcgacttggacgtgaagctcacgcggttgttgatctttggcgccatggacgaggtggtatcgtcctggctcatctcgggcaggcggtattccctgtcggcccaagtcgacaaaaccgtcgacttctttctccgaggtcttcgcgcctga

SEQ ID NO: 1087 - DNA, 597 bp, Artificial
  Substituion in SEQ ID NO 1073
atgacaagtggattggcggagaaaaggagagaaaagtacgaggcaatcctcaaagcggcgctgaaaatgtttgcggaacacggtttcttcaattcgcaggtgtccaaaattgcccgcgaggcgggcgtagcggacgggaccatttatctgtactttaaaaacaaggaggacatcttgatctccttgtttcgggagaagctcggcagtctcgtgcgcaagttccacgagcacgtgcacgaggacgatcgcgcggacgaagccatccgcaagatctgcgagcttcatttcaccgaactcgagaaggatgttcaactcgccaaagtcacgcagcttgagctccgccagagttcgcgcgaattgcacagcgagatcagcaaggcgctgaaaccttatattcagctgattgaggacgtgctggtgcgggggatcgaacaaggcatcttccgccgcgacttggacgtgaagctcacgcggttgttgatctttggcgccatggacgaggtggtatcgtcctggctcatctcgggcaggcggtattccctgtcggcccaagtcgacaaaaccattgacttctttctccgaggtcttcgcgcctga

SEQ ID NO: 1088 - DNA, 597 bp, Artificial
  Substituion in SEQ ID NO 1073
atgacaagtggattggcggagaaaaggagagaaaagtacgaggcaatcctcaaagcggcgctgaaaatgtttgcggaacacggtttcttcaattcgcaggtgtccaaaattgcccgcgaggcgggcgtagcggacgggaccatttatctgtactttaaaaacaaggaggacatcttgatctccttgtttcgggagaagctcggcagtctcgtgcgcaagttccacgagcacgtgcacgaggacgatcgcgcggacgaagccatccgcaagatctgcgagcttcatttcaccgaactcgagaaggatgttcaactcgccaaagtcacgcagcttgagctccgccagagttcgcgcgaattgcacagcgagatcagcaaggcgctgaaaccttatattcagctgattgaggacgtgctggtgcgggggatcgaacaaggcatcttccgccgcgacttggacgtgaagctcacgcggttgttgatctttggcgccatggacgaggtggtatcgtcctggctcatctcgggcaggcggtattccctgtcggcccaagtcgacaaaaccgtcgaattctttctccgaggtcttcgcgcctga

SEQ ID NO: 1089 - protein, 210 aa, Alicyclobacillus acidocaldarius
MGPKGVGTVSGLTARQRAILEFIRKNIREKGYPPSVREIGEAVGLASSSTVHGHLERLQQKGYLRRDPTKPRALELLVDDEEPGDVVLAPIVGRVTAGLPISALEDIEGYLPLPRDVAKGDEVFALRVVGESMINAGILDGDLAIVRRQTSADNGDIVVAMTDEDEATIKRFYREDGRVRLQPENDAMSPLYFPNVTILGKVIGIFRQIR

SEQ ID NO: 1090 - DNA, 633 bp, Alicyclobacillus acidocaldarius
atgggaccgaagggagtggggacggtgagcggtcttacggctcgtcaacgcgcaattctcgagtttatccgaaaaaacatccgcgaaaaaggatatccgccatcggtgcgcgagattggagaagcggtggggttggcgtcaagctcgacggttcacgggcatctcgagcgactccaacagaagggttacttgcgtcgagatccgaccaaaccgagagcactggaactccttgtggacgacgaggagccgggggatgtcgtgctcgctcccatcgtcggtcgtgtgacagcgggacttcccatctcggcgctggaagacatcgagggatacttgcctttgccgcgcgacgtggcgaagggcgatgaagtcttcgcgctgcgcgtggtcggcgagagcatgatcaatgcgggcattctggatggcgatctcgccatcgtgcggcggcagacgtcggccgacaacggcgacatcgtcgtggccatgaccgacgaggacgaagccaccatcaagcggttttaccgggaggatggccgtgtgcgcctccaaccagaaaacgacgcgatgtctcccttgtactttccgaacgtgaccatcctcggcaaggtcatcgggatctttcggcagatccgatag

SEQ ID NO: 1091 - protein, 202 aa, Listeria welshimeri serovar 6b str. SLCC5334
ISKRQQDIYEFIKSEVKEKGYPPSVREIGEAVGLASSSTVHGHLARLEGKGLIRRDPTKPRAIEILSLEDEAETPNVVNIPIIGKVTAGMPITAIENIEEYFPLPEYMAAGETNVFMLEIDGESMINAGILDGDKVIVRQQNSAINGEIVVAMTDENEATCKRFYKEANHFRLQPENDALEPIILNNVTILGKVIGLYRDIR

SEQ ID NO: 1092 - protein, 202 aa, Listeria monocytogenes FSL J2-064
ISKRQQDIYEFIKSEVKEKGYPPSVREIGEAVGLASSSTVHGHLARLEGKGLIRRDPTKPRAIEILSLEDEAETPNVVNIPIIGKVTAGMPITAIENIDEYFPLPEYMATGETNVFMLEIDGESMINAGILDGDKVIVRQQSSAINGEIVVAMTDENEATCKRFYKEANHFRLQPENDALEPILLNNVTILGKVIGLYRDIR

SEQ ID NO: 1093 - protein, 202 aa, Listeria monocytogenes str. 4b F2365
ISKRQQDIYEFIKSEVKEKGYPPSVREIGEAVGLASSSTVHGHLARLEGKGLIRRDPTKPRAIEILSLEDEAETPNVVNIPIIGKVTAGMPITAIENIDEYFPLPEYMAAGETNVFMLEIDGESMINAGILDGDKVIVRQQSSAINGEIVVAMTDENEATCKRFYKEANHFRLQPENDALEPILLNNVTILGKVIGLYRDIR

SEQ ID NO: 1094 - protein, 201 aa, Paenibacillus larvae subsp. larvae BRL-230010
LSQRQQAILEFIKNEVKEKGYPPSVREIGEAVGLASSSTVHGHLERLEKKGLIRRDPTKPRAIEILDMDSSSTFSFSVTRVPLIGKVTAGMPITATENIEDYFPLPSHYVGDHNVFMLSVLGDSMIETGIHDGDLVIVRQQQTADNGDIVVAMTEDDEATVKRFYKEKDHIRLQPENSSMAPIILSNVSILGKVIGIFRNI

SEQ ID NO: 1095 - protein, 201 aa, Listeria innocua Clip11262
ISKRQQDIYEFIKSEVKEKGYPPSVREIGEAVGLASSSTVHGHLARLEGKGLIRRDPTKPRAIEILSLEDEAETPNVVNIPIIGKVTAGMPITAIENIEEYFPLPEYMAAGETNVFMLEIDGESMINAGILDGDKVIVRQQSSAINGEIVVAMTDENEATCKRFYKEANHFRLQPENDALEPIILNNVTILGKVIGLYRDI

SEQ ID NO: 1096 - protein, 210 aa, Artificial
  Substituion in SEQ ID NO 1089
MGPKGVGTVSGLTARQRAILEFIRKNIREKGYPPSVREIGEAVGLASSSTVHGHLDRLQQKGYLRRDPTKPRALELLVDDEEPGDVVLAPIVGRVTAGLPISALEDIEGYLPLPRDVAKGDEVFALRVVGESMINAGILDGDLAIVRRQTSADNGDIVVAMTDEDEATIKRFYREDGRVRLQPENDAMSPLYFPNVTILGKVIGIFRQIR

SEQ ID NO: 1097 - protein, 210 aa, Artificial
  Substituion in SEQ ID NO 1089
MGPKGVGTVSGLTARQRAILEFIRKNIREKGYPPSVREIGEAVGLASSSTVHGHLERLQQKGYLRRDPTKPRAIELLVDDEEPGDVVLAPIVGRVTAGLPISALEDIEGYLPLPRDVAKGDEVFALRVVGESMINAGILDGDLAIVRRQTSADNGDIVVAMTDEDEATIKRFYREDGRVRLQPENDAMSPLYFPNVTILGKVIGIFRQIR

SEQ ID NO: 1098 - protein, 210 aa, Artificial
  Substituion in SEQ ID NO 1089
MGPKGVGTVSGLTARQRAILEFIRKNIREKGYPPSVREIGEAVGLASSSTVHGHLERLQQKGYLRRDPTKPRALELLVDDEEPGDVVLAPIVGRVTAGLPISALEDIEGYLPLPRDVAKGDEVFALRVVGESMINAGILDGDLAIVRRQTSADNGDIVVAMTDEDEATIKRFYREDGKVRLQPENDAMSPLYFPNVTILGKVIGIFRQIR

SEQ ID NO: 1099 - protein, 210 aa, Artificial
  Substituion in SEQ ID NO 1089
MGPKGVGTVSGLTARQRAILEFIRKNIREKGYPPSVREIGEAVGLASSSTVHGHLERLQQKGYLRRDPTKPRALELLVDDEEPGDVVLAPIVGRVTAGLPISALEDIEGYLPLPRDVAKGDEVFALRVVGESMINAGILDGDLAIVRRQTSADNGDIVVAMTDEDEATIKRFYREDGRVRLQPENEAMSPLYFPNVTILGKVIGIFRQIR

SEQ ID NO: 1100 - protein, 210 aa, Artificial
  Substituion in SEQ ID NO 1089
MGPKGVGTVSGLTARQRAILEFIRKNIREKGYPPSVREIGEAVGLASSSTVHGHLERLQQKGYLRRDPTKPRALELLVDDEEPGDVVLAPIVGRVTAGLPISALEDIEGYLPLPRDVAKGDEVFALRVVGESMINAGILDGDLAIVRRQTSADNGDIVVAMTDEEEATIKRFYREDGRVRLQPENDAMSPLYFPNVTILGKVIGIFRQIR

SEQ ID NO: 1101 - DNA, 633 bp, Artificial
  Substituion in SEQ ID NO 1090
atgggaccgaagggagtggggacggtgagcggtcttacggctcgtcaacgcgcaattctcgagtttatccgaaaaaacatccgcgaaaaaggatatccgccatcggtgcgcgagattggagaagcggtggggttggcgtcaagctcgacggttcacgggcatctcgatcgactccaacagaagggttacttgcgtcgagatccgaccaaaccgagagcactggaactccttgtggacgacgaggagccgggggatgtcgtgctcgctcccatcgtcggtcgtgtgacagcgggacttcccatctcggcgctggaagacatcgagggatacttgcctttgccgcgcgacgtggcgaagggcgatgaagtcttcgcgctgcgcgtggtcggcgagagcatgatcaatgcgggcattctggatggcgatctcgccatcgtgcggcggcagacgtcggccgacaacggcgacatcgtcgtggccatgaccgacgaggacgaagccaccatcaagcggttttaccgggaggatggccgtgtgcgcctccaaccagaaaacgacgcgatgtctcccttgtactttccgaacgtgaccatcctcggcaaggtcatcgggatctttcggcagatccgatag

SEQ ID NO: 1102 - DNA, 633 bp, Artificial
  Substituion in SEQ ID NO 1090
atgggaccgaagggagtggggacggtgagcggtcttacggctcgtcaacgcgcaattctcgagtttatccgaaaaaacatccgcgaaaaaggatatccgccatcggtgcgcgagattggagaagcggtggggttggcgtcaagctcgacggttcacgggcatctcgagcgactccaacagaagggttacttgcgtcgagatccgaccaaaccgagagcaattgaactccttgtggacgacgaggagccgggggatgtcgtgctcgctcccatcgtcggtcgtgtgacagcgggacttcccatctcggcgctggaagacatcgagggatacttgcctttgccgcgcgacgtggcgaagggcgatgaagtcttcgcgctgcgcgtggtcggcgagagcatgatcaatgcgggcattctggatggcgatctcgccatcgtgcggcggcagacgtcggccgacaacggcgacatcgtcgtggccatgaccgacgaggacgaagccaccatcaagcggttttaccgggaggatggccgtgtgcgcctccaaccagaaaacgacgcgatgtctcccttgtactttccgaacgtgaccatcctcggcaaggtcatcgggatctttcggcagatccgatag

SEQ ID NO: 1103 - DNA, 633 bp, Artificial
  Substituion in SEQ ID NO 1090
atgggaccgaagggagtggggacggtgagcggtcttacggctcgtcaacgcgcaattctcgagtttatccgaaaaaacatccgcgaaaaaggatatccgccatcggtgcgcgagattggagaagcggtggggttggcgtcaagctcgacggttcacgggcatctcgagcgactccaacagaagggttacttgcgtcgagatccgaccaaaccgagagcactggaactccttgtggacgacgaggagccgggggatgtcgtgctcgctcccatcgtcggtcgtgtgacagcgggacttcccatctcggcgctggaagacatcgagggatacttgcctttgccgcgcgacgtggcgaagggcgatgaagtcttcgcgctgcgcgtggtcggcgagagcatgatcaatgcgggcattctggatggcgatctcgccatcgtgcggcggcagacgtcggccgacaacggcgacatcgtcgtggccatgaccgacgaggacgaagccaccatcaagcggttttaccgggaggatggcaaagtgcgcctccaaccagaaaacgacgcgatgtctcccttgtactttccgaacgtgaccatcctcggcaaggtcatcgggatctttcggcagatccgatag

SEQ ID NO: 1104 - DNA, 633 bp, Artificial
  Substituion in SEQ ID NO 1090
atgggaccgaagggagtggggacggtgagcggtcttacggctcgtcaacgcgcaattctcgagtttatccgaaaaaacatccgcgaaaaaggatatccgccatcggtgcgcgagattggagaagcggtggggttggcgtcaagctcgacggttcacgggcatctcgagcgactccaacagaagggttacttgcgtcgagatccgaccaaaccgagagcactggaactccttgtggacgacgaggagccgggggatgtcgtgctcgctcccatcgtcggtcgtgtgacagcgggacttcccatctcggcgctggaagacatcgagggatacttgcctttgccgcgcgacgtggcgaagggcgatgaagtcttcgcgctgcgcgtggtcggcgagagcatgatcaatgcgggcattctggatggcgatctcgccatcgtgcggcggcagacgtcggccgacaacggcgacatcgtcgtggccatgaccgacgaggacgaagccaccatcaagcggttttaccgggaggatggccgtgtgcgcctccaaccagaaaacgaagcgatgtctcccttgtactttccgaacgtgaccatcctcggcaaggtcatcgggatctttcggcagatccgatag

SEQ ID NO: 1105 - DNA, 633 bp, Artificial
  Substituion in SEQ ID NO 1090
atgggaccgaagggagtggggacggtgagcggtcttacggctcgtcaacgcgcaattctcgagtttatccgaaaaaacatccgcgaaaaaggatatccgccatcggtgcgcgagattggagaagcggtggggttggcgtcaagctcgacggttcacgggcatctcgagcgactccaacagaagggttacttgcgtcgagatccgaccaaaccgagagcactggaactccttgtggacgacgaggagccgggggatgtcgtgctcgctcccatcgtcggtcgtgtgacagcgggacttcccatctcggcgctggaagacatcgagggatacttgcctttgccgcgcgacgtggcgaagggcgatgaagtcttcgcgctgcgcgtggtcggcgagagcatgatcaatgcgggcattctggatggcgatctcgccatcgtgcggcggcagacgtcggccgacaacggcgacatcgtcgtggccatgaccgacgaggaagaagccaccatcaagcggttttaccgggaggatggccgtgtgcgcctccaaccagaaaacgacgcgatgtctcccttgtactttccgaacgtgaccatcctcggcaaggtcatcgggatctttcggcagatccgatag

SEQ ID NO: 1106 - protein, 340 aa, Alicyclobacillus acidocaldarius
MTRMTTMADVAKRAGVSIMTVSRVVNNSGYVKPSTRQKVLAAMQELNYVPKGQQSSPHDTWMLIVPDITNPFFTFIARGMEDVARKHGFRVFIANTDEDLQKEQEYVQMCLDYQVRGALVVPVGDPSRENLVRLTEHQVPFVLIDREIEGLDADLVKGDIRETSRRLVEHLLDLGHERIAAVVGPLHSASSRERLDGYRDALLHKGLPVDESLIFTAPMTRDMDASFVDALVGRSDAPTALFLGNMFQYAHIVRRLRGLGLSIPHDISVVSFGNTDDLASVDSLATAAVQPAYNYGSLGAQLLLERIEGVRKTSTRIVLHSEMVVRSSTAPPPVRMTKKR

SEQ ID NO: 1107 - DNA, 1023 bp, Alicyclobacillus acidocaldarius
gtgacccgcatgaccacgatggcggatgtcgcaaaacgcgcgggcgtgtccatcatgaccgtatctcgcgtggtgaacaactccggttatgtgaagccgtcgacgaggcaaaaggtgctcgcggcgatgcaggaactcaactacgttccgaaggggcagcagtcctcgccgcacgacacgtggatgctcatcgtgccggacatcaccaacccgtttttcacctttatcgcgcgcggcatggaggacgtggcgcgcaaacacggttttcgggtgttcatcgccaacacggacgaggaccttcagaaagagcaggaatatgtgcagatgtgcctcgattaccaggtgcgcggcgcgctggtggtgccggtcggagatccgtcgcgcgaaaacctggtgcggctcaccgaacatcaggtgccgttcgtgctcatcgaccgcgagatcgaagggctcgacgcagatctcgtcaagggagacattcgcgagacctcgcgtcggctcgtggaacatctcctggacctgggccacgagcgcatcgcagccgtggtgggcccgctccacagcgcgtccagccgagagcggctcgacgggtaccgagacgcccttctccacaaggggttaccggtggatgagagcctcatcttcacggcgcccatgacgcgagacatggatgcatcgtttgtggacgcgctcgtcgggcgttcggacgcacccaccgccctgttcctcggcaacatgtttcagtacgcgcatatcgtgcgaaggcttcgcggtcttggcctttcgattccccacgacatcagcgtggtcagcttcggcaacacggacgatctcgcctcggtcgactccctcgcgacggcggcggttcaaccggcatacaactatggatcgctcggcgcgcagcttctgctcgagcggattgagggcgtgcggaagacgtcgacgaggattgtactccattcggagatggtcgtgcgcagttccaccgcgccgcctcccgtgcggatgaccaagaagaggtga

SEQ ID NO: 1108 - protein, 335 aa, Halothermothrix orenii H 168
MITIYDVAKEAGVSPSTVSRVLNNYNNVTETTRKKVEAACKKLKYVPNANASSLKKDNTKTLALIIPDIENPFFISILKGFDDKANKLGYDTILCNTDERLEKEKDYIKMVLKKRIDGVAISTVGKTSEHISEFSDRNIPYILLDRKVEGLDADIVCGDNYQGAIDLVNHLINNGHKDIAMITGPLHVSTSRERFEGYKTALNRAGISVEEDYIKIDYVSQDYSGEKAYEMTKELLGLNEPPTAIFVANNLMALEVYKALKEEGISVPDDIAIVCFDDLNLIYEIEPFFTVMKQPAYTMGEAAAEILIKRIEMSDNGHRKRKIVFEPELIIRKSS

SEQ ID NO: 1109 - protein, 329 aa, Thermoanaerobacter sp. X514
TIKDIAKLANVSITTVSRVINNKSEGVSEETRNRILQLVKELGYQPNAIARGLVTKKTKTIGLIIPDISNPFFPDIARGVEDSAHIYGYNVFLCNTDDNLEKESEYINALKEKYVDGIIFTSSSIPKHEHIMELVKSGIPIVIMDRRVDSEDIYGVFLDNYEGGYIATKHLIDLGHKKIACITGPLYTKSAKERLEGYKKALVENGMDVDERLIFEGDYKINSGIIGTEKLLGNNENVTAIFACNDLMAYGAYKTIRSYGYKIPDDISIVGFDDIQLSQILEPQLTTIKQPAYDMGLAAARMLIKLVEGKKLKKKIINFRPQLIIRQST

SEQ ID NO: 1110 - protein, 328 aa, Symbiobacterium thermophilum IAM 14863
TIRDVARRAGVGVATVSRVLNGTGYVKAETRERVLAAAAELGYVPSQLARGLVRRLSGTVGLVVPDITNPFFPLITRGVEDAASEAGYTVFLCNTDNDPVLEAQDVRKLREHRVDGIIFVGTTERRELVDQLLADDIPVVVMDRQLEHADVDTVTVDNVAGAQAACRHLIELGHRRIAHAAGHQSTRTGQDRCQGYRMALEEADIPYDPACVTWGDFTFESGFRVGQVLLGLSPRPTAVFAGNDLIALGVIRAAEEAGLSVPDDLSVVGFDNIQMAALVRPGLTTVRQPAREMGRLAMTMLLERIRGEFSGPGRRHVYPPELIVRGTT

SEQ ID NO: 1111 - protein, 329 aa, Thermoanaerobacter tengcongensis MB4
TIKDIARLANVSVTTVSRVINNKPEGVSEETRQKILKLVKELGYQPNAIARGLVTKKTKTIGLIIPDISNPFFPDIARGVEDSAHIYGYNVFLCNTDDNLEKESEYIRALKEKYVDGIIFTSSSIPKHEHIIELVESGIPVVIMDRRVDSENIYGVFLDNYEGGYIATKHLIDLGHEKIGCITGPLYTKSAKERLEGYKKALLDSGIKIDEKLIFEGDYKINGGIIGAERLLKDNKDMSAIFACNDLMAYGAYKTIRSFGYKIPDDISVVGFDDIQLSQILEPQLSTIKQPAYDMGLTAARMLIKLIEGKKLKKKIINFRPQLVIRQST

SEQ ID NO: 1112 - protein, 327 aa, Geobacillus kaustophilus HTA426
MASIKDVAKRANVSTATVSRVLRNAGNVTEETRQRVLEAIEALNYQPNVLGRYLRRMETETVLVVVPDITNPFFSKVLRGIEAVALEHGYQVLLGDTQNDVRLEEQYLNLLPQRQVDGMIFLTARIRKELVEEMARQFPIVLACEYLEGADIPTVSIDNISSARKATEHLIRLGHRRIAHLSGPMNIILSRDRLRGYQQALAQHELEADAALVQEGDFTYESGYNLTLKLLALEKPPTAIFAANDEMAIGAIKAVRHRGGRVPDDVAVVGFDDIQMASIFEPSLTTIAQPMFEIGQKAMELLLALIEGTSARRRQLVLPDRLVIRDS

SEQ ID NO: 1113 - protein, 340 aa, Artificial
  Substituion in SEQ ID NO 1106
MTRMTTMADVAKRAGVSIMTVSRVVNNSGYVKPSTRQKVLAAMQELNYVPKGQQSSPHDTWMLIVPDITNPFFTFIARGMEDVARKHGFRVFIANTDEDLQKEQEYVQMCLDYQVRGALVVPVGDPSRENLVRLTEHQVPFVLIDREIEGLDADLVKGDIRETSRRLVEHLLDLGHERIAAVVGPLHSASSRERLDGYRDALLHKGLPVDESLIFTAPMTRDMDASFVDALVGRSDAPTALFLGNMFQYAHIVRRLRGLGLSLPHDISVVSFGNTDDLASVDSLATAAVQPAYNYGSLGAQLLLERIEGVRKTSTRIVLHSEMVVRSSTAPPPVRMTKKR

SEQ ID NO: 1114 - protein, 340 aa, Artificial
  Substituion in SEQ ID NO 1106
MTRMTTMADVAKRAGVSIMTVSRVVNNSGYVKPSTRQKVLAAMQELNYVPKGQQSSPHDTWMLIVPDITNPFFTFIARGMEDVARKHGFRVFIANTDEDLQKEQEYVQMCLDYQVRGALVVPVGDPSRENLVRLTEHQVPFVLIDREIEGLDADLVKGDIRETSRRLVEHLLDLGHERIAAVVGPLHSASSRERLDGYRDALLHKGLPVDESLIFTAPMTRDMDASFVDALVGRSDAPTALFLGNMFQYAHIVRRLRGLGLSIPHDISVVSFGNTDDLASVDSLATAAVQPAYNYGSLGAQLLLERIEGVRKTSTRIVLHSEMVVRSSTAPPPVRMTKRR

SEQ ID NO: 1115 - protein, 340 aa, Artificial
  Substituion in SEQ ID NO 1106
MTRMTTMADVAKRAGVSIMTVSRVVNNSGYVKPSTRQKVLAAMQELNYVPKGQQSSPHDTWMLIVPDITNPFFTFIARGMEDVARKHGFRVFIANTDEDLQKEQEYVQMCLDYQVRGALVVPVGDPSRENIVRLTEHQVPFVLIDREIEGLDADLVKGDIRETSRRLVEHLLDLGHERIAAVVGPLHSASSRERLDGYRDALLHKGLPVDESLIFTAPMTRDMDASFVDALVGRSDAPTALFLGNMFQYAHIVRRLRGLGLSIPHDISVVSFGNTDDLASVDSLATAAVQPAYNYGSLGAQLLLERIEGVRKTSTRIVLHSEMVVRSSTAPPPVRMTKKR

SEQ ID NO: 1116 - protein, 340 aa, Artificial
  Substituion in SEQ ID NO 1106
MTRMTTMADVAKRAGVSIMTVSRVVNNSGYVKPSTRQKVLAAMQELNYVPKGQQSSPHDTWMLIVPDITNPFFTFIARGMEDIARKHGFRVFIANTDEDLQKEQEYVQMCLDYQVRGALVVPVGDPSRENLVRLTEHQVPFVLIDREIEGLDADLVKGDIRETSRRLVEHLLDLGHERIAAVVGPLHSASSRERLDGYRDALLHKGLPVDESLIFTAPMTRDMDASFVDALVGRSDAPTALFLGNMFQYAHIVRRLRGLGLSIPHDISVVSFGNTDDLASVDSLATAAVQPAYNYGSLGAQLLLERIEGVRKTSTRIVLHSEMVVRSSTAPPPVRMTKKR

SEQ ID NO: 1117 - protein, 340 aa, Artificial
  Substituion in SEQ ID NO 1106
MTRMTTMADVAKRAGVSIMTVSRVVNNSGYVKPSTRQKVLAAMQELNYVPKGQQSSPHDTWMLIVPDITNPFFTFIARGMEDVARKHGFRVFIANTDEDLQKEQEYVQMCLDYQVRGALVVPVGDPSRENLVRLTEHQVPFVLIDREIEGLDADLVKGDIRETSRRLVEHLLDLGHERIAAVVGPLHSASSRERLEGYRDALLHKGLPVDESLIFTAPMTRDMDASFVDALVGRSDAPTALFLGNMFQYAHIVRRLRGLGLSIPHDISVVSFGNTDDLASVDSLATAAVQPAYNYGSLGAQLLLERIEGVRKTSTRIVLHSEMVVRSSTAPPPVRMTKKR

SEQ ID NO: 1118 - DNA, 1023 bp, Artificial
  Substituion in SEQ ID NO 1107
gtgacccgcatgaccacgatggcggatgtcgcaaaacgcgcgggcgtgtccatcatgaccgtatctcgcgtggtgaacaactccggttatgtgaagccgtcgacgaggcaaaaggtgctcgcggcgatgcaggaactcaactacgttccgaaggggcagcagtcctcgccgcacgacacgtggatgctcatcgtgccggacatcaccaacccgtttttcacctttatcgcgcgcggcatggaggacgtggcgcgcaaacacggttttcgggtgttcatcgccaacacggacgaggaccttcagaaagagcaggaatatgtgcagatgtgcctcgattaccaggtgcgcggcgcgctggtggtgccggtcggagatccgtcgcgcgaaaacctggtgcggctcaccgaacatcaggtgccgttcgtgctcatcgaccgcgagatcgaagggctcgacgcagatctcgtcaagggagacattcgcgagacctcgcgtcggctcgtggaacatctcctggacctgggccacgagcgcatcgcagccgtggtgggcccgctccacagcgcgtccagccgagagcggctcgacgggtaccgagacgcccttctccacaaggggttaccggtggatgagagcctcatcttcacggcgcccatgacgcgagacatggatgcatcgtttgtggacgcgctcgtcgggcgttcggacgcacccaccgccctgttcctcggcaacatgtttcagtacgcgcatatcgtgcgaaggcttcgcggtcttggcctttcgttaccccacgacatcagcgtggtcagcttcggcaacacggacgatctcgcctcggtcgactccctcgcgacggcggcggttcaaccggcatacaactatggatcgctcggcgcgcagcttctgctcgagcggattgagggcgtgcggaagacgtcgacgaggattgtactccattcggagatggtcgtgcgcagttccaccgcgccgcctcccgtgcggatgaccaagaagaggtga

SEQ ID NO: 1119 - DNA, 1023 bp, Artificial
  Substituion in SEQ ID NO 1107
gtgacccgcatgaccacgatggcggatgtcgcaaaacgcgcgggcgtgtccatcatgaccgtatctcgcgtggtgaacaactccggttatgtgaagccgtcgacgaggcaaaaggtgctcgcggcgatgcaggaactcaactacgttccgaaggggcagcagtcctcgccgcacgacacgtggatgctcatcgtgccggacatcaccaacccgtttttcacctttatcgcgcgcggcatggaggacgtggcgcgcaaacacggttttcgggtgttcatcgccaacacggacgaggaccttcagaaagagcaggaatatgtgcagatgtgcctcgattaccaggtgcgcggcgcgctggtggtgccggtcggagatccgtcgcgcgaaaacctggtgcggctcaccgaacatcaggtgccgttcgtgctcatcgaccgcgagatcgaagggctcgacgcagatctcgtcaagggagacattcgcgagacctcgcgtcggctcgtggaacatctcctggacctgggccacgagcgcatcgcagccgtggtgggcccgctccacagcgcgtccagccgagagcggctcgacgggtaccgagacgcccttctccacaaggggttaccggtggatgagagcctcatcttcacggcgcccatgacgcgagacatggatgcatcgtttgtggacgcgctcgtcgggcgttcggacgcacccaccgccctgttcctcggcaacatgtttcagtacgcgcatatcgtgcgaaggcttcgcggtcttggcctttcgattccccacgacatcagcgtggtcagcttcggcaacacggacgatctcgcctcggtcgactccctcgcgacggcggcggttcaaccggcatacaactatggatcgctcggcgcgcagcttctgctcgagcggattgagggcgtgcggaagacgtcgacgaggattgtactccattcggagatggtcgtgcgcagttccaccgcgccgcctcccgtgcggatgaccaagcgtaggtga

SEQ ID NO: 1120 - DNA, 1023 bp, Artificial
  Substituion in SEQ ID NO 1107
gtgacccgcatgaccacgatggcggatgtcgcaaaacgcgcgggcgtgtccatcatgaccgtatctcgcgtggtgaacaactccggttatgtgaagccgtcgacgaggcaaaaggtgctcgcggcgatgcaggaactcaactacgttccgaaggggcagcagtcctcgccgcacgacacgtggatgctcatcgtgccggacatcaccaacccgtttttcacctttatcgcgcgcggcatggaggacgtggcgcgcaaacacggttttcgggtgttcatcgccaacacggacgaggaccttcagaaagagcaggaatatgtgcagatgtgcctcgattaccaggtgcgcggcgcgctggtggtgccggtcggagatccgtcgcgcgaaaacattgtgcggctcaccgaacatcaggtgccgttcgtgctcatcgaccgcgagatcgaagggctcgacgcagatctcgtcaagggagacattcgcgagacctcgcgtcggctcgtggaacatctcctggacctgggccacgagcgcatcgcagccgtggtgggcccgctccacagcgcgtccagccgagagcggctcgacgggtaccgagacgcccttctccacaaggggttaccggtggatgagagcctcatcttcacggcgcccatgacgcgagacatggatgcatcgtttgtggacgcgctcgtcgggcgttcggacgcacccaccgccctgttcctcggcaacatgtttcagtacgcgcatatcgtgcgaaggcttcgcggtcttggcctttcgattccccacgacatcagcgtggtcagcttcggcaacacggacgatctcgcctcggtcgactccctcgcgacggcggcggttcaaccggcatacaactatggatcgctcggcgcgcagcttctgctcgagcggattgagggcgtgcggaagacgtcgacgaggattgtactccattcggagatggtcgtgcgcagttccaccgcgccgcctcccgtgcggatgaccaagaagaggtga

SEQ ID NO: 1121 - DNA, 1023 bp, Artificial
  Substituion in SEQ ID NO 1107
gtgacccgcatgaccacgatggcggatgtcgcaaaacgcgcgggcgtgtccatcatgaccgtatctcgcgtggtgaacaactccggttatgtgaagccgtcgacgaggcaaaaggtgctcgcggcgatgcaggaactcaactacgttccgaaggggcagcagtcctcgccgcacgacacgtggatgctcatcgtgccggacatcaccaacccgtttttcacctttatcgcgcgcggcatggaggacattgcgcgcaaacacggttttcgggtgttcatcgccaacacggacgaggaccttcagaaagagcaggaatatgtgcagatgtgcctcgattaccaggtgcgcggcgcgctggtggtgccggtcggagatccgtcgcgcgaaaacctggtgcggctcaccgaacatcaggtgccgttcgtgctcatcgaccgcgagatcgaagggctcgacgcagatctcgtcaagggagacattcgcgagacctcgcgtcggctcgtggaacatctcctggacctgggccacgagcgcatcgcagccgtggtgggcccgctccacagcgcgtccagccgagagcggctcgacgggtaccgagacgcccttctccacaaggggttaccggtggatgagagcctcatcttcacggcgcccatgacgcgagacatggatgcatcgtttgtggacgcgctcgtcgggcgttcggacgcacccaccgccctgttcctcggcaacatgtttcagtacgcgcatatcgtgcgaaggcttcgcggtcttggcctttcgattccccacgacatcagcgtggtcagcttcggcaacacggacgatctcgcctcggtcgactccctcgcgacggcggcggttcaaccggcatacaactatggatcgctcggcgcgcagcttctgctcgagcggattgagggcgtgcggaagacgtcgacgaggattgtactccattcggagatggtcgtgcgcagttccaccgcgccgcctcccgtgcggatgaccaagaagaggtga

SEQ ID NO: 1122 - DNA, 1023 bp, Artificial
  Substituion in SEQ ID NO 1107
gtgacccgcatgaccacgatggcggatgtcgcaaaacgcgcgggcgtgtccatcatgaccgtatctcgcgtggtgaacaactccggttatgtgaagccgtcgacgaggcaaaaggtgctcgcggcgatgcaggaactcaactacgttccgaaggggcagcagtcctcgccgcacgacacgtggatgctcatcgtgccggacatcaccaacccgtttttcacctttatcgcgcgcggcatggaggacgtggcgcgcaaacacggttttcgggtgttcatcgccaacacggacgaggaccttcagaaagagcaggaatatgtgcagatgtgcctcgattaccaggtgcgcggcgcgctggtggtgccggtcggagatccgtcgcgcgaaaacctggtgcggctcaccgaacatcaggtgccgttcgtgctcatcgaccgcgagatcgaagggctcgacgcagatctcgtcaagggagacattcgcgagacctcgcgtcggctcgtggaacatctcctggacctgggccacgagcgcatcgcagccgtggtgggcccgctccacagcgcgtccagccgagagcggctcgaagggtaccgagacgcccttctccacaaggggttaccggtggatgagagcctcatcttcacggcgcccatgacgcgagacatggatgcatcgtttgtggacgcgctcgtcgggcgttcggacgcacccaccgccctgttcctcggcaacatgtttcagtacgcgcatatcgtgcgaaggcttcgcggtcttggcctttcgattccccacgacatcagcgtggtcagcttcggcaacacggacgatctcgcctcggtcgactccctcgcgacggcggcggttcaaccggcatacaactatggatcgctcggcgcgcagcttctgctcgagcggattgagggcgtgcggaagacgtcgacgaggattgtactccattcggagatggtcgtgcgcagttccaccgcgccgcctcccgtgcggatgaccaagaagaggtga

SEQ ID NO: 1123 - protein, 149 aa, Alicyclobacillus acidocaldarius
MSWRALHVTISFNRSHREGRAVDLEERRNMPLFSIGTVQKLTGLSARQIRYYEEHGLIQPARTPGNQRQFSFADVERLMQIRQLLDEGHNIASVKRNLLEKDRRPRSSRPLATRDVPDSEVYQWLERELMERRQTGEFQGDLSRFYRHR

SEQ ID NO: 1124 - DNA, 450 bp, Alicyclobacillus acidocaldarius
ttgtcgtggcgcgccctccatgttacgataagtttcaacaggtcgcacagggaggggcgcgccgtggatttggaagagcgcaggaacatgcccttattttcgataggcacggtgcaaaagctgacggggctcagcgcacggcaaatccgttactacgaagagcacgggttgatccagccggcgcgcacgcccgggaatcagcggcagttttcgtttgccgacgtggagcgcctgatgcagatccgacagttgctcgacgagggtcacaatatcgcgagcgtgaagcgcaaccttctcgagaaggacaggcggccgagatcgagccgcccgttggcgacaagggacgtgcccgattccgaagtgtatcagtggctggagcgcgagctgatggagcggcggcaaacgggagagtttcaaggcgatttgtctcgcttctaccgccaccgctga

SEQ ID NO: 1125 - protein, 129 aa, Bacillus subtilis
RRSMPLFPIGIVMQLTELSARQIRYYEENGLIFPARSEGNRRLFSFHDVDKLLEIKHLIEQGVNMAGIKQILAKAEAEPEQKQNEKTKKPVKHDLSDDELRQLLKNELMQAGRFQRGNTFRQGDMSRFF

SEQ ID NO: 1126 - protein, 129 aa, Bacillus subtilis subsp. subtilis str. 168
RRSMPLFPIGIVMQLTELSARQIRYYEENGLIFPARSEGNRRLFSFHDVDKLLEIKHLIEQGVNMAGIKQILAKAEAEPEQKQNEKTKKPMKHDLSDDELRQLLKNELMQAGRFQRGNTFRQGDMSRFF

SEQ ID NO: 1127 - protein, 129 aa, Paenibacillus larvae subsp. larvae BRL-230010
RRNMALFPIGIVMKLTDLTARQIRYYEQHELVIPARTSGNQRLYSFNDVERLLEIKDLIEKGVNIAGIKQVLLPVSKDSEEATYLNEASETKRKELTDSQLRQLLKQQIVGARRPGQVSLIQGELSRFY

SEQ ID NO: 1128 - protein, 126 aa, Bacillus cereus ATCC 14579
EDRRSAPLFPIGIVMDLTQLSARQIRYYEEHNLVSPTRTKGNRRLFSFNDVDKLLEIKDLLDQGLNMAGIKQVLLMKENQTEAVKVKEETKEISKTELRKILRDELQHTGRFNRTSLRQGDISRFF

SEQ ID NO: 1129 - protein, 126 aa, Bacillus cereus subsp. cytotoxis NVH 391-98
EDRRSAPLFPIGIVMDLTQLSARQIRYYEEHNLISPTRTKGNRRLFSFNDVDKLLEIKDLLDQGLNMAGVKQVLQMKENQTEAVKTKEETKEISKAELRRILRDELQHTGRFNRTSLRQGDISRFF

SEQ ID NO: 1130 - protein, 149 aa, Artificial
  Substituion in SEQ ID NO 1123
MSWRALHVTISFNRSHREGRAVDLEERRNMPLFSIGTVQKLTGLSARQIRYYEEHGLIQPARTPGNQRQFSFADVERLMQIRQLLDEGHNIASVKRNLLDKDRRPRSSRPLATRDVPDSEVYQWLERELMERRQTGEFQGDLSRFYRHR

SEQ ID NO: 1131 - protein, 149 aa, Artificial
  Substituion in SEQ ID NO 1123
MSWRALHVTISFNRSHREGRAVDLEERRNMPLFSIGTVQKLTGLSARQIRYYEEHGLIQPARTPGNQRQFSFADVERLMNIRQLLDEGHNIASVKRNLLEKDRRPRSSRPLATRDVPDSEVYQWLERELMERRQTGEFQGDLSRFYRHR

SEQ ID NO: 1132 - protein, 149 aa, Artificial
  Substituion in SEQ ID NO 1123
MSWRALHVTISFNRSHREGRAVDLEERRNMPLFSIGTVQKLTGLSARQIRYYEEHGLIQPARTPGNQRQFSFADVERLMQIRQLLDEGHNIASVKKNLLEKDRRPRSSRPLATRDVPDSEVYQWLERELMERRQTGEFQGDLSRFYRHR

SEQ ID NO: 1133 - protein, 149 aa, Artificial
  Substituion in SEQ ID NO 1123
MSWRALHVTISFNRSHREGRAVDLDERRNMPLFSIGTVQKLTGLSARQIRYYEEHGLIQPARTPGNQRQFSFADVERLMQIRQLLDEGHNIASVKRNLLEKDRRPRSSRPLATRDVPDSEVYQWLERELMERRQTGEFQGDLSRFYRHR

SEQ ID NO: 1134 - protein, 149 aa, Artificial
  Substituion in SEQ ID NO 1123
MSWRALHVTISFNRSHREGKAVDLEERRNMPLFSIGTVQKLTGLSARQIRYYEEHGLIQPARTPGNQRQFSFADVERLMQIRQLLDEGHNIASVKRNLLEKDRRPRSSRPLATRDVPDSEVYQWLERELMERRQTGEFQGDLSRFYRHR

SEQ ID NO: 1135 - DNA, 450 bp, Artificial
  Substituion in SEQ ID NO 1124
ttgtcgtggcgcgccctccatgttacgataagtttcaacaggtcgcacagggaggggcgcgccgtggatttggaagagcgcaggaacatgcccttattttcgataggcacggtgcaaaagctgacggggctcagcgcacggcaaatccgttactacgaagagcacgggttgatccagccggcgcgcacgcccgggaatcagcggcagttttcgtttgccgacgtggagcgcctgatgcagatccgacagttgctcgacgagggtcacaatatcgcgagcgtgaagcgcaaccttctcgataaggacaggcggccgagatcgagccgcccgttggcgacaagggacgtgcccgattccgaagtgtatcagtggctggagcgcgagctgatggagcggcggcaaacgggagagtttcaaggcgatttgtctcgcttctaccgccaccgctga

SEQ ID NO: 1136 - DNA, 450 bp, Artificial
  Substituion in SEQ ID NO 1124
ttgtcgtggcgcgccctccatgttacgataagtttcaacaggtcgcacagggaggggcgcgccgtggatttggaagagcgcaggaacatgcccttattttcgataggcacggtgcaaaagctgacggggctcagcgcacggcaaatccgttactacgaagagcacgggttgatccagccggcgcgcacgcccgggaatcagcggcagttttcgtttgccgacgtggagcgcctgatgaatatccgacagttgctcgacgagggtcacaatatcgcgagcgtgaagcgcaaccttctcgagaaggacaggcggccgagatcgagccgcccgttggcgacaagggacgtgcccgattccgaagtgtatcagtggctggagcgcgagctgatggagcggcggcaaacgggagagtttcaaggcgatttgtctcgcttctaccgccaccgctga

SEQ ID NO: 1137 - DNA, 450 bp, Artificial
  Substituion in SEQ ID NO 1124
ttgtcgtggcgcgccctccatgttacgataagtttcaacaggtcgcacagggaggggcgcgccgtggatttggaagagcgcaggaacatgcccttattttcgataggcacggtgcaaaagctgacggggctcagcgcacggcaaatccgttactacgaagagcacgggttgatccagccggcgcgcacgcccgggaatcagcggcagttttcgtttgccgacgtggagcgcctgatgcagatccgacagttgctcgacgagggtcacaatatcgcgagcgtgaagaaaaaccttctcgagaaggacaggcggccgagatcgagccgcccgttggcgacaagggacgtgcccgattccgaagtgtatcagtggctggagcgcgagctgatggagcggcggcaaacgggagagtttcaaggcgatttgtctcgcttctaccgccaccgctga

SEQ ID NO: 1138 - DNA, 450 bp, Artificial
  Substituion in SEQ ID NO 1124
ttgtcgtggcgcgccctccatgttacgataagtttcaacaggtcgcacagggaggggcgcgccgtggatttggatgagcgcaggaacatgcccttattttcgataggcacggtgcaaaagctgacggggctcagcgcacggcaaatccgttactacgaagagcacgggttgatccagccggcgcgcacgcccgggaatcagcggcagttttcgtttgccgacgtggagcgcctgatgcagatccgacagttgctcgacgagggtcacaatatcgcgagcgtgaagcgcaaccttctcgagaaggacaggcggccgagatcgagccgcccgttggcgacaagggacgtgcccgattccgaagtgtatcagtggctggagcgcgagctgatggagcggcggcaaacgggagagtttcaaggcgatttgtctcgcttctaccgccaccgctga

SEQ ID NO: 1139 - DNA, 450 bp, Artificial
  Substituion in SEQ ID NO 1124
ttgtcgtggcgcgccctccatgttacgataagtttcaacaggtcgcacagggaggggaaagccgtggatttggaagagcgcaggaacatgcccttattttcgataggcacggtgcaaaagctgacggggctcagcgcacggcaaatccgttactacgaagagcacgggttgatccagccggcgcgcacgcccgggaatcagcggcagttttcgtttgccgacgtggagcgcctgatgcagatccgacagttgctcgacgagggtcacaatatcgcgagcgtgaagcgcaaccttctcgagaaggacaggcggccgagatcgagccgcccgttggcgacaagggacgtgcccgattccgaagtgtatcagtggctggagcgcgagctgatggagcggcggcaaacgggagagtttcaaggcgatttgtctcgcttctaccgccaccgctga

SEQ ID NO: 1140 - protein, 222 aa, Alicyclobacillus acidocaldarius
MTKLEFWSECVAMRRKRGMTVRDRIEEAAKRAFSEFGYKGTTMDQIARLAGVSKGAIYLHFPSKEALFQHMLRGVIAQVRDAFESAQVEGDDYFRNLERGLRALMRFRADHAMLSKLVQEVRQFGTAEARAGLGELEAAILDYLARHLKRGVELGVVRPCRANLVAFVLLRAYTAVLRDFPSAEGPLSEEDLYQLFTGVFVDGLRLRPGEGEPRNTQSEQER

SEQ ID NO: 1141 - DNA, 669 bp, Alicyclobacillus acidocaldarius
atgaccaaattagaattctggtcagagtgcgtcgcaatgcgcagaaagcgagggatgaccgtgcgggatcgcattgaggaggccgccaagcgggcgttctccgagtttggctacaaaggcacgaccatggaccagattgcccggctcgcgggcgtcagcaagggggccatttatcttcacttcccgagcaaggaagcgctgtttcaacacatgctgcgcggggtcatcgcgcaggtgcgagacgcgttcgagtcggcccaggtggagggcgacgattactttcgcaatctcgagcgcggcctgcgcgcgctcatgcggtttcgcgccgatcacgccatgctctcgaagctcgtccaggaggtccggcaatttgggacggcggaggcgcgcgcggggctcggggagcttgaggccgccatcctggactacctggcgcgccacctgaagcgcggcgtggagctcggcgtggtgcgcccgtgccgggccaatctcgtcgcgtttgtcctccttcgcgcctacaccgcggttttgcgcgactttccgtctgcggaaggtccgttgtccgaagaggacctgtaccagcttttcaccggcgtgtttgtcgacggcttgcgcctgaggcccggcgagggcgagcccaggaacacgcagagtgagcaggagaggtga

SEQ ID NO: 1142 - protein, 181 aa, Geobacillus kaustophilus HTA426
QIIEAAAQSFAAFGYKATTMEQIAKLANVGKGTIYTFFKSKEELLDEIVSGLIMEIKAEAELAMDSSLPFSENVHRALYRILEFRQRHQLTAKLLQEVRNIGTAAVQEVLAKLDRAMVEFIRQKIDAAVEKGEIRPCNSEITAFLMLKTYIALIVDWEKDHEPLTKEQIAELFTLYFLQGL

SEQ ID NO: 1143 - protein, 193 aa, Bacillus thuringiensis serovar israelensis ATCC 35646
FGGEDVAIDRKRSIIEAATKSFSAFGYKATTMDQVAKLANVGKGTIYTFFKNKEELFGEIISNLITEMKQVAESAIRSDVSFFENVHRALYSILEFRKEHQLMIKLIQEERDMGTKEVQEVMQQVDVEIVSVIQSYLKIAIEKGEISKCDPEITAFIMLRLYVSLIFDWEKNHEPLEKEKIAELFELYLLKGL

SEQ ID NO: 1144 - protein, 181 aa, Geobacillus thermodenitrificans NG80-2
QIIEAAAQSFAAFGYKATTMEQIAKLANVGKGTIYTFFKSKEELLDEIVSSLIAEIKVEAEQAMDSSLPFSENVHRALYRILEFRQRHQLTAKLLQEMRSIGTIAVQEVLTKFDRAMVEFIRQKIEAAVEKGEIRPCNAEITAFLMLKMYIALIVDWEKDHQPLTKEQIAELFALYFLQGL

SEQ ID NO: 1145 - protein, 193 aa, Bacillus thuringiensis str. Al Hakam
FGGDDVAIDRKRSIIEAATKSFSAFGYKATTMDQVAKLANVGKGTIYTFFKNKEELFGEIISNLITEMKQVAENAIRSDVSFFENVHRALYSILEFRKEHQLMIKLIQEERDMGTKEVQEVMQQVDVEIVSFIQSYLKIAIEKGEISKCDPEITAFIMLRLYVSLIFDWEKNHEPLEKEKIAELFELYLLRGL

SEQ ID NO: 1146 - protein, 188 aa, Bacillus cereus ATCC 14579
MAIDRKRSIIEAATKSFSAFGYKATTMDQVAKLANVGKGTIYTFFKNKEELFGEIISNLITEMKQVAESAIRSDVSFFENVHRALYSILEFRKEHQLMIKLIQEERDMGTKEVQEVMQQVDVEIVSVIQSYLKIAIEKGEISKCDPEITAFIMLRLYVSLIFDWEKNHEPLEKEKIAELFELYLLKGL

SEQ ID NO: 1147 - protein, 222 aa, Artificial
  Substituion in SEQ ID NO 1140
MTKLEFWSECVAMRRKRGMTVRDRIEEAAKRAFSEFGYKGTTMDQIARLAGVSKGAIYLHFPSKEALFQHMLRGVIAQVREAFESAQVEGDDYFRNLERGLRALMRFRADHAMLSKLVQEVRQFGTAEARAGLGELEAAILDYLARHLKRGVELGVVRPCRANLVAFVLLRAYTAVLRDFPSAEGPLSEEDLYQLFTGVFVDGLRLRPGEGEPRNTQSEQER

SEQ ID NO: 1148 - protein, 222 aa, Artificial
  Substituion in SEQ ID NO 1140
MTKLEFWSECVAMRRKRGMTVRDRIEEAAKKAFSEFGYKGTTMDQIARLAGVSKGAIYLHFPSKEALFQHMLRGVIAQVRDAFESAQVEGDDYFRNLERGLRALMRFRADHAMLSKLVQEVRQFGTAEARAGLGELEAAILDYLARHLKRGVELGVVRPCRANLVAFVLLRAYTAVLRDFPSAEGPLSEEDLYQLFTGVFVDGLRLRPGEGEPRNTQSEQER

SEQ ID NO: 1149 - protein, 222 aa, Artificial
  Substituion in SEQ ID NO 1140
MTKLEFWSECVAMRRKRGMTVRDRIEEAAKRAFSEFGYKGTTMDQIARLAGVSKGAIYLHFPSKEALFQHMLRGVIANVRDAFESAQVEGDDYFRNLERGLRALMRFRADHAMLSKLVQEVRQFGTAEARAGLGELEAAILDYLARHLKRGVELGVVRPCRANLVAFVLLRAYTAVLRDFPSAEGPLSEEDLYQLFTGVFVDGLRLRPGEGEPRNTQSEQER

SEQ ID NO: 1150 - protein, 222 aa, Artificial
  Substituion in SEQ ID NO 1140
MTKLEFWSECVAMKRKRGMTVRDRIEEAAKRAFSEFGYKGTTMDQIARLAGVSKGAIYLHFPSKEALFQHMLRGVIAQVRDAFESAQVEGDDYFRNLERGLRALMRFRADHAMLSKLVQEVRQFGTAEARAGLGELEAAILDYLARHLKRGVELGVVRPCRANLVAFVLLRAYTAVLRDFPSAEGPLSEEDLYQLFTGVFVDGLRLRPGEGEPRNTQSEQER

SEQ ID NO: 1151 - protein, 222 aa, Artificial
  Substituion in SEQ ID NO 1140
MTKLEFWSECVAMRRKRGMTVRDRIEEAAKRAFSEFGYKGTTMDQIARLAGVSKGAIYLHFPSKEALFQHMLRGVIAQVRDAFESAQVEGDDYFRNLERGLRALMRFRADHAMLSKLVQEVRQFGTAEARAGLGELEAAILDYLARHLKRGVELGVVRPCRANLVAFVLLRAYTAVLRDFPSAEGPLSEEDLYQLFTGVFVDGLRLRPGEGEPRQTQSEQER

SEQ ID NO: 1152 - DNA, 669 bp, Artificial
  Substituion in SEQ ID NO 1141
atgaccaaattagaattctggtcagagtgcgtcgcaatgcgcagaaagcgagggatgaccgtgcgggatcgcattgaggaggccgccaagcgggcgttctccgagtttggctacaaaggcacgaccatggaccagattgcccggctcgcgggcgtcagcaagggggccatttatcttcacttcccgagcaaggaagcgctgtttcaacacatgctgcgcggggtcatcgcgcaggtgcgagaagcgttcgagtcggcccaggtggagggcgacgattactttcgcaatctcgagcgcggcctgcgcgcgctcatgcggtttcgcgccgatcacgccatgctctcgaagctcgtccaggaggtccggcaatttgggacggcggaggcgcgcgcggggctcggggagcttgaggccgccatcctggactacctggcgcgccacctgaagcgcggcgtggagctcggcgtggtgcgcccgtgccgggccaatctcgtcgcgtttgtcctccttcgcgcctacaccgcggttttgcgcgactttccgtctgcggaaggtccgttgtccgaagaggacctgtaccagcttttcaccggcgtgtttgtcgacggcttgcgcctgaggcccggcgagggcgagcccaggaacacgcagagtgagcaggagaggtga

SEQ ID NO: 1153 - DNA, 669 bp, Artificial
  Substituion in SEQ ID NO 1141
atgaccaaattagaattctggtcagagtgcgtcgcaatgcgcagaaagcgagggatgaccgtgcgggatcgcattgaggaggccgccaagaaagcgttctccgagtttggctacaaaggcacgaccatggaccagattgcccggctcgcgggcgtcagcaagggggccatttatcttcacttcccgagcaaggaagcgctgtttcaacacatgctgcgcggggtcatcgcgcaggtgcgagacgcgttcgagtcggcccaggtggagggcgacgattactttcgcaatctcgagcgcggcctgcgcgcgctcatgcggtttcgcgccgatcacgccatgctctcgaagctcgtccaggaggtccggcaatttgggacggcggaggcgcgcgcggggctcggggagcttgaggccgccatcctggactacctggcgcgccacctgaagcgcggcgtggagctcggcgtggtgcgcccgtgccgggccaatctcgtcgcgtttgtcctccttcgcgcctacaccgcggttttgcgcgactttccgtctgcggaaggtccgttgtccgaagaggacctgtaccagcttttcaccggcgtgtttgtcgacggcttgcgcctgaggcccggcgagggcgagcccaggaacacgcagagtgagcaggagaggtga

SEQ ID NO: 1154 - DNA, 669 bp, Artificial
  Substituion in SEQ ID NO 1141
atgaccaaattagaattctggtcagagtgcgtcgcaatgcgcagaaagcgagggatgaccgtgcgggatcgcattgaggaggccgccaagcgggcgttctccgagtttggctacaaaggcacgaccatggaccagattgcccggctcgcgggcgtcagcaagggggccatttatcttcacttcccgagcaaggaagcgctgtttcaacacatgctgcgcggggtcatcgcgaatgtgcgagacgcgttcgagtcggcccaggtggagggcgacgattactttcgcaatctcgagcgcggcctgcgcgcgctcatgcggtttcgcgccgatcacgccatgctctcgaagctcgtccaggaggtccggcaatttgggacggcggaggcgcgcgcggggctcggggagcttgaggccgccatcctggactacctggcgcgccacctgaagcgcggcgtggagctcggcgtggtgcgcccgtgccgggccaatctcgtcgcgtttgtcctccttcgcgcctacaccgcggttttgcgcgactttccgtctgcggaaggtccgttgtccgaagaggacctgtaccagcttttcaccggcgtgtttgtcgacggcttgcgcctgaggcccggcgagggcgagcccaggaacacgcagagtgagcaggagaggtga

SEQ ID NO: 1155 - DNA, 669 bp, Artificial
  Substituion in SEQ ID NO 1141
atgaccaaattagaattctggtcagagtgcgtcgcaatgaaaagaaagcgagggatgaccgtgcgggatcgcattgaggaggccgccaagcgggcgttctccgagtttggctacaaaggcacgaccatggaccagattgcccggctcgcgggcgtcagcaagggggccatttatcttcacttcccgagcaaggaagcgctgtttcaacacatgctgcgcggggtcatcgcgcaggtgcgagacgcgttcgagtcggcccaggtggagggcgacgattactttcgcaatctcgagcgcggcctgcgcgcgctcatgcggtttcgcgccgatcacgccatgctctcgaagctcgtccaggaggtccggcaatttgggacggcggaggcgcgcgcggggctcggggagcttgaggccgccatcctggactacctggcgcgccacctgaagcgcggcgtggagctcggcgtggtgcgcccgtgccgggccaatctcgtcgcgtttgtcctccttcgcgcctacaccgcggttttgcgcgactttccgtctgcggaaggtccgttgtccgaagaggacctgtaccagcttttcaccggcgtgtttgtcgacggcttgcgcctgaggcccggcgagggcgagcccaggaacacgcagagtgagcaggagaggtga

SEQ ID NO: 1156 - DNA, 669 bp, Artificial
  Substituion in SEQ ID NO 1141
atgaccaaattagaattctggtcagagtgcgtcgcaatgcgcagaaagcgagggatgaccgtgcgggatcgcattgaggaggccgccaagcgggcgttctccgagtttggctacaaaggcacgaccatggaccagattgcccggctcgcgggcgtcagcaagggggccatttatcttcacttcccgagcaaggaagcgctgtttcaacacatgctgcgcggggtcatcgcgcaggtgcgagacgcgttcgagtcggcccaggtggagggcgacgattactttcgcaatctcgagcgcggcctgcgcgcgctcatgcggtttcgcgccgatcacgccatgctctcgaagctcgtccaggaggtccggcaatttgggacggcggaggcgcgcgcggggctcggggagcttgaggccgccatcctggactacctggcgcgccacctgaagcgcggcgtggagctcggcgtggtgcgcccgtgccgggccaatctcgtcgcgtttgtcctccttcgcgcctacaccgcggttttgcgcgactttccgtctgcggaaggtccgttgtccgaagaggacctgtaccagcttttcaccggcgtgtttgtcgacggcttgcgcctgaggcccggcgagggcgagcccaggcaaacgcagagtgagcaggagaggtga

SEQ ID NO: 1157 - protein, 712 aa, Alicyclobacillus acidocaldarius
MHRFEPKVRTWSRTWRAAAILGWLLAAALLAAVFPAASKEEINRSTLLPASAPSQMATARVRDAFPASSGTPAILVFYDPTGISSADWAAIRRTVRELRTHPVTAQTQVPPLDALPSGAAARFASDDGKVVSFPVLLRADASQDQLNQAVDEIDQDLRRAVGAGALNLALDRPGLHAYVTGPAGIAVDATHLFQHADLALLIATTLLVLALMIVLYRSPILALVPLVSVGIAYAVVSSLLGAWARYGGLTFDAQTLSILTVLLFGAGTDYCLFLIARYRQELRRHERPIDALRAGYKSAAGAILMSGLTVSASLLSLLAARSPSFHEFAIPFSVAVFVMALVAITFVPALIGSLGRAAFWPRIPRYEPDAPDAGRPGRVSRWLGRTAVRRRKPVAVLGSLALAACCLALPHVRTSYDLLSSFPADMPSREGYAVLSAHESPGALAPIDVLVEGGSPEGAVRAVQSLAAVEQVHLVAVRDHAHVALMQVELRTNPYSETAMAALSSIERAAAKGASAGGQAAHVFLAGETAAQEDTRAITARDTRVVIPIVLVAIGLLLLVYLRSVVAPLYLLATIVLSYGAAMGLGWLVIREVLHQPAMQGAIPLYAFVFLVALGEDYNIFVMSRIWEVWRRGQADAAVERGVADTASVITSAGLILAGTFAMLASLPIQVLLQFGVVTAIGVLLDTFVVRPWMVPAITALLGDAARWPRRT

SEQ ID NO: 1158 - DNA, 2139 bp, Alicyclobacillus acidocaldarius
ttgcatcgattcgaaccgaaagtccgaacgtggagccggacctggcgcgcggcggctatcctcggatggctcctcgccgctgccttgctcgccgcggtcttccccgcggcgtccaaagaggagatcaaccgctccacgcttctgcccgcctcggctcccagccagatggcaaccgcccgagtgcgggatgcgttccccgcatcgtccggcacgcccgccatcctcgtcttctacgatccgaccggcatctcctccgccgattgggctgccattcgccggaccgtccgcgaacttcgcacgcatcccgtgacggcacaaacgcaggtgcccccgctcgatgcgctcccgtccggagctgcggcgcgcttcgcctcggatgacggcaaagtggtgagcttccccgtgctcctgcgcgcggacgcatcgcaggaccagctgaatcaagccgtggacgagatcgatcaggacctccgccgcgccgtcggcgccggcgcgctcaatctcgcactggaccgtcccggcctgcacgcctacgtgacagggccagcaggcattgcagtcgacgccacgcatctgttccagcacgccgatctcgccctgctcatcgccacgacgctgctcgtgctggcactcatgatcgttctgtaccgctcgcccatcctggccttggtgccgctcgtgagcgtcgggatcgcatacgccgtcgtgagctcgctgcttggcgcgtgggcgcgttacgggggcctgaccttcgacgcgcagaccctgtctatcctgacggtgctactgtttggcgccggaacggattactgcctgttcctcatcgcccgctaccgccaggagctgcggcgtcatgagcggccgatcgacgccttgcgcgctggctacaaaagcgcggcaggtgccattctgatgagcggcctgacggtgtccgcttcgcttctgtcactgttggcggcgcgatcgccgtcctttcacgagttcgcgatccccttcagcgtcgcggtattcgtgatggccctcgtcgccatcaccttcgtgccggcgctcattggctcgcttgggcgcgcggcgttttggccacgaattccccgctatgaaccagatgcgccggacgcagggcggccagggcgcgtctcgcgctggctcgggcggacagcggtgcggcggcgcaagccggtggccgtccttggctcgctcgccctcgccgcctgctgcctcgccctgccacacgtgcgcacgagctacgatctgctctcgtccttcccggcggacatgccttcgcgcgaaggctacgccgtgctgtcggcccacgagagcccaggcgcgctcgcgcccatcgacgtgctggtcgagggcgggagccccgaaggtgccgtccgcgccgtgcaatcgctcgccgccgtcgagcaggtgcacctggtggcggtccgtgaccatgcccacgtggccttgatgcaggtggagctgcgaacgaacccctatagcgaaaccgccatggcggcgctgtcatccatcgagcgagctgcggccaagggcgcttcagcgggtgggcaagccgcgcacgtcttcctggccggcgaaaccgccgctcaagaagacacgcgagcgatcacggctcgagacacgcgggtggtcatccccattgtgcttgtcgccattgggctcctcctgctcgtctatttgcggtcggtcgtcgcgccgctctatctcctcgcgaccatcgtgctctcctacggcgccgccatgggccttggttggctcgtgattcgtgaggtcctccatcagcccgccatgcagggggctatcccgctttacgcgttcgtctttctagtggcactcggcgaagattacaacatcttcgtcatgtcgcgcatctgggaggtctggcgccggggacaggctgacgccgccgtggaacggggcgtcgccgacacggcaagcgtcattacttctgccggcctcatcctggcaggcacgtttgccatgctcgcgtccctgccgattcaggtcctgcttcagttcggcgtcgtcacggccatcggcgtgctgctggacaccttcgtggtgcggccttggatggtccccgccatcaccgcgcttctcggagacgcggcgcggtggccgaggcgcacctag

SEQ ID NO: 1159 - protein, 678 aa, Bacillus cereus ATCC 10987
LPETAMSQQAEALMKKEFPNNAGNPLLVVWYRDGGLQSQDYKLIQDVYKELKASPLKEQSTLPPFDTIPEQALSKSASKDGTSFVTPVFFNKSAGTDILKGNLDDLRKIVNSKVDVDPFKQKISDSGLHVRLSGPVGIQTDAVSLFSQADVKLLVATVLLVLVLLILLYRSPILAILPLLVVGFAYGIISPTLGFLADHGWIKVDAQAISIMTVLLFGAGTDYCLFLISRYREYLLEEESKYKALQLAIKASGGAIIMSALTVVLGLGTLLLAHYGAFHRFAVPFSVAVFIMGIAALTILPALLLIFGRAAFFPFVPRTTSMNEELARRKKKVVKVKKSKGAFSKKLGDVVVRRPWTIIMLTVFVLGGLASFVPRIQYTYDLLESFPKDMPSREGFTLISDHFSAGELAPVKVVVDTKGKELPMKQELEKFSFVKTVKEPKDGKENKQIKMYEVSLAENPYSIEALDQIPKLKIHVEKVLKDAGVTKAEDQLWIGGETASLYDTKQITERDEAVIIPVMISIIALLLLVYLRSIVAMIYLIVTVVLSFFSALGAGWILLHFGMGAPAIQGAIPLYAFVFLVALGEDYNIFMVSEIWKNRKTQNHLAAVKNGVIQTGSVITSAGLILAGTFAVLGTLPIQVLVQFGIVTAIGVLLDTFIVRPLLVPAITVVLGRFAFWP

SEQ ID NO: 1160 - protein, 678 aa, Bacillus thuringiensis serovar israelensis ATCC 35646
LPETAMSQQAEALMKKEFPNNTGNPLLVVWYRDGGLQSQDYKLIQDVYKELKANPLKEQSTLPPFDTIPEQVLSKSASKDGTSFVTPVFFNKSAGTDILKGNLEKLEKKVNSKVDEDPFKQKISESGLHVRLSGPVGIQTDAVSLFSQADVKLLVATVLLVLILLILLYRSPILAILPILVVGFAYGIISPTLGFLADHGWIKVDAQAISIMTVLLFGAGTDYCLFLISRYREYLLEEESKYKALQLAIKASGGAIIMSALTVVLGLGTLLLAHYGAFHRFAVPFSVAVFIMGIAALTILPALLLIFGRIAFFPFIPRTTSMNEEFARKKKRAVKVEKSKGSFSKKLGDVVVRRPWTIIMLTVFVLGGLASFVPRIQYTYDLLESFPKDMPSREGFTLISDHFSAGELAPVKVVVDTKGKELPIKQELEKFSFVNTVKEPKEGKENKQIQMYEVSLAENPYSIEALDQIPKLKSNVEKVLKDAGIRNTEDQLWIGGETASLYDTKQITERDESVIIPVMISIIALLLLVYLRSVVAMIYLIVTVVLSFFSALGAGWILLHYGMGAPAIQGAIPLYAFVFLVALGEDYNIFMVSEIWKNRKTQNHMDAVKNGVIQTGSVITSAGLILAGTFAVLGTLPIQVLVQFGIVTAIGVLLDTFIVRPLLVPAITVVLGRFAFWP

SEQ ID NO: 1161 - protein, 678 aa, Bacillus thuringiensis str. Al Hakam
LPETAMSQQAEALMKKEFPNNAGNPLLVVWYRDGGLQSQDYKLIQDVYKELKASPLKEQSTLPPFDTIPEQVLSKSASKDGTSFVTPVFFNKSAGTDILKGNLDDLRKIVNSKVDVDPFKQKISDSGLHVRLSGPVGIQTDAVSLFSQADVKLLIATVLLVLVLLILLYRSPILAILPLLVVGFAYGIISPTLGFLADHGWIKVDAQAISIMTVLLFGAGTDYCLFLISRYREYLLEEESKYKALQLAIKASGGAIIMSALTVVLGLGTLLLAHYGAFHRFAVPFSVAVFIMGIAALTILPALLLIFGRAAFFPFVPRTTSMNEELARRKKKVVKVKKSKGAFSKKLGDVVVRRPWTIIMLTVFVLGGLASFVPRIQYTYDLLESFPKDMPSREGFTLISDHFSAGELAPVKVVVDTKGKELPIKEELEKFSFVNTVKDPKEGKENKQIQMYEVSLAENPYSIEALDQIPKLKNSVEKVFKDAGISNAEDQLWIGGETASLYDTKQITERDEAVIIPVMISIIALLLLVYLRSIVAMIYLIVTVVLSFFSALGAGWLLLHYGMGVPAIQGAIPLYAFVFLVALGEDYNIFMVSEIWKNRKTQNHLDAVKNGVIQTGSVITSAGLILAGTFAVLGTLPIQVLVQFGIVTAIGVLLDTFIVRPLLVPAITVVLGRFAFWP

SEQ ID NO: 1162 - protein, 678 aa, Bacillus anthracis str. Ames
LPETAMSQQAEALMKKEFPNNAGNPLLVVWYRDGGLQSQDYKLIQDVYKELKASPLKEQSTLPPFDTIPEQVLSKSASKDGTSFVTPVFFNKSAGTDILKENLDDLRNIVNSKVDEDPFKRKINDAGLHVRLSGPVGIQTDAVSLFSQADVKLLVATVLLVLVLLILLYRSPILAILPLLVVGFAYGIISPTLGFLADHGWIKVDAQAISIMTVLLFGAGTDYCLFLISRYREYLLEEESKYKALQLAIKASGGAIIMSALTVVLGLGTLLLAHYGAFHRFAVPFSVAVFIMGIAALTILPAFLLIFGRTAFFPFIPRTTSMNEELARRKKKVVKVKKSKGAFSKKLGDVVVRRPWTIIMLTVFVLGGLASFVPRIQYTYDLLESFPKDMPSREGFTLISDHFSAGELAPVKVIVDTKGKELPIKEELEKFSFVNTVKDPKEGKENKQIQMYEVSLAENPYSIEALDQIPKLKNSVEKVFKDAGISNAEDQLWIGGETASLYDTKQITERDEAVIIPVMISIIALLLLVYLRSIVAMIYLIVTVVLSFFSALGAGWLLLHYGMGAPAIQGAIPLYAFVFLVALGEDYNIFMVSEIWKNRKTQNHLDAVKNGVIQTGSVITSAGLILAGTFAVLGTLPIQVLVQFGIVTAIGVLLDTFIVRPLLVPAITVVLGRFAFWP

SEQ ID NO: 1163 - protein, 678 aa, Bacillus cereus AH820
LPETAMSQQAEALMKKEFPNNAGNPLLVVWYRDGGLQSQDYKLIQDVYKELKASPLKEQSTLPPFDTIPEQVLSKSASKDGTSFVTPVFFNKSAGTDILKGNLDDLRKIVNSKVDVDPFKQKISDSGLHVRLSGPVGIQTDAVSLFSQADVKLLIATVLLVLVLLILLYRSPILAILPLLVVGFAYGIISPTLGFLADYGWIKVDAQAISIMTVLLFGAGTDYCLFLISRYREYLLEEESKYKALQLAIKASGGAIIMSALTVVLGLGTLLLAHYGAFHRFAVPFSAAVFIMGIAALTILPAFLLIFGRTAFFPFIPRTTSMNEELARRKKKVVKVKKSKGAFSKKLGDVVVRRPWTIIMLTVFVLGGLASFVPRIQYTYDLLESFPKDMPSREGFTLISDHFSAGELAPVKVIVDTKGKELPIKEELEKFSFVNTVKDPKEGKENKQIQMYEVSLAENPYSIEALDQIPKLKNSVEKVFKDAGISNAEDQLWIGGETASLYDTKQITERDEAIIIPVMISIIALLLLVYLRSIVAMIYLIVTVVLSFFSALGAGWLLLHYGMGAPAIQGAIPLYAFVFLVALGEDYNIFMVSEIWKNRKTQNHLDAVKNGVIQTGSVITSAGLILAGTFAVLGTLPIQVLVQFGIVTAIGVLLDTFIVRPLLVPAITVVLGRFAFWP

SEQ ID NO: 1164 - protein, 712 aa, Artificial
  Substituion in SEQ ID NO 1157
MHRFEPKVRTWSRTWRAAAILGWLLAAALLAAVFPAASKEEIQRSTLLPASAPSQMATARVRDAFPASSGTPAILVFYDPTGISSADWAAIRRTVRELRTHPVTAQTQVPPLDALPSGAAARFASDDGKVVSFPVLLRADASQDQLNQAVDEIDQDLRRAVGAGALNLALDRPGLHAYVTGPAGIAVDATHLFQHADLALLIATTLLVLALMIVLYRSPILALVPLVSVGIAYAVVSSLLGAWARYGGLTFDAQTLSILTVLLFGAGTDYCLFLIARYRQELRRHERPIDALRAGYKSAAGAILMSGLTVSASLLSLLAARSPSFHEFAIPFSVAVFVMALVAITFVPALIGSLGRAAFWPRIPRYEPDAPDAGRPGRVSRWLGRTAVRRRKPVAVLGSLALAACCLALPHVRTSYDLLSSFPADMPSREGYAVLSAHESPGALAPIDVLVEGGSPEGAVRAVQSLAAVEQVHLVAVRDHAHVALMQVELRTNPYSETAMAALSSIERAAAKGASAGGQAAHVFLAGETAAQEDTRAITARDTRVVIPIVLVAIGLLLLVYLRSVVAPLYLLATIVLSYGAAMGLGWLVIREVLHQPAMQGAIPLYAFVFLVALGEDYNIFVMSRIWEVWRRGQADAAVERGVADTASVITSAGLILAGTFAMLASLPIQVLLQFGVVTAIGVLLDTFVVRPWMVPAITALLGDAARWPRRT

SEQ ID NO: 1165 - protein, 712 aa, Artificial
  Substituion in SEQ ID NO 1157
MHRFEPKVRTWSRTWRAAAILGWLLAAALLAAVFPAASKEEINRSTLLPASAPSQMATARVRDAFPASSGTPAILVFYDPTGISSADWAAIRRTVRELRTHPVTAQTQVPPLDALPSGAAARFASDDGKVVSFPVLLRADASQDQLNQAVDEIDQDLRRAVGAGALNLALDRPGLHAYVTGPAGIAVDATHLFQHADLALLIATTLLVLALMIVLYRSPILALVPLVSVGIAYAVVSSLLGAWARYGGLTFDAQTLSILTVLLFGAGTDYCLFLIARYRQELRRHERPIDALRAGYKSAAGAILMSGLTVSASLLSLLAARSPSFHEFAIPFSVAVFVMALVAITFVPALIGSLGRAAFWPRIPRYEPDAPDAGRPGRVSRWLGRTAVRRRKPVAVLGSLALAACCLALPHVRTSYDLLSSFPADMPSREGYAILSAHESPGALAPIDVLVEGGSPEGAVRAVQSLAAVEQVHLVAVRDHAHVALMQVELRTNPYSETAMAALSSIERAAAKGASAGGQAAHVFLAGETAAQEDTRAITARDTRVVIPIVLVAIGLLLLVYLRSVVAPLYLLATIVLSYGAAMGLGWLVIREVLHQPAMQGAIPLYAFVFLVALGEDYNIFVMSRIWEVWRRGQADAAVERGVADTASVITSAGLILAGTFAMLASLPIQVLLQFGVVTAIGVLLDTFVVRPWMVPAITALLGDAARWPRRT

SEQ ID NO: 1166 - protein, 712 aa, Artificial
  Substituion in SEQ ID NO 1157
MHRFEPKVRTWSRTWRAAAILGWLLAAALLAAVFPAASKEEINRSTLLPASAPSQMATARVRDAFPASSGTPAILVFYDPTGISSADWAAIRRTVRELRTHPVTAQTQVPPLDALPSGAAARFASDDGKVVSFPVLLRADASQDQLNQAVDEIDQDLRRAVGAGALNLALDRPGLHAYVTGPAGIAVDATHLFQHADLALLIATTLLVLALMIVLYRSPILALVPLVSVGIAYAVVSSLLGAWARYGGLTFDAQTLSILTVLLFGAGTDYCLFLIARYRQELRRHERPIDALRAGYKSAAGAILMSGLTVSASLLSLLAARSPSFHEFAIPFSVAVFVMALVAITFVPALIGSLGRAAFWPRIPRYEPDAPDAGRPGRVSRWLGRTAVRRRKPVAVLGSLALAACCLALPHVRTSYDLLSSFPADMPSREGYAVLSAHESPGALAPIDVLVEGGSPEGAVRAVQSLAAVENVHLVAVRDHAHVALMQVELRTNPYSETAMAALSSIERAAAKGASAGGQAAHVFLAGETAAQEDTRAITARDTRVVIPIVLVAIGLLLLVYLRSVVAPLYLLATIVLSYGAAMGLGWLVIREVLHQPAMQGAIPLYAFVFLVALGEDYNIFVMSRIWEVWRRGQADAAVERGVADTASVITSAGLILAGTFAMLASLPIQVLLQFGVVTAIGVLLDTFVVRPWMVPAITALLGDAARWPRRT

SEQ ID NO: 1167 - protein, 712 aa, Artificial
  Substituion in SEQ ID NO 1157
MHRFEPKVRTWSRTWRAAAILGWLLAAALLAAVFPAASKEEINRSTLLPASAPSQMATARVRDAFPASSGTPAILVFYDPTGISSADWAAIRRTVRELRTHPVTAQTQVPPLDALPSGAAARFASDDGKVVSFPVLLRAEASQDQLNQAVDEIDQDLRRAVGAGALNLALDRPGLHAYVTGPAGIAVDATHLFQHADLALLIATTLLVLALMIVLYRSPILALVPLVSVGIAYAVVSSLLGAWARYGGLTFDAQTLSILTVLLFGAGTDYCLFLIARYRQELRRHERPIDALRAGYKSAAGAILMSGLTVSASLLSLLAARSPSFHEFAIPFSVAVFVMALVAITFVPALIGSLGRAAFWPRIPRYEPDAPDAGRPGRVSRWLGRTAVRRRKPVAVLGSLALAACCLALPHVRTSYDLLSSFPADMPSREGYAVLSAHESPGALAPIDVLVEGGSPEGAVRAVQSLAAVEQVHLVAVRDHAHVALMQVELRTNPYSETAMAALSSIERAAAKGASAGGQAAHVFLAGETAAQEDTRAITARDTRVVIPIVLVAIGLLLLVYLRSVVAPLYLLATIVLSYGAAMGLGWLVIREVLHQPAMQGAIPLYAFVFLVALGEDYNIFVMSRIWEVWRRGQADAAVERGVADTASVITSAGLILAGTFAMLASLPIQVLLQFGVVTAIGVLLDTFVVRPWMVPAITALLGDAARWPRRT

SEQ ID NO: 1168 - protein, 712 aa, Artificial
  Substituion in SEQ ID NO 1157
MHRFEPKVRTWSRTWRAAAILGWLLAAALLAAVFPAASKEEINRSTLLPASAPSQMATARVRDAFPASSGTPAILVFYDPTGISSADWAAIRRTVRELRTHPVTAQTQVPPLDALPSGAAARFASDDGKVVSFPVLLRADASQDQLNQAVDEIDQDLRRAVGAGALNLALDRPGLHAYVTGPAGIAVDATHLFQHADLALLIATTLLVLALMIVLYRSPILALVPLVSVGIAYAVVSSLLGAWARYGGLTFDAQTLSILTVLLFGAGTDYCLFLIARYRQELRRHERPIDALRAGYKSAAGAILMSGLTVSASLLSLLAARSPSFHEFAIPFSVAVFVMALVAITFVPALIGSLGRAAFWPKIPRYEPDAPDAGRPGRVSRWLGRTAVRRRKPVAVLGSLALAACCLALPHVRTSYDLLSSFPADMPSREGYAVLSAHESPGALAPIDVLVEGGSPEGAVRAVQSLAAVEQVHLVAVRDHAHVALMQVELRTNPYSETAMAALSSIERAAAKGASAGGQAAHVFLAGETAAQEDTRAITARDTRVVIPIVLVAIGLLLLVYLRSVVAPLYLLATIVLSYGAAMGLGWLVIREVLHQPAMQGAIPLYAFVFLVALGEDYNIFVMSRIWEVWRRGQADAAVERGVADTASVITSAGLILAGTFAMLASLPIQVLLQFGVVTAIGVLLDTFVVRPWMVPAITALLGDAARWPRRT

SEQ ID NO: 1169 - DNA, 2139 bp, Artificial
  Substituion in SEQ ID NO 1158
ttgcatcgattcgaaccgaaagtccgaacgtggagccggacctggcgcgcggcggctatcctcggatggctcctcgccgctgccttgctcgccgcggtcttccccgcggcgtccaaagaggagatccaacgctccacgcttctgcccgcctcggctcccagccagatggcaaccgcccgagtgcgggatgcgttccccgcatcgtccggcacgcccgccatcctcgtcttctacgatccgaccggcatctcctccgccgattgggctgccattcgccggaccgtccgcgaacttcgcacgcatcccgtgacggcacaaacgcaggtgcccccgctcgatgcgctcccgtccggagctgcggcgcgcttcgcctcggatgacggcaaagtggtgagcttccccgtgctcctgcgcgcggacgcatcgcaggaccagctgaatcaagccgtggacgagatcgatcaggacctccgccgcgccgtcggcgccggcgcgctcaatctcgcactggaccgtcccggcctgcacgcctacgtgacagggccagcaggcattgcagtcgacgccacgcatctgttccagcacgccgatctcgccctgctcatcgccacgacgctgctcgtgctggcactcatgatcgttctgtaccgctcgcccatcctggccttggtgccgctcgtgagcgtcgggatcgcatacgccgtcgtgagctcgctgcttggcgcgtgggcgcgttacgggggcctgaccttcgacgcgcagaccctgtctatcctgacggtgctactgtttggcgccggaacggattactgcctgttcctcatcgcccgctaccgccaggagctgcggcgtcatgagcggccgatcgacgccttgcgcgctggctacaaaagcgcggcaggtgccattctgatgagcggcctgacggtgtccgcttcgcttctgtcactgttggcggcgcgatcgccgtcctttcacgagttcgcgatccccttcagcgtcgcggtattcgtgatggccctcgtcgccatcaccttcgtgccggcgctcattggctcgcttgggcgcgcggcgttttggccacgaattccccgctatgaaccagatgcgccggacgcagggcggccagggcgcgtctcgcgctggctcgggcggacagcggtgcggcggcgcaagccggtggccgtccttggctcgctcgccctcgccgcctgctgcctcgccctgccacacgtgcgcacgagctacgatctgctctcgtccttcccggcggacatgccttcgcgcgaaggctacgccgtgctgtcggcccacgagagcccaggcgcgctcgcgcccatcgacgtgctggtcgagggcgggagccccgaaggtgccgtccgcgccgtgcaatcgctcgccgccgtcgagcaggtgcacctggtggcggtccgtgaccatgcccacgtggccttgatgcaggtggagctgcgaacgaacccctatagcgaaaccgccatggcggcgctgtcatccatcgagcgagctgcggccaagggcgcttcagcgggtgggcaagccgcgcacgtcttcctggccggcgaaaccgccgctcaagaagacacgcgagcgatcacggctcgagacacgcgggtggtcatccccattgtgcttgtcgccattgggctcctcctgctcgtctatttgcggtcggtcgtcgcgccgctctatctcctcgcgaccatcgtgctctcctacggcgccgccatgggccttggttggctcgtgattcgtgaggtcctccatcagcccgccatgcagggggctatcccgctttacgcgttcgtctttctagtggcactcggcgaagattacaacatcttcgtcatgtcgcgcatctgggaggtctggcgccggggacaggctgacgccgccgtggaacggggcgtcgccgacacggcaagcgtcattacttctgccggcctcatcctggcaggcacgtttgccatgctcgcgtccctgccgattcaggtcctgcttcagttcggcgtcgtcacggccatcggcgtgctgctggacaccttcgtggtgcggccttggatggtccccgccatcaccgcgcttctcggagacgcggcgcggtggccgaggcgcacctag

SEQ ID NO: 1170 - DNA, 2139 bp, Artificial
  Substituion in SEQ ID NO 1158
ttgcatcgattcgaaccgaaagtccgaacgtggagccggacctggcgcgcggcggctatcctcggatggctcctcgccgctgccttgctcgccgcggtcttccccgcggcgtccaaagaggagatcaaccgctccacgcttctgcccgcctcggctcccagccagatggcaaccgcccgagtgcgggatgcgttccccgcatcgtccggcacgcccgccatcctcgtcttctacgatccgaccggcatctcctccgccgattgggctgccattcgccggaccgtccgcgaacttcgcacgcatcccgtgacggcacaaacgcaggtgcccccgctcgatgcgctcccgtccggagctgcggcgcgcttcgcctcggatgacggcaaagtggtgagcttccccgtgctcctgcgcgcggacgcatcgcaggaccagctgaatcaagccgtggacgagatcgatcaggacctccgccgcgccgtcggcgccggcgcgctcaatctcgcactggaccgtcccggcctgcacgcctacgtgacagggccagcaggcattgcagtcgacgccacgcatctgttccagcacgccgatctcgccctgctcatcgccacgacgctgctcgtgctggcactcatgatcgttctgtaccgctcgcccatcctggccttggtgccgctcgtgagcgtcgggatcgcatacgccgtcgtgagctcgctgcttggcgcgtgggcgcgttacgggggcctgaccttcgacgcgcagaccctgtctatcctgacggtgctactgtttggcgccggaacggattactgcctgttcctcatcgcccgctaccgccaggagctgcggcgtcatgagcggccgatcgacgccttgcgcgctggctacaaaagcgcggcaggtgccattctgatgagcggcctgacggtgtccgcttcgcttctgtcactgttggcggcgcgatcgccgtcctttcacgagttcgcgatccccttcagcgtcgcggtattcgtgatggccctcgtcgccatcaccttcgtgccggcgctcattggctcgcttgggcgcgcggcgttttggccacgaattccccgctatgaaccagatgcgccggacgcagggcggccagggcgcgtctcgcgctggctcgggcggacagcggtgcggcggcgcaagccggtggccgtccttggctcgctcgccctcgccgcctgctgcctcgccctgccacacgtgcgcacgagctacgatctgctctcgtccttcccggcggacatgccttcgcgcgaaggctacgccattctgtcggcccacgagagcccaggcgcgctcgcgcccatcgacgtgctggtcgagggcgggagccccgaaggtgccgtccgcgccgtgcaatcgctcgccgccgtcgagcaggtgcacctggtggcggtccgtgaccatgcccacgtggccttgatgcaggtggagctgcgaacgaacccctatagcgaaaccgccatggcggcgctgtcatccatcgagcgagctgcggccaagggcgcttcagcgggtgggcaagccgcgcacgtcttcctggccggcgaaaccgccgctcaagaagacacgcgagcgatcacggctcgagacacgcgggtggtcatccccattgtgcttgtcgccattgggctcctcctgctcgtctatttgcggtcggtcgtcgcgccgctctatctcctcgcgaccatcgtgctctcctacggcgccgccatgggccttggttggctcgtgattcgtgaggtcctccatcagcccgccatgcagggggctatcccgctttacgcgttcgtctttctagtggcactcggcgaagattacaacatcttcgtcatgtcgcgcatctgggaggtctggcgccggggacaggctgacgccgccgtggaacggggcgtcgccgacacggcaagcgtcattacttctgccggcctcatcctggcaggcacgtttgccatgctcgcgtccctgccgattcaggtcctgcttcagttcggcgtcgtcacggccatcggcgtgctgctggacaccttcgtggtgcggccttggatggtccccgccatcaccgcgcttctcggagacgcggcgcggtggccgaggcgcacctag

SEQ ID NO: 1171 - DNA, 2139 bp, Artificial
  Substituion in SEQ ID NO 1158
ttgcatcgattcgaaccgaaagtccgaacgtggagccggacctggcgcgcggcggctatcctcggatggctcctcgccgctgccttgctcgccgcggtcttccccgcggcgtccaaagaggagatcaaccgctccacgcttctgcccgcctcggctcccagccagatggcaaccgcccgagtgcgggatgcgttccccgcatcgtccggcacgcccgccatcctcgtcttctacgatccgaccggcatctcctccgccgattgggctgccattcgccggaccgtccgcgaacttcgcacgcatcccgtgacggcacaaacgcaggtgcccccgctcgatgcgctcccgtccggagctgcggcgcgcttcgcctcggatgacggcaaagtggtgagcttccccgtgctcctgcgcgcggacgcatcgcaggaccagctgaatcaagccgtggacgagatcgatcaggacctccgccgcgccgtcggcgccggcgcgctcaatctcgcactggaccgtcccggcctgcacgcctacgtgacagggccagcaggcattgcagtcgacgccacgcatctgttccagcacgccgatctcgccctgctcatcgccacgacgctgctcgtgctggcactcatgatcgttctgtaccgctcgcccatcctggccttggtgccgctcgtgagcgtcgggatcgcatacgccgtcgtgagctcgctgcttggcgcgtgggcgcgttacgggggcctgaccttcgacgcgcagaccctgtctatcctgacggtgctactgtttggcgccggaacggattactgcctgttcctcatcgcccgctaccgccaggagctgcggcgtcatgagcggccgatcgacgccttgcgcgctggctacaaaagcgcggcaggtgccattctgatgagcggcctgacggtgtccgcttcgcttctgtcactgttggcggcgcgatcgccgtcctttcacgagttcgcgatccccttcagcgtcgcggtattcgtgatggccctcgtcgccatcaccttcgtgccggcgctcattggctcgcttgggcgcgcggcgttttggccacgaattccccgctatgaaccagatgcgccggacgcagggcggccagggcgcgtctcgcgctggctcgggcggacagcggtgcggcggcgcaagccggtggccgtccttggctcgctcgccctcgccgcctgctgcctcgccctgccacacgtgcgcacgagctacgatctgctctcgtccttcccggcggacatgccttcgcgcgaaggctacgccgtgctgtcggcccacgagagcccaggcgcgctcgcgcccatcgacgtgctggtcgagggcgggagccccgaaggtgccgtccgcgccgtgcaatcgctcgccgccgtcgagaatgtgcacctggtggcggtccgtgaccatgcccacgtggccttgatgcaggtggagctgcgaacgaacccctatagcgaaaccgccatggcggcgctgtcatccatcgagcgagctgcggccaagggcgcttcagcgggtgggcaagccgcgcacgtcttcctggccggcgaaaccgccgctcaagaagacacgcgagcgatcacggctcgagacacgcgggtggtcatccccattgtgcttgtcgccattgggctcctcctgctcgtctatttgcggtcggtcgtcgcgccgctctatctcctcgcgaccatcgtgctctcctacggcgccgccatgggccttggttggctcgtgattcgtgaggtcctccatcagcccgccatgcagggggctatcccgctttacgcgttcgtctttctagtggcactcggcgaagattacaacatcttcgtcatgtcgcgcatctgggaggtctggcgccggggacaggctgacgccgccgtggaacggggcgtcgccgacacggcaagcgtcattacttctgccggcctcatcctggcaggcacgtttgccatgctcgcgtccctgccgattcaggtcctgcttcagttcggcgtcgtcacggccatcggcgtgctgctggacaccttcgtggtgcggccttggatggtccccgccatcaccgcgcttctcggagacgcggcgcggtggccgaggcgcacctag

SEQ ID NO: 1172 - DNA, 2139 bp, Artificial
  Substituion in SEQ ID NO 1158
ttgcatcgattcgaaccgaaagtccgaacgtggagccggacctggcgcgcggcggctatcctcggatggctcctcgccgctgccttgctcgccgcggtcttccccgcggcgtccaaagaggagatcaaccgctccacgcttctgcccgcctcggctcccagccagatggcaaccgcccgagtgcgggatgcgttccccgcatcgtccggcacgcccgccatcctcgtcttctacgatccgaccggcatctcctccgccgattgggctgccattcgccggaccgtccgcgaacttcgcacgcatcccgtgacggcacaaacgcaggtgcccccgctcgatgcgctcccgtccggagctgcggcgcgcttcgcctcggatgacggcaaagtggtgagcttccccgtgctcctgcgcgcggaagcatcgcaggaccagctgaatcaagccgtggacgagatcgatcaggacctccgccgcgccgtcggcgccggcgcgctcaatctcgcactggaccgtcccggcctgcacgcctacgtgacagggccagcaggcattgcagtcgacgccacgcatctgttccagcacgccgatctcgccctgctcatcgccacgacgctgctcgtgctggcactcatgatcgttctgtaccgctcgcccatcctggccttggtgccgctcgtgagcgtcgggatcgcatacgccgtcgtgagctcgctgcttggcgcgtgggcgcgttacgggggcctgaccttcgacgcgcagaccctgtctatcctgacggtgctactgtttggcgccggaacggattactgcctgttcctcatcgcccgctaccgccaggagctgcggcgtcatgagcggccgatcgacgccttgcgcgctggctacaaaagcgcggcaggtgccattctgatgagcggcctgacggtgtccgcttcgcttctgtcactgttggcggcgcgatcgccgtcctttcacgagttcgcgatccccttcagcgtcgcggtattcgtgatggccctcgtcgccatcaccttcgtgccggcgctcattggctcgcttgggcgcgcggcgttttggccacgaattccccgctatgaaccagatgcgccggacgcagggcggccagggcgcgtctcgcgctggctcgggcggacagcggtgcggcggcgcaagccggtggccgtccttggctcgctcgccctcgccgcctgctgcctcgccctgccacacgtgcgcacgagctacgatctgctctcgtccttcccggcggacatgccttcgcgcgaaggctacgccgtgctgtcggcccacgagagcccaggcgcgctcgcgcccatcgacgtgctggtcgagggcgggagccccgaaggtgccgtccgcgccgtgcaatcgctcgccgccgtcgagcaggtgcacctggtggcggtccgtgaccatgcccacgtggccttgatgcaggtggagctgcgaacgaacccctatagcgaaaccgccatggcggcgctgtcatccatcgagcgagctgcggccaagggcgcttcagcgggtgggcaagccgcgcacgtcttcctggccggcgaaaccgccgctcaagaagacacgcgagcgatcacggctcgagacacgcgggtggtcatccccattgtgcttgtcgccattgggctcctcctgctcgtctatttgcggtcggtcgtcgcgccgctctatctcctcgcgaccatcgtgctctcctacggcgccgccatgggccttggttggctcgtgattcgtgaggtcctccatcagcccgccatgcagggggctatcccgctttacgcgttcgtctttctagtggcactcggcgaagattacaacatcttcgtcatgtcgcgcatctgggaggtctggcgccggggacaggctgacgccgccgtggaacggggcgtcgccgacacggcaagcgtcattacttctgccggcctcatcctggcaggcacgtttgccatgctcgcgtccctgccgattcaggtcctgcttcagttcggcgtcgtcacggccatcggcgtgctgctggacaccttcgtggtgcggccttggatggtccccgccatcaccgcgcttctcggagacgcggcgcggtggccgaggcgcacctag

SEQ ID NO: 1173 - DNA, 2139 bp, Artificial
  Substituion in SEQ ID NO 1158
ttgcatcgattcgaaccgaaagtccgaacgtggagccggacctggcgcgcggcggctatcctcggatggctcctcgccgctgccttgctcgccgcggtcttccccgcggcgtccaaagaggagatcaaccgctccacgcttctgcccgcctcggctcccagccagatggcaaccgcccgagtgcgggatgcgttccccgcatcgtccggcacgcccgccatcctcgtcttctacgatccgaccggcatctcctccgccgattgggctgccattcgccggaccgtccgcgaacttcgcacgcatcccgtgacggcacaaacgcaggtgcccccgctcgatgcgctcccgtccggagctgcggcgcgcttcgcctcggatgacggcaaagtggtgagcttccccgtgctcctgcgcgcggacgcatcgcaggaccagctgaatcaagccgtggacgagatcgatcaggacctccgccgcgccgtcggcgccggcgcgctcaatctcgcactggaccgtcccggcctgcacgcctacgtgacagggccagcaggcattgcagtcgacgccacgcatctgttccagcacgccgatctcgccctgctcatcgccacgacgctgctcgtgctggcactcatgatcgttctgtaccgctcgcccatcctggccttggtgccgctcgtgagcgtcgggatcgcatacgccgtcgtgagctcgctgcttggcgcgtgggcgcgttacgggggcctgaccttcgacgcgcagaccctgtctatcctgacggtgctactgtttggcgccggaacggattactgcctgttcctcatcgcccgctaccgccaggagctgcggcgtcatgagcggccgatcgacgccttgcgcgctggctacaaaagcgcggcaggtgccattctgatgagcggcctgacggtgtccgcttcgcttctgtcactgttggcggcgcgatcgccgtcctttcacgagttcgcgatccccttcagcgtcgcggtattcgtgatggccctcgtcgccatcaccttcgtgccggcgctcattggctcgcttgggcgcgcggcgttttggccaaaaattccccgctatgaaccagatgcgccggacgcagggcggccagggcgcgtctcgcgctggctcgggcggacagcggtgcggcggcgcaagccggtggccgtccttggctcgctcgccctcgccgcctgctgcctcgccctgccacacgtgcgcacgagctacgatctgctctcgtccttcccggcggacatgccttcgcgcgaaggctacgccgtgctgtcggcccacgagagcccaggcgcgctcgcgcccatcgacgtgctggtcgagggcgggagccccgaaggtgccgtccgcgccgtgcaatcgctcgccgccgtcgagcaggtgcacctggtggcggtccgtgaccatgcccacgtggccttgatgcaggtggagctgcgaacgaacccctatagcgaaaccgccatggcggcgctgtcatccatcgagcgagctgcggccaagggcgcttcagcgggtgggcaagccgcgcacgtcttcctggccggcgaaaccgccgctcaagaagacacgcgagcgatcacggctcgagacacgcgggtggtcatccccattgtgcttgtcgccattgggctcctcctgctcgtctatttgcggtcggtcgtcgcgccgctctatctcctcgcgaccatcgtgctctcctacggcgccgccatgggccttggttggctcgtgattcgtgaggtcctccatcagcccgccatgcagggggctatcccgctttacgcgttcgtctttctagtggcactcggcgaagattacaacatcttcgtcatgtcgcgcatctgggaggtctggcgccggggacaggctgacgccgccgtggaacggggcgtcgccgacacggcaagcgtcattacttctgccggcctcatcctggcaggcacgtttgccatgctcgcgtccctgccgattcaggtcctgcttcagttcggcgtcgtcacggccatcggcgtgctgctggacaccttcgtggtgcggccttggatggtccccgccatcaccgcgcttctcggagacgcggcgcggtggccgaggcgcacctag

SEQ ID NO: 1174 - protein, 207 aa, Alicyclobacillus acidocaldarius
MRNARSRRPGRPPQVEMEEPTAEKILRAAAECFMDQGFAAVSMDDVAERAGVTKAVVYYYYGSKTELFQRAMMEVMRASRERTQAILRENGPLRERLQKLTRTRLAIPATLDMNHILRGSQRALRPDQVDEMHRAEEQLVEVIAQELHAEMEQGRLRPVDAMFVARSYLALLGMGQAEIRRRGGGQAAIDEIAEEIVDLLWRGIEPR

SEQ ID NO: 1175 - DNA, 624 bp, Alicyclobacillus acidocaldarius
atgcggaacgcgaggagccggcgacctgggcgcccgccgcaggtggagatggaggagccgacggctgaaaaaattctccgcgcggctgctgagtgcttcatggatcagggattcgcggcggtttcgatggacgacgtcgcggaacgagctggcgtcacgaaggctgtcgtgtattactattatggttccaagacggagctgtttcagcgcgcgatgatggaggtcatgcgcgcttcccgcgagcgcacgcaggccattctgcgcgagaacgggccgctgcgcgagcggctgcagaagctcacgcggacccgccttgccattccagcgacgctcgacatgaaccacatccttcggggcagtcaacgcgcgcttcgcccggaccaagtggacgagatgcacagagcggaagagcagctggtggaagtcatcgcccaagaattgcacgcggagatggaacaggggcgcttgcggccggtggacgccatgttcgtggcgcgctcgtacctcgcgcttctcggcatggggcaggcggagatccggcgtcgcggtggaggacaagccgccatcgacgagattgcggaagaaatcgtggatctgctgtggcgcgggattgagccgcggtga

SEQ ID NO: 1176 - protein, 200 aa, Bacillus cereus ATCC 14579
KQRPLGRPRQNKNTKSTKENILEVATRLFLTQNYQVVSMDEVAKVCGVTKATVYYYYSTKADLFTATMIEMMVRIRENMSQILSTNKTLEERLLDFAKVYLHATMDIDMKNFMKDAKLSLSEEQLKQLKNAEDNMYEVLEKALDNAMHIGEIPKGNAKFAAHAFVSLLSIGNFKDENHNPILANIDELAQEIVSFYWNGL

SEQ ID NO: 1177 - protein, 200 aa, Bacillus thuringiensis str. Al Hakam
KQRPLGRPRQNKNTKSTKETILEVATRLFLTQNYQGVSMDEVAKVCGVTKATVYYYFSTKADLFTATMIQMMIRIRENMSQILSTNNTLEERLLNFAKVYLHATMDIDMKNFMKDAKLSLSEEQLKELKKAEDSMYEVLEKALDKAMQLGEIQKGNPKFAAHAFVSLLSIGNFKDENDNPIIVSIDELAQEIVSFYWNGL

SEQ ID NO: 1178 - protein, 200 aa, Bacillus anthracis str. A0488
KQRPLGRPRQNKNTKSTKETILEVATRLFLTQNYQVVSMDEVAKVCGVTKATVYYYFSTKADLFTATMIQMMIRIRENMSQILSTNNTLEERLLNFAKVYLHATMDIDMKNFMKDAKLSLSEEQLKELKKAEDSMYEVLEKALDKAMQLGEIQKGNPKFAAHAFVSLLSIGNFKDENDNPIIISIDELAQEIVSFYWNGL

SEQ ID NO: 1179 - protein, 200 aa, Bacillus cereus ATCC 10987
KQRPLGRPRQNKNTKSTKETILEVATRLFLTQNYQVVSMDEVAKVCGVTKATVYYYYSTKADLFTATMIQMMVRIRENMFQILSTNKTLKERLLDFAKVYLHATMDIDMKNFMKDAKLSLSEEQLKQLKHAEDNMYEVLEKALDNAMQIGEIPKGNAKFVAHAFVSLLSIGNFKDENHNPILTNIDELAQEIVSFYWNGL

SEQ ID NO: 1180 - protein, 200 aa, Bacillus anthracis str. Ames; identical to SEQ ID NO: 1178

SEQ ID NO: 1181 - protein, 207 aa, Artificial
  Substituion in SEQ ID NO 1174
MRNARSRRPGRPPQVEMEEPTAEKILRAAAECFMDQGFAAVSMDDVAERAGVTKAVVYYYYGSKTELFQRAMMEVMRASRERTQAILRENGPLRERLQKLTRTRLAIPATLDMNHILRGSQRALRPDQVDEMHRAEEQLVEVIAQELHAEMEQGRLRPVDAMFVARSYLALLGMGQAELRRRGGGQAAIDEIAEEIVDLLWRGIEPR

SEQ ID NO: 1182 - protein, 207 aa, Artificial
  Substituion in SEQ ID NO 1174
MRNARSRRPGRPPQVEMEEPTAEKILRAAAECFMDQGFAAVSMDDVAERAGVTKAVVYYYYGSKTELFQRAMMEVMRASRERTQAILRENGPLRERLQKLTRTRLAIPATLDMNHILRGSQRALRPDQVDDMHRAEEQLVEVIAQELHAEMEQGRLRPVDAMFVARSYLALLGMGQAEIRRRGGGQAAIDEIAEEIVDLLWRGIEPR

SEQ ID NO: 1183 - protein, 207 aa, Artificial
  Substituion in SEQ ID NO 1174
MRNARSRRPGRPPQVEMEEPTAEKILRAAAECFMDQGFAAVSMDDVAERAGVTKAVVYYYYGSKTELFQRAMMEVMKASRERTQAILRENGPLRERLQKLTRTRLAIPATLDMNHILRGSQRALRPDQVDEMHRAEEQLVEVIAQELHAEMEQGRLRPVDAMFVARSYLALLGMGQAEIRRRGGGQAAIDEIAEEIVDLLWRGIEPR

SEQ ID NO: 1184 - protein, 207 aa, Artificial
  Substituion in SEQ ID NO 1174
MRNARSRRPGRPPQVEMEEPTAEKILRAAAECFMDQGFAAVSMDDVAERAGVTKAVVYYYYGSKTELFQRAMMDVMRASRERTQAILRENGPLRERLQKLTRTRLAIPATLDMNHILRGSQRALRPDQVDEMHRAEEQLVEVIAQELHAEMEQGRLRPVDAMFVARSYLALLGMGQAEIRRRGGGQAAIDEIAEEIVDLLWRGIEPR

SEQ ID NO: 1185 - protein, 207 aa, Artificial
  Substituion in SEQ ID NO 1174
MRNARSRRPGRPPQVEMEEPTAEKILRAAAECFMDQGFAAVSMDDVAERAGVTKAVVYYYYGSKTELFQRAMMEVMRASRERTQAILRENGPLKERLQKLTRTRLAIPATLDMNHILRGSQRALRPDQVDEMHRAEEQLVEVIAQELHAEMEQGRLRPVDAMFVARSYLALLGMGQAEIRRRGGGQAAIDEIAEEIVDLLWRGIEPR

SEQ ID NO: 1186 - DNA, 624 bp, Artificial
  Substituion in SEQ ID NO 1175
atgcggaacgcgaggagccggcgacctgggcgcccgccgcaggtggagatggaggagccgacggctgaaaaaattctccgcgcggctgctgagtgcttcatggatcagggattcgcggcggtttcgatggacgacgtcgcggaacgagctggcgtcacgaaggctgtcgtgtattactattatggttccaagacggagctgtttcagcgcgcgatgatggaggtcatgcgcgcttcccgcgagcgcacgcaggccattctgcgcgagaacgggccgctgcgcgagcggctgcagaagctcacgcggacccgccttgccattccagcgacgctcgacatgaaccacatccttcggggcagtcaacgcgcgcttcgcccggaccaagtggacgagatgcacagagcggaagagcagctggtggaagtcatcgcccaagaattgcacgcggagatggaacaggggcgcttgcggccggtggacgccatgttcgtggcgcgctcgtacctcgcgcttctcggcatggggcaggcggagttacggcgtcgcggtggaggacaagccgccatcgacgagattgcggaagaaatcgtggatctgctgtggcgcgggattgagccgcggtga

SEQ ID NO: 1187 - DNA, 624 bp, Artificial
  Substituion in SEQ ID NO 1175
atgcggaacgcgaggagccggcgacctgggcgcccgccgcaggtggagatggaggagccgacggctgaaaaaattctccgcgcggctgctgagtgcttcatggatcagggattcgcggcggtttcgatggacgacgtcgcggaacgagctggcgtcacgaaggctgtcgtgtattactattatggttccaagacggagctgtttcagcgcgcgatgatggaggtcatgcgcgcttcccgcgagcgcacgcaggccattctgcgcgagaacgggccgctgcgcgagcggctgcagaagctcacgcggacccgccttgccattccagcgacgctcgacatgaaccacatccttcggggcagtcaacgcgcgcttcgcccggaccaagtggacgatatgcacagagcggaagagcagctggtggaagtcatcgcccaagaattgcacgcggagatggaacaggggcgcttgcggccggtggacgccatgttcgtggcgcgctcgtacctcgcgcttctcggcatggggcaggcggagatccggcgtcgcggtggaggacaagccgccatcgacgagattgcggaagaaatcgtggatctgctgtggcgcgggattgagccgcggtga

SEQ ID NO: 1188 - DNA, 624 bp, Artificial
  Substituion in SEQ ID NO 1175
atgcggaacgcgaggagccggcgacctgggcgcccgccgcaggtggagatggaggagccgacggctgaaaaaattctccgcgcggctgctgagtgcttcatggatcagggattcgcggcggtttcgatggacgacgtcgcggaacgagctggcgtcacgaaggctgtcgtgtattactattatggttccaagacggagctgtttcagcgcgcgatgatggaggtcatgaaagcttcccgcgagcgcacgcaggccattctgcgcgagaacgggccgctgcgcgagcggctgcagaagctcacgcggacccgccttgccattccagcgacgctcgacatgaaccacatccttcggggcagtcaacgcgcgcttcgcccggaccaagtggacgagatgcacagagcggaagagcagctggtggaagtcatcgcccaagaattgcacgcggagatggaacaggggcgcttgcggccggtggacgccatgttcgtggcgcgctcgtacctcgcgcttctcggcatggggcaggcggagatccggcgtcgcggtggaggacaagccgccatcgacgagattgcggaagaaatcgtggatctgctgtggcgcgggattgagccgcggtga

SEQ ID NO: 1189 - DNA, 624 bp, Artificial
  Substituion in SEQ ID NO 1175
atgcggaacgcgaggagccggcgacctgggcgcccgccgcaggtggagatggaggagccgacggctgaaaaaattctccgcgcggctgctgagtgcttcatggatcagggattcgcggcggtttcgatggacgacgtcgcggaacgagctggcgtcacgaaggctgtcgtgtattactattatggttccaagacggagctgtttcagcgcgcgatgatggatgtcatgcgcgcttcccgcgagcgcacgcaggccattctgcgcgagaacgggccgctgcgcgagcggctgcagaagctcacgcggacccgccttgccattccagcgacgctcgacatgaaccacatccttcggggcagtcaacgcgcgcttcgcccggaccaagtggacgagatgcacagagcggaagagcagctggtggaagtcatcgcccaagaattgcacgcggagatggaacaggggcgcttgcggccggtggacgccatgttcgtggcgcgctcgtacctcgcgcttctcggcatggggcaggcggagatccggcgtcgcggtggaggacaagccgccatcgacgagattgcggaagaaatcgtggatctgctgtggcgcgggattgagccgcggtga

SEQ ID NO: 1190 - DNA, 624 bp, Artificial
  Substituion in SEQ ID NO 1175
atgcggaacgcgaggagccggcgacctgggcgcccgccgcaggtggagatggaggagccgacggctgaaaaaattctccgcgcggctgctgagtgcttcatggatcagggattcgcggcggtttcgatggacgacgtcgcggaacgagctggcgtcacgaaggctgtcgtgtattactattatggttccaagacggagctgtttcagcgcgcgatgatggaggtcatgcgcgcttcccgcgagcgcacgcaggccattctgcgcgagaacgggccgctgaaagagcggctgcagaagctcacgcggacccgccttgccattccagcgacgctcgacatgaaccacatccttcggggcagtcaacgcgcgcttcgcccggaccaagtggacgagatgcacagagcggaagagcagctggtggaagtcatcgcccaagaattgcacgcggagatggaacaggggcgcttgcggccggtggacgccatgttcgtggcgcgctcgtacctcgcgcttctcggcatggggcaggcggagatccggcgtcgcggtggaggacaagccgccatcgacgagattgcggaagaaatcgtggatctgctgtggcgcgggattgagccgcggtga

SEQ ID NO: 1191 - protein, 234 aa, Alicyclobacillus acidocaldarius
MERRSVTAIQRSEPLVKQVYKYLYHAILSGEFRPRDKVVETHIAERLQVSRSPVREAIRLLIQRDLLVEDADGVRVFQPTQRDFAELYEMRLALEPVAAERAAENAHSTCVAALHENVKQTEQALALGDWDSIVALNKEFHECIWQMSGNRRILKAMQEITDLVQFYWRALLDIPNLDIQIVGDHQQIVQYIERRDSAGAHTAMKQHVAKDLRVISERFRDAKNAFKEQILDEA

SEQ ID NO: 1192 - DNA, 705 bp, Alicyclobacillus acidocaldarius
atggagaggcgatctgtgacggccattcagcggagcgagcctttggtcaagcaagtgtacaagtatctctaccacgccatcttgtcgggggaatttcgtcctcgtgacaaggtggtggagactcacattgcggaaaggcttcaagtcagtcgaagccccgttcgcgaagcgataagacttctgatccaacgggatcttcttgtggaggatgcggacggagttcgagtatttcaacctacgcagcgcgacttcgcggaactgtatgagatgaggctcgcccttgaaccggtggcagctgagcgtgctgccgagaacgcgcattcgacttgtgttgctgcgcttcatgagaacgttaaacaaactgaacaggcgcttgccctcggagactgggacagcattgtggcactcaacaaggagttccacgaatgcatatggcagatgtctgggaatcgaaggattctcaaagctatgcaggaaattaccgatctcgtccagttctattggcgagcacttctcgacatccctaatctggatattcaaatcgtgggagaccaccagcaaatcgtccaatacattgaaaggagggattctgctggagcacataccgctatgaagcaacacgtagccaaagatcttagggtcatatcagaacgctttcgagacgcaaagaatgcctttaaagaacaaatcttagatgaagcttaa

SEQ ID NO: 1193 - protein, 214 aa, Bacillus licheniformis ATCC 14580
SIQRAVSYHDQVHHYLKDMIIKGGYQPGERIYESKIAKELQVSRSPVREAIRTLEQEGLLLIDDKSKITVYEPTIKDLEEIYQCRQALESLAVSLATRLASNETLELISETLSEAHKHQKSQGPESANALLRLNTQFHDAIIEASENERLQKQLLDLRSLTFFYRSKNLEKPERTLEIINQHEEILRHMQDRNDAKAAESMRKHIEADLCYLKE

SEQ ID NO: 1194 - protein, 205 aa, Rubrobacter xylanophilus DSM 9941
LRRPEPLYRQVYEVLRRRILAGEYGAGEVLQESRAAEELRVSRTPVREALRQLEREGLLVARGTERVVADPSREEFVDLYTCRAALEGLVAERAARLAEEEELREMEEALEEARRAVAAGDHGGVLSANTRFHDLMVRSARMPPLERLMDTLRGQILVARRHILSDERIEAEICEEHASILEAIRRRDVGAARERMQRHMQNDIR

SEQ ID NO: 1195 - protein, 206 aa, Bacillus clausii KSM-K16
VERPIPYYEQFYHSIKKMIFTGHFKPGDRIVETQLAKEFNVSKSPIREAIRILEKEGLVIVDEKSRVIVYKPTQKDVEEVYFCRMALESFAVSEATKIASDEDIHELEKLLIRTDQAISSKKEEDRIISLNELFHSTIIDYTKNLRLKKQINDLKALIYYFRILNFQGDNRANVILEQHYRIFEFIKKRDPEKAAKAMISHLELDL

SEQ ID NO: 1196 - protein, 209 aa, Clostridium beijerinckii NCIMB 8052
IEKAPSYYDQAYNSIKAMIFNGILKPGDRIYESKLASEFQISRSPVREAIRSLEKDGLLVIGDKSKITIYKPTKEDIENIYECRQALESQAAKLTTLKASNKELDKIEKILLEIKKNIDNFDDTLTKNIIELNTKFHDLILDFSQNNHLKKLSKDLSSLTYFYRSIDVYEPERNIDIFNHHLEIFNYIKQRDEEKAYKAMYNHIDNDLK

SEQ ID NO: 1197 - protein, 211 aa, Desulfitobacterium hafniense Y51
MSAITKSLPFHLQIYEILKGKILNGEISRGERLYENKISQELGVSRSPVREALRMLEQDELVVVTSTGLIVNPMEFSDMEEIYQCRMALEPFAAKISADKLTNEDLAALRNLVIQARVYHNQKAYEKVVESNTQFHDIIIQSSGNSRLIGIIEKIRSLIILSRKTEFECYQREEGYLDEHEGVLEALTQRNGDEAERLLRIHIMNDFEFYS

SEQ ID NO: 1198 - protein, 234 aa, Artificial
  Substituion in SEQ ID NO 1191
MERRSVTAIQRSEPLVKQVYKYLYHAILSGEFRPRDKVVETHIAERLQVSRSPVREAIRLLIQRDLLVEDADGVRVFQPTQRDFAELYEMRLALEPVAAERAAENAHSTCVAALHENVKQTEQALALGDWDSIVALNKEFHECIWQMSGNRRILKAMQDITDLVQFYWRALLDIPNLDIQIVGDHQQIVQYIERRDSAGAHTAMKQHVAKDLRVISERFRDAKNAFKEQILDEA

SEQ ID NO: 1199 - protein, 234 aa, Artificial
  Substituion in SEQ ID NO 1191
MERRSVTAIQRSEPLVKQVYKYLYHAILSGEFRPRDKVVETHIAERLQVSRSPVREAIRLLIQRDLLVEDADGIRVFQPTQRDFAELYEMRLALEPVAAERAAENAHSTCVAALHENVKQTEQALALGDWDSIVALNKEFHECIWQMSGNRRILKAMQEITDLVQFYWRALLDIPNLDIQIVGDHQQIVQYIERRDSAGAHTAMKQHVAKDLRVISERFRDAKNAFKEQILDEA

SEQ ID NO: 1200 - protein, 234 aa, Artificial
  Substituion in SEQ ID NO 1191
MERRSVTAIQRSEPLVKQVYKYLYHAILSGEFRPRDKVVETHIAERLQVSRSPVREAIRLLIQRDLLVEDADGVRVFQPTQRDFAELYEMRLALEPVAAERAAENAHSTCVAALHENVKQTEQALALGDWDSIVALNKEFHECIWQMSGNRRILKAMQEITDLVQFYWRALLDIPNLDIQIVGEHQQIVQYIERRDSAGAHTAMKQHVAKDLRVISERFRDAKNAFKEQILDEA

SEQ ID NO: 1201 - protein, 234 aa, Artificial
  Substituion in SEQ ID NO 1191
MERRSVTAIQRSEPLVKQVYKYLYHAILSGEFRPRDKVVETHIAERLQVSRSPVREAIRLLIQRDLLVEDADGVRVFQPTQRDFAELYEMRLALEPVAAERAAENAHSTCVAALHENVKQTEQAIALGDWDSIVALNKEFHECIWQMSGNRRILKAMQEITDLVQFYWRALLDIPNLDIQIVGDHQQIVQYIERRDSAGAHTAMKQHVAKDLRVISERFRDAKNAFKEQILDEA

SEQ ID NO: 1202 - protein, 234 aa, Artificial
  Substituion in SEQ ID NO 1191
MERRSVTAIQRSEPLVKQVYKYLYHAILSGEFRPRDKVVETHIAERLQVSRSPVREAIRLLIQRDLIVEDADGVRVFQPTQRDFAELYEMRLALEPVAAERAAENAHSTCVAALHENVKQTEQALALGDWDSIVALNKEFHECIWQMSGNRRILKAMQEITDLVQFYWRALLDIPNLDIQIVGDHQQIVQYIERRDSAGAHTAMKQHVAKDLRVISERFRDAKNAFKEQILDEA

SEQ ID NO: 1203 - DNA, 705 bp, Artificial
  Substituion in SEQ ID NO 1192
atggagaggcgatctgtgacggccattcagcggagcgagcctttggtcaagcaagtgtacaagtatctctaccacgccatcttgtcgggggaatttcgtcctcgtgacaaggtggtggagactcacattgcggaaaggcttcaagtcagtcgaagccccgttcgcgaagcgataagacttctgatccaacgggatcttcttgtggaggatgcggacggagttcgagtatttcaacctacgcagcgcgacttcgcggaactgtatgagatgaggctcgcccttgaaccggtggcagctgagcgtgctgccgagaacgcgcattcgacttgtgttgctgcgcttcatgagaacgttaaacaaactgaacaggcgcttgccctcggagactgggacagcattgtggcactcaacaaggagttccacgaatgcatatggcagatgtctgggaatcgaaggattctcaaagctatgcaggatattaccgatctcgtccagttctattggcgagcacttctcgacatccctaatctggatattcaaatcgtgggagaccaccagcaaatcgtccaatacattgaaaggagggattctgctggagcacataccgctatgaagcaacacgtagccaaagatcttagggtcatatcagaacgctttcgagacgcaaagaatgcctttaaagaacaaatcttagatgaagcttaa

SEQ ID NO: 1204 - DNA, 705 bp, Artificial
  Substituion in SEQ ID NO 1192
atggagaggcgatctgtgacggccattcagcggagcgagcctttggtcaagcaagtgtacaagtatctctaccacgccatcttgtcgggggaatttcgtcctcgtgacaaggtggtggagactcacattgcggaaaggcttcaagtcagtcgaagccccgttcgcgaagcgataagacttctgatccaacgggatcttcttgtggaggatgcggacggaattcgagtatttcaacctacgcagcgcgacttcgcggaactgtatgagatgaggctcgcccttgaaccggtggcagctgagcgtgctgccgagaacgcgcattcgacttgtgttgctgcgcttcatgagaacgttaaacaaactgaacaggcgcttgccctcggagactgggacagcattgtggcactcaacaaggagttccacgaatgcatatggcagatgtctgggaatcgaaggattctcaaagctatgcaggaaattaccgatctcgtccagttctattggcgagcacttctcgacatccctaatctggatattcaaatcgtgggagaccaccagcaaatcgtccaatacattgaaaggagggattctgctggagcacataccgctatgaagcaacacgtagccaaagatcttagggtcatatcagaacgctttcgagacgcaaagaatgcctttaaagaacaaatcttagatgaagcttaa

SEQ ID NO: 1205 - DNA, 705 bp, Artificial
  Substituion in SEQ ID NO 1192
atggagaggcgatctgtgacggccattcagcggagcgagcctttggtcaagcaagtgtacaagtatctctaccacgccatcttgtcgggggaatttcgtcctcgtgacaaggtggtggagactcacattgcggaaaggcttcaagtcagtcgaagccccgttcgcgaagcgataagacttctgatccaacgggatcttcttgtggaggatgcggacggagttcgagtatttcaacctacgcagcgcgacttcgcggaactgtatgagatgaggctcgcccttgaaccggtggcagctgagcgtgctgccgagaacgcgcattcgacttgtgttgctgcgcttcatgagaacgttaaacaaactgaacaggcgcttgccctcggagactgggacagcattgtggcactcaacaaggagttccacgaatgcatatggcagatgtctgggaatcgaaggattctcaaagctatgcaggaaattaccgatctcgtccagttctattggcgagcacttctcgacatccctaatctggatattcaaatcgtgggagaacaccagcaaatcgtccaatacattgaaaggagggattctgctggagcacataccgctatgaagcaacacgtagccaaagatcttagggtcatatcagaacgctttcgagacgcaaagaatgcctttaaagaacaaatcttagatgaagcttaa

SEQ ID NO: 1206 - DNA, 705 bp, Artificial
  Substituion in SEQ ID NO 1192
atggagaggcgatctgtgacggccattcagcggagcgagcctttggtcaagcaagtgtacaagtatctctaccacgccatcttgtcgggggaatttcgtcctcgtgacaaggtggtggagactcacattgcggaaaggcttcaagtcagtcgaagccccgttcgcgaagcgataagacttctgatccaacgggatcttcttgtggaggatgcggacggagttcgagtatttcaacctacgcagcgcgacttcgcggaactgtatgagatgaggctcgcccttgaaccggtggcagctgagcgtgctgccgagaacgcgcattcgacttgtgttgctgcgcttcatgagaacgttaaacaaactgaacaggcgattgccctcggagactgggacagcattgtggcactcaacaaggagttccacgaatgcatatggcagatgtctgggaatcgaaggattctcaaagctatgcaggaaattaccgatctcgtccagttctattggcgagcacttctcgacatccctaatctggatattcaaatcgtgggagaccaccagcaaatcgtccaatacattgaaaggagggattctgctggagcacataccgctatgaagcaacacgtagccaaagatcttagggtcatatcagaacgctttcgagacgcaaagaatgcctttaaagaacaaatcttagatgaagcttaa

SEQ ID NO: 1207 - DNA, 705 bp, Artificial
  Substituion in SEQ ID NO 1192
atggagaggcgatctgtgacggccattcagcggagcgagcctttggtcaagcaagtgtacaagtatctctaccacgccatcttgtcgggggaatttcgtcctcgtgacaaggtggtggagactcacattgcggaaaggcttcaagtcagtcgaagccccgttcgcgaagcgataagacttctgatccaacgggatcttattgtggaggatgcggacggagttcgagtatttcaacctacgcagcgcgacttcgcggaactgtatgagatgaggctcgcccttgaaccggtggcagctgagcgtgctgccgagaacgcgcattcgacttgtgttgctgcgcttcatgagaacgttaaacaaactgaacaggcgcttgccctcggagactgggacagcattgtggcactcaacaaggagttccacgaatgcatatggcagatgtctgggaatcgaaggattctcaaagctatgcaggaaattaccgatctcgtccagttctattggcgagcacttctcgacatccctaatctggatattcaaatcgtgggagaccaccagcaaatcgtccaatacattgaaaggagggattctgctggagcacataccgctatgaagcaacacgtagccaaagatcttagggtcatatcagaacgctttcgagacgcaaagaatgcctttaaagaacaaatcttagatgaagcttaa

SEQ ID NO: 1208-1292 - skipped (85 entries)

SEQ ID NO: 1293 - protein, 278 aa, Alicyclobacillus acidocaldarius
MCRSPAEKHRRARKDEVNRLEDYTVKSVDKALLLLEVVSEHPDGIAITELAQSVGMYKSTVHRLLGTMMRRGYIEQDPVSGRYKLGYTVLDLGMKLLSSIDLRREAMPALQELALASGEVVHLALLDRGSVVYIEKVESPNTIRMHSRVGTRVPVHATGLGKAILAFLPKREVQDIVRRYGLPRLTPHTITDADAFWASLEETRSTGFAFDMEEHQEGVCCVAAPIFAHDGRVMAAVSVSGPALRMTRERMVELVPLVKRAGERISERLGYRRERVAP

SEQ ID NO: 1294 - DNA, 837 bp, Alicyclobacillus acidocaldarius
ttgtgcaggagcccggcagagaagcatcgacgagcgcgcaaggatgaggtgaaccgtttggaggactacacggtcaagtcggtcgacaaggcgctgctgttgctcgaggtggtgagcgagcaccccgacggcattgccatcacggaattggcgcagtccgtgggcatgtacaagagcacggtgcaccgcctgctcggcaccatgatgcggcgcggctacatcgagcaggatccggtgagcgggcggtacaagctgggctacacggtgctcgatctcggcatgaagctcctctcttccatcgatctgcgccgggaggcgatgcccgcgctgcaggagctcgcgctcgcctcgggcgaggtggtgcacctggcacttctggacaggggctccgtggtctacatcgagaaggtggaaagccccaacaccattcgcatgcactcgcgcgtcggcacgcgcgtgccggtccatgcgacggggctcggcaaggccatcctcgcgtttttgccgaagcgcgaggtgcaggacatcgtcaggcgatacgggttgccgcggctcacgccacacaccatcacggacgcggacgcgttttgggcgtcgctcgaggagacgagatcgaccggattcgcgtttgacatggaggagcatcaggaaggggtgtgctgcgtggccgcgcccatctttgcgcacgacgggcgcgtgatggcggcggtgagcgtgtcggggccggccctgcgcatgacgcgcgagcggatggtggagctggtgccgcttgtgaagcgggcgggggagcgcatctcggagcgcctcggatatcgacgggagcgcgtcgccccgtag

SEQ ID NO: 1295 - protein, 257 aa, Geobacillus kaustophilus HTA426
MNAMERENTVKSVRRALQIIEIVSTKKDGLGVTEIAKQMDINKSSVYRILTTLAQYGYIEQHPETERYKLGYKFLELSSKLLDSIDLRQEAKPYLRELEKETNEVIHLVVYDQGEVIYIEKLEGTETLRMHSKVGKRAPMHCTAVGKAILAHLPPAVAAEIIDRKGLPKHTDWTITDREAFFRELETVRQNGYALDLEENEYGIRCVAVPIFDYTGGVVAAISVSGPTIRMTDDRITSLTVRMRQIGKELSARLGYR

SEQ ID NO: 1296 - protein, 248 aa, Bacillus halodurans C-125
VKSVDRALTIISLVSEHKQGLGVTDVAAKLSLTKSSAYKLLATLVEHGFIEQDEETKKYRLGYRYLELSATLLESIDIRRQARPFLEQLEATTNEVVHLVLYDQGEMVYIDKLEGTKTLRTHSKIGRRAPIHCTSVGKVIMAYLPEKVQISLIERYGLPPHTERTITDKETFMKELEKIRLEGYGYEMEENEPGITCIAAPIFDYQGAITAAVSISGPSIRLSKERLHELRPLIIAIGKKISQRLGYQ

SEQ ID NO: 1297 - protein, 248 aa, Geobacillus thermodenitrificans NG80-2
VKSVSRALQIIDIVSTKKDGLGVTEIAKQMDINKSSVYRILTTLAQHGYIEQHPETERYKLGYKFLEISSKLLDSIDLRQEARPYLRQLEKETNEVVHLVVYDQGEVIYIEKLEGTETLRMHSKVGKRAPMHCTAVGKAILAYLPPTVTAEIIDRKGLPKHTDLTITDREAFFRELDSVRQNGYALDLEENEYGIRCVAVPIFDYTGSVVAAVSVSGPTIRMTDDRIAGLAMRMRQIGKELSARLGHR

SEQ ID NO: 1298 - protein, 247 aa, Thermoanaerobacter pseudethanolicus ATCC 33223
VQSLERALKILEVLGKNPNGLGVTELAREVDLPKSTVYRLLSTLAKWGYVEQEKENEKYKLGLKIIELSSNILNNLELREVARQYLEELMEFANEVVHLCVLRDGEIVYIDKVESHNTIQMYSQIGKRAPVHCTAVGKAILAFLPQEEAISILKTKGLPRKTPNTITSLEEMLKHLEEIRRLGYAIDNVEHEEGIRCVAAPIFDYTGQVVASVSISGPEYRVTWEKVPGLAVKVKEITKKISQRLGY

SEQ ID NO: 1299 - protein, 251 aa, Carboxydothermus hydrogenoformans Z-2901
DTLIQSVDRALRILDTFSLKEKELGVTEIANRLGLHKSTVFGLLRTLEHWGYVEQNQVTGKYRLGLKLLELGNRVKEGLDLRAVALPFLQDLVERYGETVHLAVHDRGEIVYIEKVEGPNAIRMYSQIGRRAPMHCTGVGKAILAFRPEKEIEEIIRTKGLKYFTPNTITDPKKLHEELSLIRENGYSLDREEIEIGLRCVAAPIRDSQNTVVAAISVAGPSIRMTEEKIQELIVSVKEAALEISKRLGYQ

SEQ ID NO: 1300 - protein, 278 aa, Artificial
  Substituion in SEQ ID NO 1293
MCRSPAEKHRRARKDEVNRLEDYTVKSVDKALLLLEVVSEHPDGIAITELAQSVGMYKSTVHRLLGTMMRRGYIEQDPVSGRYKLGYTVLDLGMKLLSSIDLRREAMPALQELALASGEVVHLALLDRGSVVYIEKVESPNTIRMHSRVGTRVPVHATGLGKAILAFLPKREIQDIVRRYGLPRLTPHTITDADAFWASLEETRSTGFAFDMEEHQEGVCCVAAPIFAHDGRVMAAVSVSGPALRMTRERMVELVPLVKRAGERISERLGYRRERVAP

SEQ ID NO: 1301 - protein, 278 aa, Artificial
  Substituion in SEQ ID NO 1293
MCRSPAEKHRRARKDEVNRLEDYTVKSVDKALLLLEVVSEHPDGIAITELAQSVGMYKSTVHRLLGTMMRRGYIEQDPVSGRYKLGYTVLDLGMKLLSSIDLRREAMPALQELALASGEVVHLALLDRGSVVYIEKVESPNTIRMHSRVGTRVPVHATGLGKAILAFLPKREVNDIVRRYGLPRLTPHTITDADAFWASLEETRSTGFAFDMEEHQEGVCCVAAPIFAHDGRVMAAVSVSGPALRMTRERMVELVPLVKRAGERISERLGYRRERVAP

SEQ ID NO: 1302 - protein, 278 aa, Artificial
  Substituion in SEQ ID NO 1293
MCRSPAEKHRRARKDEVNRLEDYTVKSVDKALLLLEVVSEHPDGIAITELAQSVGMYKSTVHRLLGTMMRRGYIEQDPVSGRYKLGYTVLDLGMKLLSSIDLRREAMPALQELALASGEVVHLALLDRGSVVYIEKVESPQTIRMHSRVGTRVPVHATGLGKAILAFLPKREVQDIVRRYGLPRLTPHTITDADAFWASLEETRSTGFAFDMEEHQEGVCCVAAPIFAHDGRVMAAVSVSGPALRMTRERMVELVPLVKRAGERISERLGYRRERVAP

SEQ ID NO: 1303 - protein, 278 aa, Artificial
  Substituion in SEQ ID NO 1293
MCRSPAEKHRRARKDEVNRLEDYTVKSVDKALLLLEVVSEHPDGIAITELAQSVGMYKSTVHRLLGTMMRRGYIEQDPVSGRYKLGYTVLDLGMKLLSSIDLRREAMPALQELALASGEVVHLALLDRGSVVYIEKVESPNTIRMHSRVGTRVPVHATGLGKAILAFLPKREVQDIVRRYGLPRLTPHTITDADAFWASLEETRSTGFAFDMEEHQEGVCCVAAPIFAHDGRVMAAVSVSGPALRMTRERMVELVPLVKRAGERLSERLGYRRERVAP

SEQ ID NO: 1304 - protein, 278 aa, Artificial
  Substituion in SEQ ID NO 1293
MCRSPAEKHRRARKDEVNRLEDYTVKSVDKALLLLEVVSEHPDGIAITELAQSVGMYKSTVHRLLGTMMRRGYIEQDPVSGRYKLGYTVLDLGMKLLSSIDLRREAMPALQELALASGEVVHLALLDRGSVVYIEKVESPNTIRMHSRVGTRVPVHATGLGKAILAFLPKREVQDIVRRYGLPRLTPHTITDADAFWASLEETRSTGFAFDMEEHQEGVCCVAAPIFAHDGRVMAAVSVSGPALRMTRERMVELIPLVKRAGERISERLGYRRERVAP

SEQ ID NO: 1305 - DNA, 837 bp, Artificial
  Substituion in SEQ ID NO 1294
ttgtgcaggagcccggcagagaagcatcgacgagcgcgcaaggatgaggtgaaccgtttggaggactacacggtcaagtcggtcgacaaggcgctgctgttgctcgaggtggtgagcgagcaccccgacggcattgccatcacggaattggcgcagtccgtgggcatgtacaagagcacggtgcaccgcctgctcggcaccatgatgcggcgcggctacatcgagcaggatccggtgagcgggcggtacaagctgggctacacggtgctcgatctcggcatgaagctcctctcttccatcgatctgcgccgggaggcgatgcccgcgctgcaggagctcgcgctcgcctcgggcgaggtggtgcacctggcacttctggacaggggctccgtggtctacatcgagaaggtggaaagccccaacaccattcgcatgcactcgcgcgtcggcacgcgcgtgccggtccatgcgacggggctcggcaaggccatcctcgcgtttttgccgaagcgcgagattcaggacatcgtcaggcgatacgggttgccgcggctcacgccacacaccatcacggacgcggacgcgttttgggcgtcgctcgaggagacgagatcgaccggattcgcgtttgacatggaggagcatcaggaaggggtgtgctgcgtggccgcgcccatctttgcgcacgacgggcgcgtgatggcggcggtgagcgtgtcggggccggccctgcgcatgacgcgcgagcggatggtggagctggtgccgcttgtgaagcgggcgggggagcgcatctcggagcgcctcggatatcgacgggagcgcgtcgccccgtag

SEQ ID NO: 1306 - DNA, 837 bp, Artificial
  Substituion in SEQ ID NO 1294
ttgtgcaggagcccggcagagaagcatcgacgagcgcgcaaggatgaggtgaaccgtttggaggactacacggtcaagtcggtcgacaaggcgctgctgttgctcgaggtggtgagcgagcaccccgacggcattgccatcacggaattggcgcagtccgtgggcatgtacaagagcacggtgcaccgcctgctcggcaccatgatgcggcgcggctacatcgagcaggatccggtgagcgggcggtacaagctgggctacacggtgctcgatctcggcatgaagctcctctcttccatcgatctgcgccgggaggcgatgcccgcgctgcaggagctcgcgctcgcctcgggcgaggtggtgcacctggcacttctggacaggggctccgtggtctacatcgagaaggtggaaagccccaacaccattcgcatgcactcgcgcgtcggcacgcgcgtgccggtccatgcgacggggctcggcaaggccatcctcgcgtttttgccgaagcgcgaggtgaatgacatcgtcaggcgatacgggttgccgcggctcacgccacacaccatcacggacgcggacgcgttttgggcgtcgctcgaggagacgagatcgaccggattcgcgtttgacatggaggagcatcaggaaggggtgtgctgcgtggccgcgcccatctttgcgcacgacgggcgcgtgatggcggcggtgagcgtgtcggggccggccctgcgcatgacgcgcgagcggatggtggagctggtgccgcttgtgaagcgggcgggggagcgcatctcggagcgcctcggatatcgacgggagcgcgtcgccccgtag

SEQ ID NO: 1307 - DNA, 837 bp, Artificial
  Substituion in SEQ ID NO 1294
ttgtgcaggagcccggcagagaagcatcgacgagcgcgcaaggatgaggtgaaccgtttggaggactacacggtcaagtcggtcgacaaggcgctgctgttgctcgaggtggtgagcgagcaccccgacggcattgccatcacggaattggcgcagtccgtgggcatgtacaagagcacggtgcaccgcctgctcggcaccatgatgcggcgcggctacatcgagcaggatccggtgagcgggcggtacaagctgggctacacggtgctcgatctcggcatgaagctcctctcttccatcgatctgcgccgggaggcgatgcccgcgctgcaggagctcgcgctcgcctcgggcgaggtggtgcacctggcacttctggacaggggctccgtggtctacatcgagaaggtggaaagcccccaaaccattcgcatgcactcgcgcgtcggcacgcgcgtgccggtccatgcgacggggctcggcaaggccatcctcgcgtttttgccgaagcgcgaggtgcaggacatcgtcaggcgatacgggttgccgcggctcacgccacacaccatcacggacgcggacgcgttttgggcgtcgctcgaggagacgagatcgaccggattcgcgtttgacatggaggagcatcaggaaggggtgtgctgcgtggccgcgcccatctttgcgcacgacgggcgcgtgatggcggcggtgagcgtgtcggggccggccctgcgcatgacgcgcgagcggatggtggagctggtgccgcttgtgaagcgggcgggggagcgcatctcggagcgcctcggatatcgacgggagcgcgtcgccccgtag

SEQ ID NO: 1308 - DNA, 837 bp, Artificial
  Substituion in SEQ ID NO 1294
ttgtgcaggagcccggcagagaagcatcgacgagcgcgcaaggatgaggtgaaccgtttggaggactacacggtcaagtcggtcgacaaggcgctgctgttgctcgaggtggtgagcgagcaccccgacggcattgccatcacggaattggcgcagtccgtgggcatgtacaagagcacggtgcaccgcctgctcggcaccatgatgcggcgcggctacatcgagcaggatccggtgagcgggcggtacaagctgggctacacggtgctcgatctcggcatgaagctcctctcttccatcgatctgcgccgggaggcgatgcccgcgctgcaggagctcgcgctcgcctcgggcgaggtggtgcacctggcacttctggacaggggctccgtggtctacatcgagaaggtggaaagccccaacaccattcgcatgcactcgcgcgtcggcacgcgcgtgccggtccatgcgacggggctcggcaaggccatcctcgcgtttttgccgaagcgcgaggtgcaggacatcgtcaggcgatacgggttgccgcggctcacgccacacaccatcacggacgcggacgcgttttgggcgtcgctcgaggagacgagatcgaccggattcgcgtttgacatggaggagcatcaggaaggggtgtgctgcgtggccgcgcccatctttgcgcacgacgggcgcgtgatggcggcggtgagcgtgtcggggccggccctgcgcatgacgcgcgagcggatggtggagctggtgccgcttgtgaagcgggcgggggagcgcttatcggagcgcctcggatatcgacgggagcgcgtcgccccgtag

SEQ ID NO: 1309 - DNA, 837 bp, Artificial
  Substituion in SEQ ID NO 1294
ttgtgcaggagcccggcagagaagcatcgacgagcgcgcaaggatgaggtgaaccgtttggaggactacacggtcaagtcggtcgacaaggcgctgctgttgctcgaggtggtgagcgagcaccccgacggcattgccatcacggaattggcgcagtccgtgggcatgtacaagagcacggtgcaccgcctgctcggcaccatgatgcggcgcggctacatcgagcaggatccggtgagcgggcggtacaagctgggctacacggtgctcgatctcggcatgaagctcctctcttccatcgatctgcgccgggaggcgatgcccgcgctgcaggagctcgcgctcgcctcgggcgaggtggtgcacctggcacttctggacaggggctccgtggtctacatcgagaaggtggaaagccccaacaccattcgcatgcactcgcgcgtcggcacgcgcgtgccggtccatgcgacggggctcggcaaggccatcctcgcgtttttgccgaagcgcgaggtgcaggacatcgtcaggcgatacgggttgccgcggctcacgccacacaccatcacggacgcggacgcgttttgggcgtcgctcgaggagacgagatcgaccggattcgcgtttgacatggaggagcatcaggaaggggtgtgctgcgtggccgcgcccatctttgcgcacgacgggcgcgtgatggcggcggtgagcgtgtcggggccggccctgcgcatgacgcgcgagcggatggtggagctgattccgcttgtgaagcgggcgggggagcgcatctcggagcgcctcggatatcgacgggagcgcgtcgccccgtag

SEQ ID NO: 1310 - protein, 148 aa, Alicyclobacillus acidocaldarius
MKGGGDMQAQKDAVQLLKNAGLRVTPQREAILQFLLDYDGHATVDDIYTSLQDRFPSMSVSTVYNTVKQLSQVGLVKEIGVGEGASRFDINVEPHHHLVCTRCGALFDFYLEEPIQLSVPPEARGFEVEDYHVEVRGICPKCKQQQVS

SEQ ID NO: 1311 - DNA, 447 bp, Alicyclobacillus acidocaldarius
atgaaaggagggggtgacatgcaggcgcagaaggacgctgtgcagttgttgaaaaatgccggcctgcgcgtgaccccgcagcgagaagccattctccagttcttgttggactacgacggtcatgcgaccgtggacgatatttacacgtcactgcaggaccgctttcctagcatgagcgtatccaccgtctacaatacggtaaagcaactgtcgcaggtgggactcgtgaaggagattggcgttggcgagggcgcgagccggttcgacatcaacgtggaaccccaccatcacctggtctgcacgcgctgcggtgcgctgttcgatttttacctggaggagccgattcagttgtctgtgccaccggaagcccggggatttgaggttgaggattatcacgtcgaggtccgcggaatctgcccgaagtgtaaacagcagcaggtctcgtga

SEQ ID NO: 1312 - protein, 139 aa, Listeria welshimeri serovar 6b str. SLCC5334
KEAVDVLKKTGVRITPQRHAILEFLINSHTHPTADDIYRSLEGNFPNMSVATVYNNLRVFRDAGLIKELSYGDASSRFDFSTSNHYHAICNVCGKIVDFHYPGLDEVEHFAAHVTGYEIDNHRLEVYGTCPECKEKQIN

SEQ ID NO: 1313 - protein, 137 aa, Listeria innocua Clip11262
KEAVDVLKKTGVRITPQRHAILEFLINSHTHPTADDIYRSLEGNFPNMSVATVYNNLRVFRDAGLIKELSYGDASSRFDFSTSNHYHAICNVCGKIVDFHYPGLDEVEHFAAHVTGYEIDNHRLEVYGTCPECKEKQ

SEQ ID NO: 1314 - protein, 137 aa, Listeria monocytogenes EGD-e
KEAVDVLKKTGVRITPQRHAILEFLINSHTHPTADDIYRALEGNFPNMSVATVYNNLRVFRDAGLIKELSYGDASSRFDFSTSNHYHAICNVCGKIVDFHYPGLDEVEHFAAHMTGYEIDNHRLEVYGICPACKEKQ

SEQ ID NO: 1315 - protein, 137 aa, Geobacillus thermodenitrificans NG80-2
KEALDMLKKTGIRITPQRHAILEYLISSMSHPTADEIYKALEGKFPNMSVATVYNNLRVFKEVGLVKELTYGDSSSRFDFVTSNHYHVICEQCGKIVDFHYPALDEVEQLAAHVTGFKVDHHRMEVYGVCPDCQNEK

SEQ ID NO: 1316 - protein, 140 aa, Geobacillus kaustophilus HTA426
DNEQLKEALDMLKKTGIRITPQRHAILEYLISSMSHPTADEIYKALEGKFPNMSVATVYNNLRVFKEIGLVKELTYGDSSSRFDFVTSNHYHVICEECGKIVDFHYPALDEVEQLAAHVTGFKVDHHRMEVYGVCPDCQK

SEQ ID NO: 1317 - protein, 148 aa, Artificial
  Substituion in SEQ ID NO 1310
MKGGGDMQAQKDAVQLLKNAGLRVTPQREAILQFLLDYDGHATVDDIYTSLQDRFPSMSVSTVYNTVKQLSQVGLVKEIGVGEGASRFDINVEPHHHLVCTRCGALFDFYLEEPIQLSVPPEARGFEVEDYHVEVRGLCPKCKQQQVS

SEQ ID NO: 1318 - protein, 148 aa, Artificial
  Substituion in SEQ ID NO 1310
MKGGGDMQAQKDAVQLLKNAGLRVTPQREAILQFLLDYDGHATVDDIYTSLQDRFPSMSVSTVYNTIKQLSQVGLVKEIGVGEGASRFDINVEPHHHLVCTRCGALFDFYLEEPIQLSVPPEARGFEVEDYHVEVRGICPKCKQQQVS

SEQ ID NO: 1319 - protein, 148 aa, Artificial
  Substituion in SEQ ID NO 1310
MKGGGDMQAQKDAVQLLKNAGLRVTPQREAILQFLLDYDGHATVDDIYTSLQDRFPSMSVSTVYNTVKQLSQVGLVKEIGVGEGASRFDINIEPHHHLVCTRCGALFDFYLEEPIQLSVPPEARGFEVEDYHVEVRGICPKCKQQQVS

SEQ ID NO: 1320 - protein, 148 aa, Artificial
  Substituion in SEQ ID NO 1310
MKGGGDMQAQKDAVQLLKNAGLRVTPQREAILQFLLDYDGHATVDDIYTSLQDRFPSMSVSTVYNTVKQLSQVGLVKEIGVGEGASRFDINVEPHHHLVCTRCGALFDFYIEEPIQLSVPPEARGFEVEDYHVEVRGICPKCKQQQVS

SEQ ID NO: 1321 - protein, 148 aa, Artificial
  Substituion in SEQ ID NO 1310
MKGGGDMQAQKDAIQLLKNAGLRVTPQREAILQFLLDYDGHATVDDIYTSLQDRFPSMSVSTVYNTVKQLSQVGLVKEIGVGEGASRFDINVEPHHHLVCTRCGALFDFYLEEPIQLSVPPEARGFEVEDYHVEVRGICPKCKQQQVS

SEQ ID NO: 1322 - DNA, 447 bp, Artificial
  Substituion in SEQ ID NO 1311
atgaaaggagggggtgacatgcaggcgcagaaggacgctgtgcagttgttgaaaaatgccggcctgcgcgtgaccccgcagcgagaagccattctccagttcttgttggactacgacggtcatgcgaccgtggacgatatttacacgtcactgcaggaccgctttcctagcatgagcgtatccaccgtctacaatacggtaaagcaactgtcgcaggtgggactcgtgaaggagattggcgttggcgagggcgcgagccggttcgacatcaacgtggaaccccaccatcacctggtctgcacgcgctgcggtgcgctgttcgatttttacctggaggagccgattcagttgtctgtgccaccggaagcccggggatttgaggttgaggattatcacgtcgaggtccgcggattatgcccgaagtgtaaacagcagcaggtctcgtga

SEQ ID NO: 1323 - DNA, 447 bp, Artificial
  Substituion in SEQ ID NO 1311
atgaaaggagggggtgacatgcaggcgcagaaggacgctgtgcagttgttgaaaaatgccggcctgcgcgtgaccccgcagcgagaagccattctccagttcttgttggactacgacggtcatgcgaccgtggacgatatttacacgtcactgcaggaccgctttcctagcatgagcgtatccaccgtctacaatacgattaagcaactgtcgcaggtgggactcgtgaaggagattggcgttggcgagggcgcgagccggttcgacatcaacgtggaaccccaccatcacctggtctgcacgcgctgcggtgcgctgttcgatttttacctggaggagccgattcagttgtctgtgccaccggaagcccggggatttgaggttgaggattatcacgtcgaggtccgcggaatctgcccgaagtgtaaacagcagcaggtctcgtga

SEQ ID NO: 1324 - DNA, 447 bp, Artificial
  Substituion in SEQ ID NO 1311
atgaaaggagggggtgacatgcaggcgcagaaggacgctgtgcagttgttgaaaaatgccggcctgcgcgtgaccccgcagcgagaagccattctccagttcttgttggactacgacggtcatgcgaccgtggacgatatttacacgtcactgcaggaccgctttcctagcatgagcgtatccaccgtctacaatacggtaaagcaactgtcgcaggtgggactcgtgaaggagattggcgttggcgagggcgcgagccggttcgacatcaacattgaaccccaccatcacctggtctgcacgcgctgcggtgcgctgttcgatttttacctggaggagccgattcagttgtctgtgccaccggaagcccggggatttgaggttgaggattatcacgtcgaggtccgcggaatctgcccgaagtgtaaacagcagcaggtctcgtga

SEQ ID NO: 1325 - DNA, 447 bp, Artificial
  Substituion in SEQ ID NO 1311
atgaaaggagggggtgacatgcaggcgcagaaggacgctgtgcagttgttgaaaaatgccggcctgcgcgtgaccccgcagcgagaagccattctccagttcttgttggactacgacggtcatgcgaccgtggacgatatttacacgtcactgcaggaccgctttcctagcatgagcgtatccaccgtctacaatacggtaaagcaactgtcgcaggtgggactcgtgaaggagattggcgttggcgagggcgcgagccggttcgacatcaacgtggaaccccaccatcacctggtctgcacgcgctgcggtgcgctgttcgatttttacattgaggagccgattcagttgtctgtgccaccggaagcccggggatttgaggttgaggattatcacgtcgaggtccgcggaatctgcccgaagtgtaaacagcagcaggtctcgtga

SEQ ID NO: 1326 - DNA, 447 bp, Artificial
  Substituion in SEQ ID NO 1311
atgaaaggagggggtgacatgcaggcgcagaaggacgctattcagttgttgaaaaatgccggcctgcgcgtgaccccgcagcgagaagccattctccagttcttgttggactacgacggtcatgcgaccgtggacgatatttacacgtcactgcaggaccgctttcctagcatgagcgtatccaccgtctacaatacggtaaagcaactgtcgcaggtgggactcgtgaaggagattggcgttggcgagggcgcgagccggttcgacatcaacgtggaaccccaccatcacctggtctgcacgcgctgcggtgcgctgttcgatttttacctggaggagccgattcagttgtctgtgccaccggaagcccggggatttgaggttgaggattatcacgtcgaggtccgcggaatctgcccgaagtgtaaacagcagcaggtctcgtga

SEQ ID NO: 1327 - protein, 300 aa, Alicyclobacillus acidocaldarius
MNTRRIGRMRMELVQLEYFLAVAEYQSFRRAADAIRVSQPALSRAIQKLEGDLGAPLFVRTAQGVRLTPCGEAFLPHARQALAEVAAGARKVAELAGQARGVLHVGLIYSLGTRFLPDVIRTFTRTHPGVTVRLSEAPTQKLLQQLDAGEIDIAFCTPQHAPHLTLVEILQEELVAIVPLDHPLAAKDQCHLSDLAGEPFVAYARESGIRHVIERYCAEAGFTPRVAMEGVEDLTVAGLVAAGVGVAVVPLHAQLDQLPVHVLRLCEPCKRSVYMAWHTHTTLSPVARAFIAFVKRMCAP

SEQ ID NO: 1328 - DNA, 903 bp, Alicyclobacillus acidocaldarius
gtgaacactcggcggatcgggaggatgcgcatggaacttgtccagctcgagtactttttggccgtggcggagtaccagagctttcgccgcgccgcggacgccatccgcgtgtctcaacccgcgctgtctcgggccatccaaaaactcgagggcgatctcggcgcgccgctcttcgtgcgcaccgcgcagggcgtgcgcctcacgccgtgcggcgaggcgtttctgcctcacgcccgccaggcgctcgccgaggtggccgcgggcgctcgcaaggtcgccgagctcgcgggccaggcccggggcgtgctccacgtcggcctcatctactcgctcggcacgcgcttcctgcccgacgtcattcgcacgttcacccgcacgcaccccggtgtgaccgtccgcctgtccgaagcgccgacccagaagctcttgcaacagctcgatgccggcgagatcgacatcgcgttctgcacgccgcaacacgcgccgcacctgacgctcgtcgaaatcctgcaggaggaactcgtggccatcgtccccctcgatcacccgctcgcggcgaaggaccagtgtcacctgtccgatctcgccggcgagccgttcgtggcctacgcccgcgagagcggtatccgccacgtgattgagcgctactgcgcggaggcgggattcacgccgcgcgtggccatggaaggcgtcgaagacctgaccgtggcggggctcgtggccgccggcgtcggcgtcgccgtggtgccgctgcacgcccagctcgaccagttgcccgtccacgtcctccggctgtgcgagccgtgcaaacggtccgtctacatggcctggcacacccacacgaccctgtcgcccgtcgcccgcgcgttcatcgccttcgtcaagcgcatgtgcgcaccgtga

SEQ ID NO: 1329 - protein, 286 aa, Bacillus licheniformis ATCC 14580
MELYQIDHFIAVSRHKHFTKAALEQRISQPALSRSIKKLEEELGVPLFIRKTKSIRLTKYGEQFLIKAKQARLALDEGVQQIRESVNPNAGEISVSFLHTLGSRLMPQLIAEFKKKYPNVAFRLYQAANEHLQHMVETGEADICLSSPPLPNEHLEWTVLDTEPLYLVLPADHPLADRKEVAIRSIAHEDFVCFKPGYGLRYVFDQMCRGLSISPKLAFEGEEVSTILGLVSAGLGVAILPKTAEHVHSPVAFCRVSDYRSERTIGLAVLKDHYLSPAARNFKEFV

SEQ ID NO: 1330 - protein, 286 aa, Chloroflexus aurantiacus J-10-fl
MELRHLRYFEAVARHSHVTRAAAELHIAQPALSKQISQLERELGITLFDRVGRSLRLTEAGEALLPYARAILAQVEEARAAMAERIGLKAGRVTIGAPPTVGAHLLPPLLTIFHQRYPGITLRLHEAGIQSLLDLLEAGITDLAVVALPVTDEQLTVTPLLNEPLVLIVSTTHPLARRSEVMMTELRHERWILSPSSYELREATLKACREAGFTPQTVLEGGETETLVRFVAAGLGVSLVPALAVAGCTDVVRLTVSDQHLTRSLGLVWRSDRTASPAARALREFL

SEQ ID NO: 1331 - protein, 285 aa, Thermobifida fusca YX
MQLQQLAYFLAVAETRHFTRAAELSRVAQPSLSKQIKALEEELGAPLFVRARGNITLTPAGEILLPLAQRILADVETARREIQELAGMRRGWVRLGATPSLCAGLLADALVRFHERYPGIELHVEEGGSRDLIRALGGGELDLALIILPLHSSDPAFVTVPILRESLVVASPISQPPPTNGGAMRITDLRDQPLVMFRRGYDVRETTLSACRAAGFEPRLAVEGGEMDAVLRFVEAGLGLAVVPSMVLRNRPGLRGTPLAEPRLLRTIALAHRKDVALSRTARAF

SEQ ID NO: 1332 - protein, 287 aa, Bacillus amyloliquefaciens FZB42
MDWHQINYFQTVAQVQHITQAAKQLSISQPALSRSISKLEDELGVQLFDRKGRNIYLNRYGKMFLHRVEQSIRQIEIGKQEVWNEIHPNSGTILLSFLPSLGMSMVPDVISSFQHMYPHVNFQLTQASNQQIIEQLTSREVDIALTSLRDENDDVICQPLLTEELYLAVSAEHPLASYDEIDLKMAEHEPFISFKDTNVLHGMIKELCEKAGFSPDVVFEGEDIVTASGLVGAKLGVSLIPDLHVFDKTKVKLLSVTNPICEREIGLAWRKDGYLSPAAENFIAFIQ

SEQ ID NO: 1333 - protein, 285 aa, Bacillus amyloliquefaciens FZB42
MELHQIDNFIAAAAHQHFTNAAKERMISQPALSRSIIRLEEELGAPLFFRDTKAVRLTRHGEQFLIKAKQARRALNEGVEQVKKNMSLEHGEISVSFLHTLGLRLMPQLIAEFKKLYPNVTFRLYQGANETLRKMVETGDADICLSSPPLPSELLQWTVLEKEPLYAVLPENHPLAGNKSIQMKEMQDEDFVGFKPGYGLRYMFDLMCRDLNIHPHLAFEGEEVSTILGLTAAGLGAAVLPKTAEHSYFPVVFLPVADYQCERTIALAQLKNHALSPAAERFKQF

SEQ ID NO: 1334 - protein, 300 aa, Artificial
  Substituion in SEQ ID NO 1327
MNTRRIGRMRMELVQLEYFLAVAEYQSFRRAADAIRVSQPALSRAIQKLEGDLGAPLFVRTAQGVRLTPCGEAFLPHARQALAEVAAGARKVAELAGQARGVLHVGLIYSLGTRFLPDVIRTFTRTHPGVTVRLSEAPTQKLLQQLDAGEIDIAFCTPQHAPHLTLVEILQEELVAIVPLDHPLAAKDQCHLSDLAGEPFVAYARESGLRHVIERYCAEAGFTPRVAMEGVEDLTVAGLVAAGVGVAVVPLHAQLDQLPVHVLRLCEPCKRSVYMAWHTHTTLSPVARAFIAFVKRMCAP

SEQ ID NO: 1335 - protein, 300 aa, Artificial
  Substituion in SEQ ID NO 1327
MNTRRIGRMRMELVQLEYFLAVAEYQSFRRAADAIRVSQPALSRAIQKLEGDLGAPLFVRTAQGVRLTPCGEAFLPHARQALAEVAAGARKVAELAGQARGVLHVGLIYSLGTRFLPDVIRTFTRTHPGVTVRLSEAPTQKILQQLDAGEIDIAFCTPQHAPHLTLVEILQEELVAIVPLDHPLAAKDQCHLSDLAGEPFVAYARESGIRHVIERYCAEAGFTPRVAMEGVEDLTVAGLVAAGVGVAVVPLHAQLDQLPVHVLRLCEPCKRSVYMAWHTHTTLSPVARAFIAFVKRMCAP

SEQ ID NO: 1336 - protein, 300 aa, Artificial
  Substituion in SEQ ID NO 1327
MNTRRIGRMRMELVQLEYFLAVAEYQSFRRAADAIRVSQPALSRAIQKLEGDLGAPLFVRTAQGVRLTPCGEAFLPHARQALAEVAAGARKVAELAGQARGVLHVGLIYSLGTRFLPDVIRTFTRTHPGVTVRLSEAPTQKLLQQLDAGEIDIAFCTPQHAPHLTLVEILQEELVAIVPLDHPLAAKDQCHLSDLAGEPFVAYARESGIRHVIERYCAEAGFTPRVAMEGVEDLTVAGLVAAGVGVAVVPLHAQLDQLPVHVLRLCEPCKRSVYMAWHTHTTLSPVARAFIAFVKKMCAP

SEQ ID NO: 1337 - protein, 300 aa, Artificial
  Substituion in SEQ ID NO 1327
MNTRRIGRMRMELVQLEYFLAVAEYQSFRRAADAIRVSQPALSRAIQKLEGDLGAPLFVRTAQGVKLTPCGEAFLPHARQALAEVAAGARKVAELAGQARGVLHVGLIYSLGTRFLPDVIRTFTRTHPGVTVRLSEAPTQKLLQQLDAGEIDIAFCTPQHAPHLTLVEILQEELVAIVPLDHPLAAKDQCHLSDLAGEPFVAYARESGIRHVIERYCAEAGFTPRVAMEGVEDLTVAGLVAAGVGVAVVPLHAQLDQLPVHVLRLCEPCKRSVYMAWHTHTTLSPVARAFIAFVKRMCAP

SEQ ID NO: 1338 - protein, 300 aa, Artificial
  Substituion in SEQ ID NO 1327
MNTRRIGRMRMELVQLEYFLAVAEYQSFRRAADAIRVSQPALSRAIQKLEGDLGAPLFVRTAQGVRLTPCGEAFLPHARQALAEVAAGARKVAELAGQARGVLHVGLIYSLGTRFLPDVIRTFTRTHPGVTVRLSEAPTQKLLQQLDAGEIDIAFCTPQHAPHLTLVEILQEELVAIVPLDHPLAAKDQCHLSDLAGEPFVAYARESGIRHVIERYCAEAGFTPRVAMEGVEDITVAGLVAAGVGVAVVPLHAQLDQLPVHVLRLCEPCKRSVYMAWHTHTTLSPVARAFIAFVKRMCAP

SEQ ID NO: 1339 - DNA, 903 bp, Artificial
  Substituion in SEQ ID NO 1328
gtgaacactcggcggatcgggaggatgcgcatggaacttgtccagctcgagtactttttggccgtggcggagtaccagagctttcgccgcgccgcggacgccatccgcgtgtctcaacccgcgctgtctcgggccatccaaaaactcgagggcgatctcggcgcgccgctcttcgtgcgcaccgcgcagggcgtgcgcctcacgccgtgcggcgaggcgtttctgcctcacgcccgccaggcgctcgccgaggtggccgcgggcgctcgcaaggtcgccgagctcgcgggccaggcccggggcgtgctccacgtcggcctcatctactcgctcggcacgcgcttcctgcccgacgtcattcgcacgttcacccgcacgcaccccggtgtgaccgtccgcctgtccgaagcgccgacccagaagctcttgcaacagctcgatgccggcgagatcgacatcgcgttctgcacgccgcaacacgcgccgcacctgacgctcgtcgaaatcctgcaggaggaactcgtggccatcgtccccctcgatcacccgctcgcggcgaaggaccagtgtcacctgtccgatctcgccggcgagccgttcgtggcctacgcccgcgagagcggtttacgccacgtgattgagcgctactgcgcggaggcgggattcacgccgcgcgtggccatggaaggcgtcgaagacctgaccgtggcggggctcgtggccgccggcgtcggcgtcgccgtggtgccgctgcacgcccagctcgaccagttgcccgtccacgtcctccggctgtgcgagccgtgcaaacggtccgtctacatggcctggcacacccacacgaccctgtcgcccgtcgcccgcgcgttcatcgccttcgtcaagcgcatgtgcgcaccgtga

SEQ ID NO: 1340 - DNA, 903 bp, Artificial
  Substituion in SEQ ID NO 1328
gtgaacactcggcggatcgggaggatgcgcatggaacttgtccagctcgagtactttttggccgtggcggagtaccagagctttcgccgcgccgcggacgccatccgcgtgtctcaacccgcgctgtctcgggccatccaaaaactcgagggcgatctcggcgcgccgctcttcgtgcgcaccgcgcagggcgtgcgcctcacgccgtgcggcgaggcgtttctgcctcacgcccgccaggcgctcgccgaggtggccgcgggcgctcgcaaggtcgccgagctcgcgggccaggcccggggcgtgctccacgtcggcctcatctactcgctcggcacgcgcttcctgcccgacgtcattcgcacgttcacccgcacgcaccccggtgtgaccgtccgcctgtccgaagcgccgacccagaagattttgcaacagctcgatgccggcgagatcgacatcgcgttctgcacgccgcaacacgcgccgcacctgacgctcgtcgaaatcctgcaggaggaactcgtggccatcgtccccctcgatcacccgctcgcggcgaaggaccagtgtcacctgtccgatctcgccggcgagccgttcgtggcctacgcccgcgagagcggtatccgccacgtgattgagcgctactgcgcggaggcgggattcacgccgcgcgtggccatggaaggcgtcgaagacctgaccgtggcggggctcgtggccgccggcgtcggcgtcgccgtggtgccgctgcacgcccagctcgaccagttgcccgtccacgtcctccggctgtgcgagccgtgcaaacggtccgtctacatggcctggcacacccacacgaccctgtcgcccgtcgcccgcgcgttcatcgccttcgtcaagcgcatgtgcgcaccgtga

SEQ ID NO: 1341 - DNA, 903 bp, Artificial
  Substituion in SEQ ID NO 1328
gtgaacactcggcggatcgggaggatgcgcatggaacttgtccagctcgagtactttttggccgtggcggagtaccagagctttcgccgcgccgcggacgccatccgcgtgtctcaacccgcgctgtctcgggccatccaaaaactcgagggcgatctcggcgcgccgctcttcgtgcgcaccgcgcagggcgtgcgcctcacgccgtgcggcgaggcgtttctgcctcacgcccgccaggcgctcgccgaggtggccgcgggcgctcgcaaggtcgccgagctcgcgggccaggcccggggcgtgctccacgtcggcctcatctactcgctcggcacgcgcttcctgcccgacgtcattcgcacgttcacccgcacgcaccccggtgtgaccgtccgcctgtccgaagcgccgacccagaagctcttgcaacagctcgatgccggcgagatcgacatcgcgttctgcacgccgcaacacgcgccgcacctgacgctcgtcgaaatcctgcaggaggaactcgtggccatcgtccccctcgatcacccgctcgcggcgaaggaccagtgtcacctgtccgatctcgccggcgagccgttcgtggcctacgcccgcgagagcggtatccgccacgtgattgagcgctactgcgcggaggcgggattcacgccgcgcgtggccatggaaggcgtcgaagacctgaccgtggcggggctcgtggccgccggcgtcggcgtcgccgtggtgccgctgcacgcccagctcgaccagttgcccgtccacgtcctccggctgtgcgagccgtgcaaacggtccgtctacatggcctggcacacccacacgaccctgtcgcccgtcgcccgcgcgttcatcgccttcgtcaagaaaatgtgcgcaccgtga

SEQ ID NO: 1342 - DNA, 903 bp, Artificial
  Substituion in SEQ ID NO 1328
gtgaacactcggcggatcgggaggatgcgcatggaacttgtccagctcgagtactttttggccgtggcggagtaccagagctttcgccgcgccgcggacgccatccgcgtgtctcaacccgcgctgtctcgggccatccaaaaactcgagggcgatctcggcgcgccgctcttcgtgcgcaccgcgcagggcgtgaaactcacgccgtgcggcgaggcgtttctgcctcacgcccgccaggcgctcgccgaggtggccgcgggcgctcgcaaggtcgccgagctcgcgggccaggcccggggcgtgctccacgtcggcctcatctactcgctcggcacgcgcttcctgcccgacgtcattcgcacgttcacccgcacgcaccccggtgtgaccgtccgcctgtccgaagcgccgacccagaagctcttgcaacagctcgatgccggcgagatcgacatcgcgttctgcacgccgcaacacgcgccgcacctgacgctcgtcgaaatcctgcaggaggaactcgtggccatcgtccccctcgatcacccgctcgcggcgaaggaccagtgtcacctgtccgatctcgccggcgagccgttcgtggcctacgcccgcgagagcggtatccgccacgtgattgagcgctactgcgcggaggcgggattcacgccgcgcgtggccatggaaggcgtcgaagacctgaccgtggcggggctcgtggccgccggcgtcggcgtcgccgtggtgccgctgcacgcccagctcgaccagttgcccgtccacgtcctccggctgtgcgagccgtgcaaacggtccgtctacatggcctggcacacccacacgaccctgtcgcccgtcgcccgcgcgttcatcgccttcgtcaagcgcatgtgcgcaccgtga

SEQ ID NO: 1343 - DNA, 903 bp, Artificial
  Substituion in SEQ ID NO 1328
gtgaacactcggcggatcgggaggatgcgcatggaacttgtccagctcgagtactttttggccgtggcggagtaccagagctttcgccgcgccgcggacgccatccgcgtgtctcaacccgcgctgtctcgggccatccaaaaactcgagggcgatctcggcgcgccgctcttcgtgcgcaccgcgcagggcgtgcgcctcacgccgtgcggcgaggcgtttctgcctcacgcccgccaggcgctcgccgaggtggccgcgggcgctcgcaaggtcgccgagctcgcgggccaggcccggggcgtgctccacgtcggcctcatctactcgctcggcacgcgcttcctgcccgacgtcattcgcacgttcacccgcacgcaccccggtgtgaccgtccgcctgtccgaagcgccgacccagaagctcttgcaacagctcgatgccggcgagatcgacatcgcgttctgcacgccgcaacacgcgccgcacctgacgctcgtcgaaatcctgcaggaggaactcgtggccatcgtccccctcgatcacccgctcgcggcgaaggaccagtgtcacctgtccgatctcgccggcgagccgttcgtggcctacgcccgcgagagcggtatccgccacgtgattgagcgctactgcgcggaggcgggattcacgccgcgcgtggccatggaaggcgtcgaagacattaccgtggcggggctcgtggccgccggcgtcggcgtcgccgtggtgccgctgcacgcccagctcgaccagttgcccgtccacgtcctccggctgtgcgagccgtgcaaacggtccgtctacatggcctggcacacccacacgaccctgtcgcccgtcgcccgcgcgttcatcgccttcgtcaagcgcatgtgcgcaccgtga

SEQ ID NO: 1344 - protein, 366 aa, Alicyclobacillus acidocaldarius
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELEKP

SEQ ID NO: 1345 - DNA, 1101 bp, Alicyclobacillus acidocaldarius
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 1346 - protein, 356 aa, Geobacillus kaustophilus HTA426
TISLCMIVKNEEDVLARCLDSVQHLVDEIVIVDTGSTDRTKEIARSYTARVIDFPWSDDFSAARNFSFSHATMDYIFWLDADDILPAEEQTKFLTLKRTLSSDIDSVTMIYSLAQDEYGKTISSVRRNRLVKRSSGFRWHGMVHEYLEVWGTILNSDITIIHQPNRCASDRNLQIYEKQLAQGKEFSPRDLFYFANELFDHQQYERAIQYYEQFLQTKKGWVEDCIAACGKVADCFDALGDEEQALRYALRSFEYDTPRAECCCRLGYYFLQRKQYRLAAFWYHLATQLTMPSDSWGFVHHACWTWLPHLQLCVCYFYMGEYELAYQHNEKAKQYVPHHPAVLHNECLLQSILAAE

SEQ ID NO: 1347 - protein, 347 aa, Desulfitobacterium hafniense Y51
SLCMIVRNEEKTIARCLDSVCDIADEIIIVDTGSTDRTKEIVARYTDKIFDFAWIDDFAAARNYAFSLGTKEYLLWLDADDVILESDRLKFHNLKKNLNPSIDVVNMHYLLAFDSSENPTFTLRRNRLVRRGKNFRWKGAVHEYLEVSGNIMNSDIAIAHKSEEHDSERNLRIYEKRLEQGEEFSPRDLYYFANELYDHKQYEKAVEYYEKFLNTEKGWVEDNISACGKLADIYKLLGDSANAQAYLYKSFDYDTPRAEFCCRIGFNHLNAGKYQQAIFWYKLASELEKPTNSWGPKSEACWTYLPHLQLCVCYDRLGMHELAYKHNEIARDYRPDNPQILHNKKYL

SEQ ID NO: 1348 - protein, 355 aa, Clostridium kluyveri DSM 555
KDSITVSLCMIVKNEEDTIGRCLDSVKDVIDEFIIVDTGSSDNTKDVIKKYTDNIYDFEWIDDFSAARNFAFSKATKDYIFWLDADDVLLPEDVEKFKALKKNLDTSIDSVTMRYNVSFDEYSNVTTSYRRNRLVKKEKNFKWIGFVHEYLEVYGNIINSEISVTHKKINYSPNRNLEIFQNKLKEGVEFTPRDILYYGNELYEHRMFEDALKYYNDFLDSKRGWYEDNIHVCGKICDYYQSINNGEECRKYAFKSFEYDSPRAEACCRLGFSFLQENKINQAIFWYETAANLKKPINSLGFFSDACWTWLPHLQLCVCYDRIGKHQLAYEHNEIAGKFRPNDKKILYNRNYFQS

SEQ ID NO: 1349 - protein, 351 aa, Clostridium beijerinckii NCIMB 8052
TISLCMIVKNEEDVIANCLESVKDIVDEMIIVDTGSDDKTKKIVKRYTDKIYDFKWIDDFSAARNFAFSKATKDYILWLDADDVVLPEDGEKFKDLKETLDPTVDSVTAKYNTAFDEYGNVTASYRRNRLVKRSNNFQWFGFVHEYLAVGGNIINSEIAITHRKLKQTPKRNLEIYQNKLKEGVVFTPRDILYYGNELYDHRMFDEALQYYNKFLDSKQGWFEDNIRVCEKICDYYQSIDKVEDGRRYAFRSFEYDTPRAEACCKIGFSFLHEKKYKQSAFWYEQATKLEKPKDSWGFFNDACWTWLPHLQLCVCYDRLGDHNLAYEHNEIAAKFRPNDSRILYNRNYFKS

SEQ ID NO: 1350 - protein, 345 aa, Bacillus weihenstephanensis KBAB4
TISLCMIVKDEEQTISKCLESVKSVVDEIIIVDTGSTDGTKEIVKKYDAKVYDFQWIEDFSAARNFAFSKATKEYILWLDADDIIDTEDIKKLLQLKHTLDRSTDAVSMKYYLTFDIEGNPTHSLRRYRLVNRSKNFQWYGFVHEYLEVYGNLINSDVGVSHKKEKAYTNRNLKIYEKHLESGKEFSPRDVYYYANECKDHRLFDKAVKGYSRFLDEEKGWVEDNIQACLKRAECYLELGDLKKSIQSCLQSFTYDTPRGELCCHLGRVFLQQGEYSKAIYWYHAAIDGPRPKDSPFVREECHTWLPHIQLCICYDRIKEYEKAIYHNEQAALFIPNNPSIEYNR

SEQ ID NO: 1351 - protein, 366 aa, Artificial
  Substituion in SEQ ID NO 1344
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPDQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELEKP

SEQ ID NO: 1352 - protein, 366 aa, Artificial
  Substituion in SEQ ID NO 1344
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRLVRLVKRSRGFVWRGRVHEYLEINGNILNSDIAIIHRPVDHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELEKP

SEQ ID NO: 1353 - protein, 366 aa, Artificial
  Substituion in SEQ ID NO 1344
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDIATKCRRPANFVGFVNHACETWLPHIQLCVCYSRLGQYRKAYDHNERAAEYLGEDPMIVHNRSVLRAWMDGELEKP

SEQ ID NO: 1354 - protein, 366 aa, Artificial
  Substituion in SEQ ID NO 1344
MSAKTENTWSLCMIVKEEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELEKP

SEQ ID NO: 1355 - protein, 366 aa, Artificial
  Substituion in SEQ ID NO 1344
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELERP

SEQ ID NO: 1356 - DNA, 1101 bp, Artificial
  Substituion in SEQ ID NO 1345
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggatcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 1357 - DNA, 1101 bp, Artificial
  Substituion in SEQ ID NO 1345
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgatcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 1358 - DNA, 1101 bp, Artificial
  Substituion in SEQ ID NO 1345
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatattgcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 1359 - DNA, 1101 bp, Artificial
  Substituion in SEQ ID NO 1345
gtgtccgctaaaacggaaaatacttggagcttatgtatgatcgtgaaagaagaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 1360 - DNA, 1101 bp, Artificial
  Substituion in SEQ ID NO 1345
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagcgtccgtaa

SEQ ID NO: 1361 - protein, 79 aa, Alicyclobacillus acidocaldarius
MPCRRIVSVSPLTREGFGMARRRSTMSDAFKVELAKELGFYDTVQREGWGGIKARDAGNMVKRAIEIAEQALAEKSGQR

SEQ ID NO: 1362 - DNA, 240 bp, Alicyclobacillus acidocaldarius
gtgccttgccggcgcatcgtaagcgtgtcgcctctgaccagggagggatttggcatggcacggcggagaagcaccatgtcagatgcgttcaaagtggaactggccaaggagctcgggttctacgacacggtccagcgcgaaggctggggcgggatcaaagcgcgcgacgccgggaacatggtgaagcgcgccatcgagatcgcagagcaagcgttggctgagaagtccgggcagaggtga

SEQ ID NO: 1363 - protein, 61 aa, Bacillus halodurans C-125
MSRRRGIMSDRLKEEIAKELGFYDTVQQEGWGGIRARDAGNMVKRAIELAEQQLAERESSR

SEQ ID NO: 1364 - protein, 55 aa, Paenibacillus larvae subsp. larvae BRL-230010
RRRSTMSDQLKNELAKDLGFYDTVQKEGWGGIKAKDAGNMVKRAIQIAEQAAQKK

SEQ ID NO: 1365 - protein, 58 aa, Bacillus amyloliquefaciens FZB42
MGRRRGVMSDEFKYELAKDLGFYDTVKNEGWGGIRARDAGNMVKRAIEIAEQQMAAQN

SEQ ID NO: 1366 - protein, 58 aa, Bacillus cereus ATCC 14579
MSRRRGVMSNQFKEELAKELGFYDVVQKEGWGGIRAKDAGNMVKRAIEIAEQQLMKRN

SEQ ID NO: 1367 - protein, 58 aa, Bacillus anthracis str. Ames
MSRRRGVMSNQFKEELAKELGFYDVVQKEGWGGIRAKDAGNMVKRAIEIAEQQLMKQN

SEQ ID NO: 1368 - protein, 79 aa, Artificial
  Substituion in SEQ ID NO 1361
MPCRRIVSISPLTREGFGMARRRSTMSDAFKVELAKELGFYDTVQREGWGGIKARDAGNMVKRAIEIAEQALAEKSGQR

SEQ ID NO: 1369 - protein, 79 aa, Artificial
  Substituion in SEQ ID NO 1361
MPCRRIVSVSPLTREGFGMARRRSTMSDAFKVELAKDLGFYDTVQREGWGGIKARDAGNMVKRAIEIAEQALAEKSGQR

SEQ ID NO: 1370 - protein, 79 aa, Artificial
  Substituion in SEQ ID NO 1361
MPCRRLVSVSPLTREGFGMARRRSTMSDAFKVELAKELGFYDTVQREGWGGIKARDAGNMVKRAIEIAEQALAEKSGQR

SEQ ID NO: 1371 - protein, 79 aa, Artificial
  Substituion in SEQ ID NO 1361
MPCRRIISVSPLTREGFGMARRRSTMSDAFKVELAKELGFYDTVQREGWGGIKARDAGNMVKRAIEIAEQALAEKSGQR

SEQ ID NO: 1372 - protein, 79 aa, Artificial
  Substituion in SEQ ID NO 1361
MPCRRIVSVSPLTREGFGMARRRSTMSDAFKVELAKELGFYDTVNREGWGGIKARDAGNMVKRAIEIAEQALAEKSGQR

SEQ ID NO: 1373 - DNA, 240 bp, Artificial
  Substituion in SEQ ID NO 1362
gtgccttgccggcgcatcgtaagcatttcgcctctgaccagggagggatttggcatggcacggcggagaagcaccatgtcagatgcgttcaaagtggaactggccaaggagctcgggttctacgacacggtccagcgcgaaggctggggcgggatcaaagcgcgcgacgccgggaacatggtgaagcgcgccatcgagatcgcagagcaagcgttggctgagaagtccgggcagaggtga

SEQ ID NO: 1374 - DNA, 240 bp, Artificial
  Substituion in SEQ ID NO 1362
gtgccttgccggcgcatcgtaagcgtgtcgcctctgaccagggagggatttggcatggcacggcggagaagcaccatgtcagatgcgttcaaagtggaactggccaaggatctcgggttctacgacacggtccagcgcgaaggctggggcgggatcaaagcgcgcgacgccgggaacatggtgaagcgcgccatcgagatcgcagagcaagcgttggctgagaagtccgggcagaggtga

SEQ ID NO: 1375 - DNA, 240 bp, Artificial
  Substituion in SEQ ID NO 1362
gtgccttgccggcgcttagtaagcgtgtcgcctctgaccagggagggatttggcatggcacggcggagaagcaccatgtcagatgcgttcaaagtggaactggccaaggagctcgggttctacgacacggtccagcgcgaaggctggggcgggatcaaagcgcgcgacgccgggaacatggtgaagcgcgccatcgagatcgcagagcaagcgttggctgagaagtccgggcagaggtga

SEQ ID NO: 1376 - DNA, 240 bp, Artificial
  Substituion in SEQ ID NO 1362
gtgccttgccggcgcatcattagcgtgtcgcctctgaccagggagggatttggcatggcacggcggagaagcaccatgtcagatgcgttcaaagtggaactggccaaggagctcgggttctacgacacggtccagcgcgaaggctggggcgggatcaaagcgcgcgacgccgggaacatggtgaagcgcgccatcgagatcgcagagcaagcgttggctgagaagtccgggcagaggtga

SEQ ID NO: 1377 - DNA, 240 bp, Artificial
  Substituion in SEQ ID NO 1362
gtgccttgccggcgcatcgtaagcgtgtcgcctctgaccagggagggatttggcatggcacggcggagaagcaccatgtcagatgcgttcaaagtggaactggccaaggagctcgggttctacgacacggtcaatcgcgaaggctggggcgggatcaaagcgcgcgacgccgggaacatggtgaagcgcgccatcgagatcgcagagcaagcgttggctgagaagtccgggcagaggtga

SEQ ID NO: 1378 - protein, 294 aa, Alicyclobacillus acidocaldarius
MPVCGRLRPRTRAELRRRAMQRHERLIRLTRRLVERPMAPIGISALAEAWGVAKSTLSEDVQLVREVLAEDGAGRVETLVGAQGGVRFVPQVARDRAEAFLWDVARRLASPDRVIAGEFLYASDVLGDPDVIDTAGAMVASRFAHAGVEVVVTVETKGIPLAASAARYLHAPLAIVRREQRVTEGASLTTHYVSGSAKRIQTMSLSTRLVPRGARALIVDDFMRAGATARAVAELIGEFGGEVCGTAVFMATSQPAQKMVADYVALLEVGPVRESGFEVRPNLGALERRVTHVD

SEQ ID NO: 1379 - DNA, 885 bp, Alicyclobacillus acidocaldarius
gtgccggtttgtgggcggctacgcccacgcacacgcgcggagctgaggaggcgggccatgcagcggcatgaacggctcatccgcctgacccgccgactcgtcgagcgccccatggcgcccatcggcatctcggcgctggccgaggcgtggggcgtggctaagtcgacgctgagcgaggacgtgcaactcgtccgcgaagtgcttgccgaggacggcgccggccgggtggagacgctcgtcggggcccagggcggcgtgcgtttcgtgcctcaggtggcccgggatcgcgccgaagcctttctgtgggacgtcgctcgccgactcgcctcgcccgatcgcgtcatcgcgggcgagttcttgtacgcgtcggatgtgctcggcgatccggacgtgatcgacacggcgggcgccatggtggcgagccgattcgcccacgcgggcgtcgaggtcgtggtgaccgtcgagacgaaggggatcccgctcgccgcgagcgccgcgcggtatttgcacgcgccgctcgccatcgtccggcgcgagcagcgcgtgacagagggcgcatcgctcacgacgcactacgtgtccgggtcggcgaagcgcatccagaccatgtccttgagcacccggctcgttccgaggggcgcgcgggcgctcatcgtggacgacttcatgcgcgcgggcgccacggcccgggcggtggccgagctcatcggcgagtttggcggcgaggtctgcggcacggcggtctttatggccacctcgcagcccgcgcagaaaatggtcgccgactacgtggcgctgctcgaggtcggccccgtgcgcgagagcggctttgaggttcgccccaacctcggcgcgctggagcggcgcgttacccatgtcgattga

SEQ ID NO: 1380 - protein, 262 aa, Thermosinus carboxydivorans Nor1
ERVVALTKLLVDRPHHLFSLGYFSELFGAAKSTISEDILTIKQALQSFGLGTLETVSGAAGGVRYLPQQEAAAINGLLTDLAERLKSADRIIPGGFLYMSDILFDSQLMLQIGEVFMTRFQHLAPDCVMTVETKGIPLAFATARAFHVPLVIVRRGSKVTEGPAVSINYVTGSSRRIQTMSLAKRAVPAGARVLIIDDFMKAGGTARGLVDLAQEVGARVVGVGVLVATAEPQEKLVEDYVALLILHEVDEHTKKTDIRPAL

SEQ ID NO: 1381 - protein, 256 aa, Symbiobacterium thermophilum IAM 14863
QRLVAIMKLLSERPGELLPLSFFTERFGAAKSTISEDLALVKEALEADGSGRLRTHAGAAGGVQYWPLPSREEEQETLLELCRLLSDPGRILPGGFVYMTDLITHPIWSARIGAIMAARFIDAEPDVVLTVETKGIPLALMVARALGLPMVVARREGRVTEGPSVTLHYISGSRRIHTMTVGLRALWRGARVLVVDDFMKAGATARAMVDVAGEMGASVAGVGVFVSTAEPARKQVQRYVSLLTLEQVDEVARTVR

SEQ ID NO: 1382 - protein, 249 aa, Bacillus sp. NRRL B-14911
ERLIDMTNYLLEHPRQLVSLTFFADRYGSAKSSISEDLAIIKETFEQRGIGTLQTVPGAAGGVKYSVKVSDDEARPFISGLCEVIASPERLLPGGYLYMTDILGDPAIVQKAGRVFASAFADADIDVVMTVATKGIPLAYAVGAYLNVPVVIVRRDSRVTEGSTVSINYVSGSAKRIQTMVLSKRSLEEGSKVLIVDDFMKAGGTVNGMISMLEEFKAHVAGIAVLVEAEKAEERLVDEYLSLVQLADV

SEQ ID NO: 1383 - protein, 260 aa, Lactobacillus gasseri ATCC 33323
ERLVDMVKYLLARPHTLIALPFFADRYGAAKSSISEDLAILRQTLANDQNGILETVAGAAGGVRYIPFVGKKEATNYLHDLADRIEDPDRILPGNFVYLSDILGSPQDLQQIGQLIATKYAYSNVDYVMTIETKGIAIAQAVSRFLNVPFVMVRRRPKITEGSTISVNYVASSSERVEKMELAKRLLPEGSNVLIVDDFMKGGGTLTGMEELVKEFKGTVAGMCVLCETKYASQKVVDDYQSLIKITEVDRTKKLIKVRP

SEQ ID NO: 1384 - protein, 249 aa, Lactobacillus johnsonii NCC 533
ERLVDMVKYLLARPHTLIALPFFADRYGAAKSSISEDLAILRQTLANDQNGILETVAGAAGGVRYIPFVGKKEATDYLHDLADRIEDPDRILPGNFVYLSDILGSPQDLRQIGQLIATKYAYSNIDYVMTIETKGIALAQAVSRFLNVPFVMVRRRPKITEGSTISVNYVASSSERVEKMELAKRLLPEGSNVLIVDDFMKGGGTLTGMEELVKEFKGTVAGMCVLCETKYASQKVVDDYQSLIKITEV

SEQ ID NO: 1385 - protein, 294 aa, Artificial
  Substituion in SEQ ID NO 1378
MPVCGRLRPRTRAELRRRAMQRHERLIRLTRRLVERPMAPIGISALAEAWGVAKSTLSEDVQLVREVLAEDGAGRVETLVGAQGGVRFVPQVAKDRAEAFLWDVARRLASPDRVIAGEFLYASDVLGDPDVIDTAGAMVASRFAHAGVEVVVTVETKGIPLAASAARYLHAPLAIVRREQRVTEGASLTTHYVSGSAKRIQTMSLSTRLVPRGARALIVDDFMRAGATARAVAELIGEFGGEVCGTAVFMATSQPAQKMVADYVALLEVGPVRESGFEVRPNLGALERRVTHVD

SEQ ID NO: 1386 - protein, 294 aa, Artificial
  Substituion in SEQ ID NO 1378
MPVCGRLRPRTRAELRRRAMQRHERLIRLTRRLVERPMAPIGISALAEAWGVAKSTLSEDVQLVREVLAEDGAGRVETLVGAQGGVKFVPQVARDRAEAFLWDVARRLASPDRVIAGEFLYASDVLGDPDVIDTAGAMVASRFAHAGVEVVVTVETKGIPLAASAARYLHAPLAIVRREQRVTEGASLTTHYVSGSAKRIQTMSLSTRLVPRGARALIVDDFMRAGATARAVAELIGEFGGEVCGTAVFMATSQPAQKMVADYVALLEVGPVRESGFEVRPNLGALERRVTHVD

SEQ ID NO: 1387 - protein, 294 aa, Artificial
  Substituion in SEQ ID NO 1378
MPVCGRLRPRTRAELRRRAMQRHERLIRLTRRLVERPMAPIGISALAEAWGVAKSTLSEDVQLVREVLAEDGAGRVETLVGAQGGVRFVPQVARDRAEAFLWDVARRLASPDRVIAGEFLYASDVLGDPDVIDTAGAMVASRFAHAGVEVVVTVETKGIPLAASAARYLHAPLAIIRREQRVTEGASLTTHYVSGSAKRIQTMSLSTRLVPRGARALIVDDFMRAGATARAVAELIGEFGGEVCGTAVFMATSQPAQKMVADYVALLEVGPVRESGFEVRPNLGALERRVTHVD

SEQ ID NO: 1388 - protein, 294 aa, Artificial
  Substituion in SEQ ID NO 1378
MPVCGRLRPRTRAELRRRAMQRHERLIRLTRRLVERPMAPIGISALAEAWGVAKSTLSEDVQLVREVLAEEGAGRVETLVGAQGGVRFVPQVARDRAEAFLWDVARRLASPDRVIAGEFLYASDVLGDPDVIDTAGAMVASRFAHAGVEVVVTVETKGIPLAASAARYLHAPLAIVRREQRVTEGASLTTHYVSGSAKRIQTMSLSTRLVPRGARALIVDDFMRAGATARAVAELIGEFGGEVCGTAVFMATSQPAQKMVADYVALLEVGPVRESGFEVRPNLGALERRVTHVD

SEQ ID NO: 1389 - protein, 294 aa, Artificial
  Substituion in SEQ ID NO 1378
MPVCGRLRPRTRAELRRRAMQRHERLIRLTRRLVERPMAPIGISALAEAWGVAKSTLSEDVQLVREVLAEDGAGRVETLVGAQGGVRFVPQVARDRAEAFLWDVARRLASPERVIAGEFLYASDVLGDPDVIDTAGAMVASRFAHAGVEVVVTVETKGIPLAASAARYLHAPLAIVRREQRVTEGASLTTHYVSGSAKRIQTMSLSTRLVPRGARALIVDDFMRAGATARAVAELIGEFGGEVCGTAVFMATSQPAQKMVADYVALLEVGPVRESGFEVRPNLGALERRVTHVD

SEQ ID NO: 1390 - DNA, 885 bp, Artificial
  Substituion in SEQ ID NO 1379
gtgccggtttgtgggcggctacgcccacgcacacgcgcggagctgaggaggcgggccatgcagcggcatgaacggctcatccgcctgacccgccgactcgtcgagcgccccatggcgcccatcggcatctcggcgctggccgaggcgtggggcgtggctaagtcgacgctgagcgaggacgtgcaactcgtccgcgaagtgcttgccgaggacggcgccggccgggtggagacgctcgtcggggcccagggcggcgtgcgtttcgtgcctcaggtggccaaagatcgcgccgaagcctttctgtgggacgtcgctcgccgactcgcctcgcccgatcgcgtcatcgcgggcgagttcttgtacgcgtcggatgtgctcggcgatccggacgtgatcgacacggcgggcgccatggtggcgagccgattcgcccacgcgggcgtcgaggtcgtggtgaccgtcgagacgaaggggatcccgctcgccgcgagcgccgcgcggtatttgcacgcgccgctcgccatcgtccggcgcgagcagcgcgtgacagagggcgcatcgctcacgacgcactacgtgtccgggtcggcgaagcgcatccagaccatgtccttgagcacccggctcgttccgaggggcgcgcgggcgctcatcgtggacgacttcatgcgcgcgggcgccacggcccgggcggtggccgagctcatcggcgagtttggcggcgaggtctgcggcacggcggtctttatggccacctcgcagcccgcgcagaaaatggtcgccgactacgtggcgctgctcgaggtcggccccgtgcgcgagagcggctttgaggttcgccccaacctcggcgcgctggagcggcgcgttacccatgtcgattga

SEQ ID NO: 1391 - DNA, 885 bp, Artificial
  Substituion in SEQ ID NO 1379
gtgccggtttgtgggcggctacgcccacgcacacgcgcggagctgaggaggcgggccatgcagcggcatgaacggctcatccgcctgacccgccgactcgtcgagcgccccatggcgcccatcggcatctcggcgctggccgaggcgtggggcgtggctaagtcgacgctgagcgaggacgtgcaactcgtccgcgaagtgcttgccgaggacggcgccggccgggtggagacgctcgtcggggcccagggcggcgtgaaattcgtgcctcaggtggcccgggatcgcgccgaagcctttctgtgggacgtcgctcgccgactcgcctcgcccgatcgcgtcatcgcgggcgagttcttgtacgcgtcggatgtgctcggcgatccggacgtgatcgacacggcgggcgccatggtggcgagccgattcgcccacgcgggcgtcgaggtcgtggtgaccgtcgagacgaaggggatcccgctcgccgcgagcgccgcgcggtatttgcacgcgccgctcgccatcgtccggcgcgagcagcgcgtgacagagggcgcatcgctcacgacgcactacgtgtccgggtcggcgaagcgcatccagaccatgtccttgagcacccggctcgttccgaggggcgcgcgggcgctcatcgtggacgacttcatgcgcgcgggcgccacggcccgggcggtggccgagctcatcggcgagtttggcggcgaggtctgcggcacggcggtctttatggccacctcgcagcccgcgcagaaaatggtcgccgactacgtggcgctgctcgaggtcggccccgtgcgcgagagcggctttgaggttcgccccaacctcggcgcgctggagcggcgcgttacccatgtcgattga

SEQ ID NO: 1392 - DNA, 885 bp, Artificial
  Substituion in SEQ ID NO 1379
gtgccggtttgtgggcggctacgcccacgcacacgcgcggagctgaggaggcgggccatgcagcggcatgaacggctcatccgcctgacccgccgactcgtcgagcgccccatggcgcccatcggcatctcggcgctggccgaggcgtggggcgtggctaagtcgacgctgagcgaggacgtgcaactcgtccgcgaagtgcttgccgaggacggcgccggccgggtggagacgctcgtcggggcccagggcggcgtgcgtttcgtgcctcaggtggcccgggatcgcgccgaagcctttctgtgggacgtcgctcgccgactcgcctcgcccgatcgcgtcatcgcgggcgagttcttgtacgcgtcggatgtgctcggcgatccggacgtgatcgacacggcgggcgccatggtggcgagccgattcgcccacgcgggcgtcgaggtcgtggtgaccgtcgagacgaaggggatcccgctcgccgcgagcgccgcgcggtatttgcacgcgccgctcgccatcattcggcgcgagcagcgcgtgacagagggcgcatcgctcacgacgcactacgtgtccgggtcggcgaagcgcatccagaccatgtccttgagcacccggctcgttccgaggggcgcgcgggcgctcatcgtggacgacttcatgcgcgcgggcgccacggcccgggcggtggccgagctcatcggcgagtttggcggcgaggtctgcggcacggcggtctttatggccacctcgcagcccgcgcagaaaatggtcgccgactacgtggcgctgctcgaggtcggccccgtgcgcgagagcggctttgaggttcgccccaacctcggcgcgctggagcggcgcgttacccatgtcgattga

SEQ ID NO: 1393 - DNA, 885 bp, Artificial
  Substituion in SEQ ID NO 1379
gtgccggtttgtgggcggctacgcccacgcacacgcgcggagctgaggaggcgggccatgcagcggcatgaacggctcatccgcctgacccgccgactcgtcgagcgccccatggcgcccatcggcatctcggcgctggccgaggcgtggggcgtggctaagtcgacgctgagcgaggacgtgcaactcgtccgcgaagtgcttgccgaggaaggcgccggccgggtggagacgctcgtcggggcccagggcggcgtgcgtttcgtgcctcaggtggcccgggatcgcgccgaagcctttctgtgggacgtcgctcgccgactcgcctcgcccgatcgcgtcatcgcgggcgagttcttgtacgcgtcggatgtgctcggcgatccggacgtgatcgacacggcgggcgccatggtggcgagccgattcgcccacgcgggcgtcgaggtcgtggtgaccgtcgagacgaaggggatcccgctcgccgcgagcgccgcgcggtatttgcacgcgccgctcgccatcgtccggcgcgagcagcgcgtgacagagggcgcatcgctcacgacgcactacgtgtccgggtcggcgaagcgcatccagaccatgtccttgagcacccggctcgttccgaggggcgcgcgggcgctcatcgtggacgacttcatgcgcgcgggcgccacggcccgggcggtggccgagctcatcggcgagtttggcggcgaggtctgcggcacggcggtctttatggccacctcgcagcccgcgcagaaaatggtcgccgactacgtggcgctgctcgaggtcggccccgtgcgcgagagcggctttgaggttcgccccaacctcggcgcgctggagcggcgcgttacccatgtcgattga

SEQ ID NO: 1394 - DNA, 885 bp, Artificial
  Substituion in SEQ ID NO 1379
gtgccggtttgtgggcggctacgcccacgcacacgcgcggagctgaggaggcgggccatgcagcggcatgaacggctcatccgcctgacccgccgactcgtcgagcgccccatggcgcccatcggcatctcggcgctggccgaggcgtggggcgtggctaagtcgacgctgagcgaggacgtgcaactcgtccgcgaagtgcttgccgaggacggcgccggccgggtggagacgctcgtcggggcccagggcggcgtgcgtttcgtgcctcaggtggcccgggatcgcgccgaagcctttctgtgggacgtcgctcgccgactcgcctcgcccgaacgcgtcatcgcgggcgagttcttgtacgcgtcggatgtgctcggcgatccggacgtgatcgacacggcgggcgccatggtggcgagccgattcgcccacgcgggcgtcgaggtcgtggtgaccgtcgagacgaaggggatcccgctcgccgcgagcgccgcgcggtatttgcacgcgccgctcgccatcgtccggcgcgagcagcgcgtgacagagggcgcatcgctcacgacgcactacgtgtccgggtcggcgaagcgcatccagaccatgtccttgagcacccggctcgttccgaggggcgcgcgggcgctcatcgtggacgacttcatgcgcgcgggcgccacggcccgggcggtggccgagctcatcggcgagtttggcggcgaggtctgcggcacggcggtctttatggccacctcgcagcccgcgcagaaaatggtcgccgactacgtggcgctgctcgaggtcggccccgtgcgcgagagcggctttgaggttcgccccaacctcggcgcgctggagcggcgcgttacccatgtcgattga

SEQ ID NO: 1395 - protein, 1190 aa, Alicyclobacillus acidocaldarius
MCWEGDKVKGLVELMAADGALSSLADGMGPRRNDILITGVTGAGRQLVMAALYHLRNRRLPESMIVVTHTASHAQTIWEDLKEYLPDARVYLYPERDNALVDYLASSSDVLADRLHVLEALAQEGPVVVVTTLLAAWQPVTKKSHFLHSLVNLAVGESKPIDDVVAQLVRGGYERVSLVESRGQFSVRGGILDVFPMGHDLPYRIEWFDTDIDSIRTFDPATQRSQDKRDRVSFGPAFDLMLPQPVADKVADELEARLEARLKTVTDAALRDRLEQSISADIRKLREGQPFAGVARYQLLYPEHADTLFDHVPQPAFVCFDETARILERADVLEKEFREWLSGAMMRGEVLSGTVDAIHYEAKFQELNRPKVHFATFAHTRGSQRYQQVLNISARSMQNFHGQMNVLKQELARWEKAHTQVVFAAATKERADHLARVLDDYRIQADQVEVFTPGSKVPQIVVANLSSGFELPMHRIAVIVETEVFTAKRKHRQTRAQVSDAERIKSYQELNVGDYVVHVNHGIGRYMGIKTLEVDGRRNDYLYLSYAGGDSLYVPVDQIDQIQRYIGSGEKEPKLHSLGSSEWQKTKNRVKKSVRDIAGDLLKLYAKREATPGHAFSPDTPWQADFENMFPYEETPDQLRAIAEIKRDMEKPRPMDRLLCGDVGYGKTEVAMRAAFKAVMDGKQVAVLVPTTVLAQQHYETFKERFAGFPVKIEMLSRFRTRKETQEVLKGLKEGTIDIVIGTHRLLQNSVQFKDLGLLIVDEEQRFGVTHKEKLKQLRANVDCLTLTATPIPRTLHMSMLGVRDLSIIETPPENRFPVQTYVVEYNEGLVKEAIERELARGGQVYFVYNDVQTIHRMAERVQSLVPDARVSVAHGQMAEAELERVMLDFLEGEYDVLVTTTIIETGLDIPNVNTLIVYDADKFGLSQLYQLRGRVGRSNRIAYAYFTYQPAKVLSEVAEKRLAAIKEFTELGSGFKIAMRDLSIRGAGNLLGAEQHGFINSVGFDMYTELLQQAIRELRGEQLEKPVEPTIDVPVEAYIPDTYISDPSQKVAMYKRFRAIQAVSEADDLEDELIDRYGDPPQEVRNLLDVTRLKSLAMQAHADHIATQGADTTVRFPNEKHAPVDYPKLLSMAVKHKAQVTSRPNGMIFVAFRTKGLAGDEIVRRIIAFLTDYLEMVRQSKKQEEVAGV

SEQ ID NO: 1396 - DNA, 3573 bp, Alicyclobacillus acidocaldarius
gtgtgctgggagggggacaaggtgaagggtctcgtcgaactcatggccgcggacggggcgctttcgtcattggcggatgggatggggccgcgcagaaacgacatactcatcacgggcgtgaccggggccgggcggcagctcgtgatggcggccttgtaccatctccgcaatcgccgtctcccagagtcgatgattgtggtgacgcatacggccagtcacgcccagaccatctgggaggacttgaaggagtacctgccggatgcgcgcgtctatctctatcccgagcgagacaacgcgctcgtcgattacctggcgtcgtcgtcggacgtactggcggatcggctgcacgtccttgaggccctcgcgcaggagggccctgtcgttgtggtcacgacccttttggccgcctggcagccggtgacgaaaaagagccattttctacactcgctggtgaacctcgcggtaggtgaatcgaagccgattgacgacgtcgtagcgcagctagtgcgcggcggctacgagcgcgtgagcctcgtggagagccgcggccagttcagcgtgcgcggcggcatcctcgacgtctttccgatgggccacgatctcccctaccgcatcgagtggttcgacacggacattgactccatccggacgttcgatcccgccacgcagcgatcccaggacaagcgggatcgcgtgtcgtttggccctgcattcgacctgatgcttcctcagcccgttgcggacaaggtggcggatgaactcgaggcgcggcttgaagccaggctgaagacggtgacggatgcggcgctccgggatcggctggagcagtccatctccgcggatatccgcaagctgcgcgaggggcagccgttcgcgggcgtggctcgttatcagcttctgtatcccgaacacgcggacaccctgttcgatcacgtcccccagcctgcgttcgtctgcttcgacgagacggctcgcatcctggagcgcgcggacgtgctcgagaaggagtttcgcgagtggctgtcgggcgccatgatgcggggcgaggtgctctcgggcacggtcgacgccattcactacgaggcgaagtttcaagagttgaatcggccgaaggtgcacttcgcgacgttcgcccacacgcgcggcagtcagcggtatcagcaggtgctcaacatctccgcgcgcagcatgcagaatttccacgggcagatgaacgtgttgaaacaagagctcgcgcgctgggagaaggcgcacacgcaggtggtgtttgcggccgcgaccaaggagcgggcggatcacctggcgcgcgtcctggacgactatcgcatccaggccgatcaggtggaggtctttacgccgggatcgaaggtgccgcagatcgtcgtcgccaacctgtcaagcgggttcgagttgccgatgcaccgcatcgccgtgatcgtcgagaccgaggtgttcacggcgaagcggaagcatcgccagacgcgcgcgcaggtctcggatgcggagcggatcaagagctaccaggaactgaatgtcggcgactacgtggtgcacgtgaatcacggcattggccggtacatgggtatcaagacgcttgaggtcgatggtcgccgcaacgactacctgtacctgagctacgcgggcggcgacagcctgtacgtgccggtggaccagatcgatcagatccagcggtacatcggctccggcgagaaggagccgaagctgcacagcctcgggtcgagcgaatggcagaagacgaagaaccgcgtcaagaagtcggtgcgcgacatcgcgggcgatctcctgaagctctacgcgaagcgcgaggcgacgcccgggcacgcgttctcgcccgacacgccatggcaggcggacttcgagaacatgttcccgtacgaggagacgccggaccagcttcgcgccatcgcggagatcaagcgggacatggagaagccgcgcccgatggataggctcctgtgcggcgacgtgggctacggcaagacggaggtcgccatgcgcgcggcgttcaaggcggtcatggacgggaaacaagtcgcggtgctggtgccgacgacggtcctcgcgcagcagcactacgagacgttcaaggagcggttcgccggcttcccagtgaagattgagatgctgagccgcttccggacgcgcaaagagacgcaggaggtgttgaagggcctcaaggaggggaccatcgacatcgtcatcggcacgcaccggcttttgcagaactcggtgcagttcaaggacctggggcttctgattgtggacgaggaacagcgcttcggcgtgacccacaaggaaaagctgaagcagttgcgcgcgaatgtggactgtttgacgctgaccgcgacgcccatcccgcgcacgctccacatgtccatgctcggcgtgcgcgatctgtccatcatcgagacgccgcccgagaaccggtttccggtccagacgtacgtcgtggagtacaacgaggggcttgtcaaagaggccatcgagcgcgaactcgcccgcggcggacaggtgtacttcgtgtacaacgacgtccagaccatccaccgcatggccgagcgcgtgcagtcgctcgtgcccgatgcgcgcgtgagcgtggcgcacggtcagatggcggaggcggagctcgagcgcgtgatgctcgactttctcgagggcgagtacgacgtgctcgtcaccaccaccatcatcgagacggggctcgacattccgaacgtgaacaccttgattgtgtacgacgccgacaagttcggtctgtcccagttgtatcagctgcgcggccgcgtcggccgatccaaccggattgcgtacgcatatttcacctatcagccggccaaggtgctgtcggaggtcgcggaaaagcggctggcggccatcaaggagttcaccgagctcggcagcggcttcaagatcgccatgcgtgacctgtccatccgcggcgctggcaacttgctcggggccgagcaacacgggttcatcaactctgtgggcttcgacatgtacacggagctcttgcagcaggccattcgcgagctgcgcggcgagcagctggagaagcccgtcgaaccgaccatcgacgtgcccgtcgaggcgtacattccagacacctatatctccgatccgtctcagaaggtggccatgtacaagcggttccgggcgattcaggctgtgtccgaggcggacgatctcgaggacgagctcatcgatcgctacggcgatccgccgcaggaggtgcgcaatctgctcgacgtgacgaggctcaagagcctcgcgatgcaggcgcacgcggatcacatcgcgacgcagggtgccgacacgaccgtgcggtttccgaacgagaagcatgcgcccgtcgattatccgaagctcctgtccatggcggtcaagcacaaggcgcaggtcacctcgcggccgaacggcatgatctttgtcgcgttccgaaccaagggcctcgcgggggacgagatcgtccggaggatcatcgccttcttgacggattacctggagatggtgcggcagtcgaaaaagcaggaagaggtggcgggcgtctga

SEQ ID NO: 1397 - protein, 1173 aa, Bacillus clausii KSM-K16
GLQQLVGSVKEVRAVAKGIENDMNEQLLTGLTGSARTVVSAALFRETGRSQLVVTHNLYQAQKIYEDLVELLDEDTVYLYPVNELISAEIAVASPEMKAQRLDLLNALVQDFKGIVVAPLAGIRRLLPPKALWQSSQLHLKTGEDIGDLEEFIKNFVTMGYRRSDMVSAPGEFSVRGGIVDLYPLTKEHPLRIELFDTEVDSMRYFSLETQRSEGMIDEVTIGPAQEVLLHHSHYSHGAKLLEEKYEATLKKVASKQTRDKLQEHIPFEIAQLKQSATFEGMYKYMSLYYETPQSLLSYMPEDAFVWVDEMNRVKEMAEHLQKEEAEWHTAMLEQGSIVHGTHLSLDALARLQQAPQPVLYTSLFQKQVPSTKPEQIINLSCKSMQNFHGQMDLLTSEVNRWLSNDYTVLFIAGTEDRANRLALNLEDEKIDAHLIEAITDLTPSKVQIYTGHLHTGFELSEQKLVVVTEEEVFSKRAKRPKRRQKLSNAERIKSYSELAVGDLVVHTNHGVGKYLGVETLEINGVHKDYLNLRYAGNDKLYVPVEQIDQVQKYVGTEEKDPKIYALGGSDWKKVKKKVQTSVEDIADDLIKLYAEREASVGHRFSSDGPEQAEFESSFPYQETEDQLRAIKEIKEDMEKQRPMDRLLCGDVGYGKTEVAIRAAFKAIMDGKQVAILVPTTILAQQHFETISDRFSDFPITVGVLSRFRSRKEQTEVLKGLKAGSVDLVVGTHRLLSKDVQFRDLGLLIVDEEQRFGVTHKEKIKRMKANIDVLTLTATPIPRTLHMSMLGVRDLSVIETPPENRFPVQTYVVEFNPAIVREAIERELSRGGQVYVLYNRVEDIERMTEQISTLVPDARVSYAHGQMNERELESIILDFLEGESDVLVTTTIIETGVDIPNVNTLIVCNADKMGLSQLYQIRGRVGRSNRVAYSYFTYQPDKVLTEVAEKRLQAIKEFTELGSGFKIAMRDLTIRGAGNLLGSQQHGFIDSVGFDLYSQMLKEAIEERKGEKPKEPPFKAELNVNIDAYIPERYIPDAKQKIEMYKRFKGVETLEEIADLQDELVDRFGEYPKQVAYLFEMTKIKLIADQEKVEKITEGKDAVTILLTEETTNRIHVATLVDAAQKIGRDVSIGSQGNQIKLVIKTKQLSDETLLAYIIELLEALIRADKSKK

SEQ ID NO: 1398 - protein, 1167 aa, Bacillus halodurans C-125
GLQRFIQEQEDTQAIVQGLEVNMKEQLVSGLSGSARPAVMAALYKETRRPQLVITYNLYQAQKIFEDLVELVGADHVLLYPVNDLISSEIAIASPEMKAQRIDVLNQLVAGFSGIVVVPLAGMRRLLPPSSLWKESQIRLSVGDDIGDLESLIRRLVRNGFTRVDMVTTPGECSVRGGIIDLYPLTEEDPIRIELFDTEIDSIRTFTIEDQRSKDSLSEVVIGPAAEIIMDEEHFIQGASRLEDRLSQTLKKVKKKEVKEKLTEQISFDISELKQKHPFPSMYKYISLFYDDTYSLFSYVPSNGVIFVDEMSRVKEMSESLEKEEAEWHTTLIEQGEIVHDVTLAHSVLEQMKQGVLPIVYLSLFVRHVPSTNPQNIISFQCKSMQNFHGQMPLLQSEVKRWISSQFATVFIAATRERAKRLNHVLAEEGIEALVVDGEAPLTPGQAQIMVGALTSGFELTLHKLVVITEEEIFAKKVKRPQRKQKLSNAERIKNYSELKVGDLVVHTNHGIGKYLGIETLEINGVHKDYLHIRYAGNDKLYVPVEQIDQVQKYVGAEDKDPKLYSLGKSDWKKVKRRVQSSVEDIADDLIKLYAEREASKGFAFAPDGPEQAEFEASFPYQETEDQLRAIQEIKEDMEKERPMDRLLCGDVGYGKTEVAIRAAFKAIMNGKQVAILVPTTILAQQHFETIQERFADYPINIGVLSRFRSRKEQSQTLKGLKAGSVDLVVGTHRLLSKDVQFKDLGLLIVDEEQRFGVTHKEKIKQLKANIDVLTLTATPIPRTLHMSMLGVRDLSVIETPPENRFPVQTYVVEYNSPLVREAIERELSRGGQVYFLYNRVENIERMANEISMLVPDARVSFAHGQMKESELESIMLAFLEGESDVLVTTTIIETGVDIPNVNTLIIHGADKMGLSQLYQIRGRVGRSNRVAYAYFTYQRDKVLSEVAEKRLQAIKEFTELGSGFKIAMRDLAIRGAGNLLGAQQHGFIESVGFDLYSQMLKEAIEKRKGEQPKEEPRNVEIDVQVDAYIPDSYIQDAKQKIEMYKRFRGVETIEEINDLKDEMFDRFGEYPQEVSDLLQLTTIKIIAYQEGVESIVESKGQWIILLSPETTEGIDGAKLFEVIHKLDQQVGLGTEGERIKLTLKTKQLGTNQLLEVTETLLASLAD

SEQ ID NO: 1399 - protein, 1125 aa, Bacillus cereus subsp. cytotoxis NVH 391-98
GLLEQFYKNKEVQSIINGLEEGLKEQLVSGMATSSRSLLMAALYKKTKQSQLVVTHNLYQAQKIYEDLVSLLGEKDVWLYPVNELIASEVGVASPELKAQRIEVLNRLAAGENGIIVAPVAGLRRFLPMKELWKQKQIEINLGQEVDLDALLHTLHHIGYERKSMVEAPGEFSLRGGILDIYPLTEELPFRIEFFDTEVDSIRLFDVEEQRSQDKRESVKFGPATEFVFSPEELRVGIEHLEKGLMKTMQKLSDDKIKTAVLETVSHEIELLKNGQNIEQMFKYLSIFYKEPASLIDYLPENGVVILDEISRVQETASHLETEEAEWYTSLLSEGAIIQDLVFSHSFEEFLRHKKRSFVYLTLFLRHIAHTHPQNIVNVTCKTMQDFHGQMQLLKTEIDRWNEGQFTTVILGTDEERAKKLQHILSDYDIEADIIESTDILLPGRLQIAVGDLHAGFEMPMQKLVVITEKELFHKKVKKSRRKQKLSNAERIKSYSELKVGDYVVHVNHGIGKFLGIETLEINGVHKDYLNIKYQGNDKLYVPIEQIDQVQKYVGSEGKDPKVYKLGGNDWKKVKTKVEKSVQDIADDLIKLYAEREASKGYAFTPDTAEQREFESSFPYQETEDQLRSIEEIKKDMERSRPMDRLLCGDVGYGKTEVAIRAAFKAIMDEKQVAILVPTTILAQQHYETIRERFQDYPINIGLLSRFRTRKEQNETIKGLKDGTVDIVIGTHRILSKDVTYKDLGLLIIDEEQRFGVTHKEKIKQLKANIDVLTLTATPIPRTLHMSMLGVRDLSVIETPPENRFPVQTYVVEYNPALIREAIERELARGGQIYFLYNRVEDIERKADEISMLVPEARVTYAHGKMNESELESVMLSFLEGQYDVLVSTTIIETGVDIPNVNTLIVYDADRMGLSQLYQLRGRVGRSNRVAYAYFAYKRDKVLSEVAEKRLQAIKEFTELGSGFKIAMRDLSIRGAGNLLGAEQHGFIDSVGFDLYSQMLKDAIEQRKGKQGIENTIDVEIDLEVDAYLPDSYISDSKQKIMMYKQFRGVSTLEDIEELQEEMIDRFGDYPQEVGYLLQIANIKVLAMKEQIELIKQTKSEVTFLFSEQASQNIDGGKLFMLGNK

SEQ ID NO: 1400 - protein, 1151 aa, Bacillus thuringiensis str. Al Hakam
KMIGLLEQFYKNEEIQSVINGLEDGLKEQLVSGMATSSRSLLMAALYKKTKKSQLIVTHNLYQAQKVHEDLVALLGEKDVWLYPVNELIASELGVASPELKAQRIEVLNRLAAGEHGIIVAPVAGLRRFLPMKELWKQRQIEISLGQEIDLDTFLHTLHHIGYERKSMVEAPGEFSLRGGILDIYPLTEELPFRIEFFDTEVDSIRLFDVDEQRSQDKKESVRFGPATEFLFSQEELKSGIKHLEEGLTKTMQKLSDDKLKTTVLETVSHEIEMLKNGQSIEQMFKYLSIFYNEPASLIDYLPEDGVVILDEISRIQETASHLESEEAEWYISLLGEGTIIQDLSFSHSFEEFLHHKKRSFVYLTLFLRHIAHTHPQNIVNVTCKTMQDFHGQMQLLKTEIDRWNEGHFTTVVLGTDDERVKKLQHILSDYDIDADIVEGTDILLPGRLQIAVGDLHAGFEMPMQKLVVITEKELFHKKVKKSQRKQKLSNAERIKSYSELKVGDYVVHVNHGIGKFLGIETLEINGVHKDYLNIKYQGNDKLYVPIEQIDQVQKYVGSEGKDPKVYKLGGNDWKKVKTKVEKSVQDIADDLIKLYAEREASKGYAYTPDTAEQQEFESSFPYQETEDQLRSIEEIKKDMERGRPMDRLLCGDVGYGKTEVAIRAAFKAIMDEKQVAILVPTTILAQQHYETIRERFQDYPINIGLLSRFRTRKQQNETIKGLKDGTVDIVIGTHRILSKDVTYKDLGLLIIDEEQRFGVTHKEKIKQLKANVDVLTLTATPIPRTLHMSMLGVRDLSVIETPPENRFPVQTYVVEYNPALMREAIERELARGGQVYFLYNRVEDIERKADEISMLVPDARVTYAHGKMNESELESVMLSFLEGQHDVLVSTTIIETGVDIPNVNTLIVFDADRMGLSQLYQLRGRVGRSNRVAYAYFAYKRDKVLSEVAEKRLQAIKEFTELGSGFKIAMRDLSIRGAGNLLGAEQHGFIDSVGFDLYSQMLKDAIEQRRGTDGVENTVNVEIDLEVDAYLPDAYISDSKQKIMMYKQFRGVSAIEDIEELQEEMIDRFGDYPQEVGYLLQIANIKVLAMKEQIELIKQNKFEVTILFSEQASQNIDGGKLFMLGNSFGRMIGLGMEGSQLKIVMKTNGL

SEQ ID NO: 1401 - protein, 1148 aa, Bacillus cereus ATCC 10987
GLLEQFYKNEEIQSVINGLEDGLKEQLVSGMATSSRSLLMAALYKKTKKSQLIVTHNLYQAQKVHEDLVALLGEKDVWLYPVNELIASELGVASPELKAQRIEVLNRLAAGEHGIIVAPVAGLRRFLPMKELWKQRQIEISLGQEIDLDTFLHTLHHIGYERKSMVEAPGEFSLRGGILDIYPLTEELPFRIEFFDTEVDSIRLFDVDEQRSQDKKESVRFGPATEFLFSQEELKSGIKHLEEGLTKTMQKLSDDKLKTTVLETVSHEIEMLKNGQSIEQMFKYLSIFYNEPASLIDYLPEDGVVILDEISRIQETASHLETEEAEWYISLLGEGTIIQDLSFSHSFEEFLHHKKRSFVYLTLFLRHIAHTHPQNIVNVTCKTMQDFHGQMQLLKTEIDRWNEGHFTTVVLGTDDERVKKLQHILSDYDIEADIVEGTDILLPGRLQIAVGDLHAGFEMPMQKLVVITEKELFHKKVKKSQRKQKLSNAERIKSYSELKVGDYVVHVNHGIGKFLGIETLEINGVHKDYLNIKYQGNDKLYVPIEQIDQVQKYVGSEGKDPKVYKLGGNDWKKVKTKVEKSVQDIADDLIKLYAEREASKGYAYTPDTAEQQEFESSFPYQETEDQLRSIEEIKKDMERGRPMDRLLCGDVGYGKTEVAIRAAFKAIMDEKQVAILVPTTILAQQHYETIRERFQDYPINIGLLSRFRTRKQQNETIKGLKDGTVDIVIGTHRILSKDVTYKDLGLLIIDEEQRFGVTHKEKIKQLKANVDVLTLTATPIPRTLHMSMLGVRDLSVIETPPENRFPVQTYVVEYNPALMREAIERELARGGQVYFLYNRVEDIERKADEISMLVPDARVTYAHGKMNESELESVMLSFLEGQHDVLVSTTIIETGVDIPNVNTLIVFDADRMGLSQLYQLRGRVGRSNRVAYAYFAYKRDKVLSEVAEKRLQAIKEFTELGSGFKIAMRDLSIRGAGNLLGAEQHGFIDSVGFDLYSQMLKDAIEQRRGTDGVENTVNVEIDLEVDAYLPDAYISDSKQKIMMYKQFRGVSAIEDIEELQEEMIDRFGDYPQEVGYLLQIANIKVLAMKEQIELIKQNKFEVTILFSEQASQNIDGGKLFMLGNSFGRMIGLGMEGSQLKIVMKTNGL

SEQ ID NO: 1402 - protein, 1190 aa, Artificial
  Substituion in SEQ ID NO 1395
MCWEGDKVKGLVELMAADGALSSLADGMGPRRNDILITGVTGAGRQLVMAALYHLRNRRLPESMIVVTHTASHAQTIWEDLKEYLPDARVYLYPERDNALVDYLASSSDVLADRLHVLEALAQEGPVVVVTTLLAAWQPVTKKSHFLHSLVNLAVGESKPIDDVVAQLVRGGYERVSLVESRGQFSVRGGILDVFPMGHDLPYRIEWFDTDIDSIRTFDPATQRSQDKRDRVSFGPAFDLMLPQPVADKVADELEARLEARLKTVTDAALRDRLEQSISADIRKLREGQPFAGVARYQLLYPEHADTLFDHVPQPAFVCFDETARILERADVLEKEFREWLSGAMMRGEVLSGTVDAIHYEAKFQELNRPKVHFATFAHTRGSQRYQQVLNISARSMQNFHGQMNVLKQELARWEKAHTQVVFAAATKERADHLARVLDDYRIQADQVEVFTPGSKVPQIVVANLSSGFELPMHRIAVIVETEVFTAKRKHRQTRAQVSDAERIKSYQELNVGDYVVHVNHGIGRYMGIKTLEVDGRRNDYLYLSYAGGDSLYVPVDQIDQIQKYIGSGEKEPKLHSLGSSEWQKTKNRVKKSVRDIAGDLLKLYAKREATPGHAFSPDTPWQADFENMFPYEETPDQLRAIAEIKRDMEKPRPMDRLLCGDVGYGKTEVAMRAAFKAVMDGKQVAVLVPTTVLAQQHYETFKERFAGFPVKIEMLSRFRTRKETQEVLKGLKEGTIDIVIGTHRLLQNSVQFKDLGLLIVDEEQRFGVTHKEKLKQLRANVDCLTLTATPIPRTLHMSMLGVRDLSIIETPPENRFPVQTYVVEYNEGLVKEAIERELARGGQVYFVYNDVQTIHRMAERVQSLVPDARVSVAHGQMAEAELERVMLDFLEGEYDVLVTTTIIETGLDIPNVNTLIVYDADKFGLSQLYQLRGRVGRSNRIAYAYFTYQPAKVLSEVAEKRLAAIKEFTELGSGFKIAMRDLSIRGAGNLLGAEQHGFINSVGFDMYTELLQQAIRELRGEQLEKPVEPTIDVPVEAYIPDTYISDPSQKVAMYKRFRAIQAVSEADDLEDELIDRYGDPPQEVRNLLDVTRLKSLAMQAHADHIATQGADTTVRFPNEKHAPVDYPKLLSMAVKHKAQVTSRPNGMIFVAFRTKGLAGDEIVRRIIAFLTDYLEMVRQSKKQEEVAGV

SEQ ID NO: 1403 - protein, 1190 aa, Artificial
  Substituion in SEQ ID NO 1395
MCWEGDKVKGLVELMAADGALSSLADGMGPRRNDILITGVTGAGRQLVMAALYHLRNRRLPESMIVVTHTASHAQTIWEDLKEYLPDARVYLYPERDNALVDYLASSSDVLADRLHVLEALAQEGPVVVVTTLLAAWQPVTKKSHFLHSLVNLAVGESKPIDDVVAQLVRGGYERVSLVESRGQFSVRGGILDVFPMGHDLPYRIEWFDTDIDSIRTFDPATQRSQDKRDRVSFGPAFDLMLPQPVADKVADELEARLEARLKTVTDAALRDRLEQSISADIRKLREGQPFAGVARYQLLYPEHADTLFDHVPQPAFVCFDETARILERADVLEKEFREWLSGAMMRGEVLSGTVDAIHYEAKFQELNRPKVHFATFAHTRGSQRYQQVLNISARSMQNFHGQMNVLKQELARWEKAHTQVVFAAATKDRADHLARVLDDYRIQADQVEVFTPGSKVPQIVVANLSSGFELPMHRIAVIVETEVFTAKRKHRQTRAQVSDAERIKSYQELNVGDYVVHVNHGIGRYMGIKTLEVDGRRNDYLYLSYAGGDSLYVPVDQIDQIQRYIGSGEKEPKLHSLGSSEWQKTKNRVKKSVRDIAGDLLKLYAKREATPGHAFSPDTPWQADFENMFPYEETPDQLRAIAEIKRDMEKPRPMDRLLCGDVGYGKTEVAMRAAFKAVMDGKQVAVLVPTTVLAQQHYETFKERFAGFPVKIEMLSRFRTRKETQEVLKGLKEGTIDIVIGTHRLLQNSVQFKDLGLLIVDEEQRFGVTHKEKLKQLRANVDCLTLTATPIPRTLHMSMLGVRDLSIIETPPENRFPVQTYVVEYNEGLVKEAIERELARGGQVYFVYNDVQTIHRMAERVQSLVPDARVSVAHGQMAEAELERVMLDFLEGEYDVLVTTTIIETGLDIPNVNTLIVYDADKFGLSQLYQLRGRVGRSNRIAYAYFTYQPAKVLSEVAEKRLAAIKEFTELGSGFKIAMRDLSIRGAGNLLGAEQHGFINSVGFDMYTELLQQAIRELRGEQLEKPVEPTIDVPVEAYIPDTYISDPSQKVAMYKRFRAIQAVSEADDLEDELIDRYGDPPQEVRNLLDVTRLKSLAMQAHADHIATQGADTTVRFPNEKHAPVDYPKLLSMAVKHKAQVTSRPNGMIFVAFRTKGLAGDEIVRRIIAFLTDYLEMVRQSKKQEEVAGV

SEQ ID NO: 1404 - protein, 1190 aa, Artificial
  Substituion in SEQ ID NO 1395
MCWEGDKVKGLVELMAADGALSSLADGMGPRRNDILITGVTGAGRQLVMAALYHLRNRRLPESMIVVTHTASHAQTIWEDLKEYLPDARVYLYPERDNALVDYLASSSDVLADRLHVLEALAQEGPVVVVTTLLAAWQPVTKKSHFLHSLVNLAVGESKPIDDVVAQLVRGGYERVSLVESRGQFSVRGGILDVFPMGHDLPYRIEWFDTDIDSIRTFDPATQRSQDKRDRVSFGPAFDLMLPQPVADKVADELEARLEARLKTVTDAALRDRLEQSISADIRKLREGQPFAGVARYQLLYPEHADTLFDHVPQPAFVCFDETARILERADVLEKEFREWLSGAMMRGEVLSGTVDAIHYEAKFQELNRPKVHFATFAHTRGSQRYQQVLNISARSMQNFHGQMNVLKQELARWEKAHTQVVFAAATKERADHLARVLDDYRIQADQVEVFTPGSKVPQIVVANLSSGFELPMHRIAVIVETEVFTAKRKHRQTRAQVSDAERIKSYQELNVGDYVVHVNHGIGRYMGIKTLEVDGRRNDYLYLSYAGGDSLYVPVDQIDQIQRYIGSGEKEPKLHSLGSSEWQKTKNRVKKSVRDIAGDLLKLYAKREATPGHAFSPDTPWQADFENMFPYEETPDQLRAIAEIKRDMEKPRPMDRLLCGDVGYGKTEVAMRAAFKAVMDGKQVAVLVPTTVLAQQHYETFKERFAGFPVKIEMLSRFRTRKETQEVLKGLKEGTIDIVIGTHRLLQNSVQFKDLGLLIVDEEQRFGVTHKEKLKQLRANVDCLTLTATPIPRTLHMSMLGVRDLSIIETPPENRFPVQTYVVEYNEGLVKEAIERELARGGQVYFVYNDVQTIHRMAERVQSLVPDARVSVAHGQMAEAELERVMLDFLEGEYDVLVTTTIIETGLDIPNVNTLIVYDADKFGLSQLYQLRGRVGRSNRLAYAYFTYQPAKVLSEVAEKRLAAIKEFTELGSGFKIAMRDLSIRGAGNLLGAEQHGFINSVGFDMYTELLQQAIRELRGEQLEKPVEPTIDVPVEAYIPDTYISDPSQKVAMYKRFRAIQAVSEADDLEDELIDRYGDPPQEVRNLLDVTRLKSLAMQAHADHIATQGADTTVRFPNEKHAPVDYPKLLSMAVKHKAQVTSRPNGMIFVAFRTKGLAGDEIVRRIIAFLTDYLEMVRQSKKQEEVAGV

SEQ ID NO: 1405 - protein, 1190 aa, Artificial
  Substituion in SEQ ID NO 1395
MCWEGDKVKGLVELMAADGALSSLADGMGPRRNDILITGVTGAGRQLVMAALYHLRNRRLPESMIVVTHTASHAQTIWEDLKEYLPDARVYLYPERDNALVDYLASSSDVLADRLHVLEALAQEGPVVVVTTLLAAWQPVTKKSHFLHSLVNLAVGESKPIDDVVAQLVRGGYERVSLVESRGQFSVRGGIIDVFPMGHDLPYRIEWFDTDIDSIRTFDPATQRSQDKRDRVSFGPAFDLMLPQPVADKVADELEARLEARLKTVTDAALRDRLEQSISADIRKLREGQPFAGVARYQLLYPEHADTLFDHVPQPAFVCFDETARILERADVLEKEFREWLSGAMMRGEVLSGTVDAIHYEAKFQELNRPKVHFATFAHTRGSQRYQQVLNISARSMQNFHGQMNVLKQELARWEKAHTQVVFAAATKERADHLARVLDDYRIQADQVEVFTPGSKVPQIVVANLSSGFELPMHRIAVIVETEVFTAKRKHRQTRAQVSDAERIKSYQELNVGDYVVHVNHGIGRYMGIKTLEVDGRRNDYLYLSYAGGDSLYVPVDQIDQIQRYIGSGEKEPKLHSLGSSEWQKTKNRVKKSVRDIAGDLLKLYAKREATPGHAFSPDTPWQADFENMFPYEETPDQLRAIAEIKRDMEKPRPMDRLLCGDVGYGKTEVAMRAAFKAVMDGKQVAVLVPTTVLAQQHYETFKERFAGFPVKIEMLSRFRTRKETQEVLKGLKEGTIDIVIGTHRLLQNSVQFKDLGLLIVDEEQRFGVTHKEKLKQLRANVDCLTLTATPIPRTLHMSMLGVRDLSIIETPPENRFPVQTYVVEYNEGLVKEAIERELARGGQVYFVYNDVQTIHRMAERVQSLVPDARVSVAHGQMAEAELERVMLDFLEGEYDVLVTTTIIETGLDIPNVNTLIVYDADKFGLSQLYQLRGRVGRSNRIAYAYFTYQPAKVLSEVAEKRLAAIKEFTELGSGFKIAMRDLSIRGAGNLLGAEQHGFINSVGFDMYTELLQQAIRELRGEQLEKPVEPTIDVPVEAYIPDTYISDPSQKVAMYKRFRAIQAVSEADDLEDELIDRYGDPPQEVRNLLDVTRLKSLAMQAHADHIATQGADTTVRFPNEKHAPVDYPKLLSMAVKHKAQVTSRPNGMIFVAFRTKGLAGDEIVRRIIAFLTDYLEMVRQSKKQEEVAGV

SEQ ID NO: 1406 - protein, 1190 aa, Artificial
  Substituion in SEQ ID NO 1395
MCWEGDKVKGLVELMAADGALSSLADGMGPRRNDILITGVTGAGRQLVMAALYHLRNRRLPESMIVVTHTASHAQTIWEDLKEYLPDARVYLYPERDNALVDYLASSSDVLADRLHVLEALAQEGPVVVVTTLLAAWQPVTKKSHFLHSLVNLAVGESKPIDDVVAQLVRGGYERVSLVESRGQFSVRGGILDVFPMGHDLPYRIEWFDTDIDSIRTFDPATQRSQDKRDRVSFGPAFDLMLPQPVADKVADELEARLEARLKTVTDAALRDRLEQSISADIRKLREGQPFAGVARYQLLYPEHADTLFDHVPQPAFVCFDETARILERADVLEKEFREWLSGAMMRGEVLSGTVDAIHYEAKFQELNRPKVHFATFAHTRGSQRYQQVLNISARSMQNFHGQMNVLKQELARWEKAHTQVVFAAATKERADHLARVLDDYRIQADQVEVFTPGSKVPQIVVANLSSGFELPMHRIAVIVETEVFTAKRKHRQTRAQVSDAERIKSYQELNVGDYVVHVNHGIGRYMGIKTLEVDGRRNDYLYLSYAGGDSLYVPVDQIDQIQRYIGSGEKEPKLHSLGSSEWQKTKNRVKKSVRDIAGDLLKLYAKREATPGHAFSPDTPWQADFENMFPYEETPDQLRAIAEIKRDMEKPRPMDRLLCGDVGYGKTEVAMRAAFKAVMDGKQVAVLVPTTVLAQQHYETFKERFAGFPVKIEMLSRFRTRKETNEVLKGLKEGTIDIVIGTHRLLQNSVQFKDLGLLIVDEEQRFGVTHKEKLKQLRANVDCLTLTATPIPRTLHMSMLGVRDLSIIETPPENRFPVQTYVVEYNEGLVKEAIERELARGGQVYFVYNDVQTIHRMAERVQSLVPDARVSVAHGQMAEAELERVMLDFLEGEYDVLVTTTIIETGLDIPNVNTLIVYDADKFGLSQLYQLRGRVGRSNRIAYAYFTYQPAKVLSEVAEKRLAAIKEFTELGSGFKIAMRDLSIRGAGNLLGAEQHGFINSVGFDMYTELLQQAIRELRGEQLEKPVEPTIDVPVEAYIPDTYISDPSQKVAMYKRFRAIQAVSEADDLEDELIDRYGDPPQEVRNLLDVTRLKSLAMQAHADHIATQGADTTVRFPNEKHAPVDYPKLLSMAVKHKAQVTSRPNGMIFVAFRTKGLAGDEIVRRIIAFLTDYLEMVRQSKKQEEVAGV

SEQ ID NO: 1407 - DNA, 3573 bp, Artificial
  Substituion in SEQ ID NO 1396
gtgtgctgggagggggacaaggtgaagggtctcgtcgaactcatggccgcggacggggcgctttcgtcattggcggatgggatggggccgcgcagaaacgacatactcatcacgggcgtgaccggggccgggcggcagctcgtgatggcggccttgtaccatctccgcaatcgccgtctcccagagtcgatgattgtggtgacgcatacggccagtcacgcccagaccatctgggaggacttgaaggagtacctgccggatgcgcgcgtctatctctatcccgagcgagacaacgcgctcgtcgattacctggcgtcgtcgtcggacgtactggcggatcggctgcacgtccttgaggccctcgcgcaggagggccctgtcgttgtggtcacgacccttttggccgcctggcagccggtgacgaaaaagagccattttctacactcgctggtgaacctcgcggtaggtgaatcgaagccgattgacgacgtcgtagcgcagctagtgcgcggcggctacgagcgcgtgagcctcgtggagagccgcggccagttcagcgtgcgcggcggcatcctcgacgtctttccgatgggccacgatctcccctaccgcatcgagtggttcgacacggacattgactccatccggacgttcgatcccgccacgcagcgatcccaggacaagcgggatcgcgtgtcgtttggccctgcattcgacctgatgcttcctcagcccgttgcggacaaggtggcggatgaactcgaggcgcggcttgaagccaggctgaagacggtgacggatgcggcgctccgggatcggctggagcagtccatctccgcggatatccgcaagctgcgcgaggggcagccgttcgcgggcgtggctcgttatcagcttctgtatcccgaacacgcggacaccctgttcgatcacgtcccccagcctgcgttcgtctgcttcgacgagacggctcgcatcctggagcgcgcggacgtgctcgagaaggagtttcgcgagtggctgtcgggcgccatgatgcggggcgaggtgctctcgggcacggtcgacgccattcactacgaggcgaagtttcaagagttgaatcggccgaaggtgcacttcgcgacgttcgcccacacgcgcggcagtcagcggtatcagcaggtgctcaacatctccgcgcgcagcatgcagaatttccacgggcagatgaacgtgttgaaacaagagctcgcgcgctgggagaaggcgcacacgcaggtggtgtttgcggccgcgaccaaggagcgggcggatcacctggcgcgcgtcctggacgactatcgcatccaggccgatcaggtggaggtctttacgccgggatcgaaggtgccgcagatcgtcgtcgccaacctgtcaagcgggttcgagttgccgatgcaccgcatcgccgtgatcgtcgagaccgaggtgttcacggcgaagcggaagcatcgccagacgcgcgcgcaggtctcggatgcggagcggatcaagagctaccaggaactgaatgtcggcgactacgtggtgcacgtgaatcacggcattggccggtacatgggtatcaagacgcttgaggtcgatggtcgccgcaacgactacctgtacctgagctacgcgggcggcgacagcctgtacgtgccggtggaccagatcgatcagatccagaaatacatcggctccggcgagaaggagccgaagctgcacagcctcgggtcgagcgaatggcagaagacgaagaaccgcgtcaagaagtcggtgcgcgacatcgcgggcgatctcctgaagctctacgcgaagcgcgaggcgacgcccgggcacgcgttctcgcccgacacgccatggcaggcggacttcgagaacatgttcccgtacgaggagacgccggaccagcttcgcgccatcgcggagatcaagcgggacatggagaagccgcgcccgatggataggctcctgtgcggcgacgtgggctacggcaagacggaggtcgccatgcgcgcggcgttcaaggcggtcatggacgggaaacaagtcgcggtgctggtgccgacgacggtcctcgcgcagcagcactacgagacgttcaaggagcggttcgccggcttcccagtgaagattgagatgctgagccgcttccggacgcgcaaagagacgcaggaggtgttgaagggcctcaaggaggggaccatcgacatcgtcatcggcacgcaccggcttttgcagaactcggtgcagttcaaggacctggggcttctgattgtggacgaggaacagcgcttcggcgtgacccacaaggaaaagctgaagcagttgcgcgcgaatgtggactgtttgacgctgaccgcgacgcccatcccgcgcacgctccacatgtccatgctcggcgtgcgcgatctgtccatcatcgagacgccgcccgagaaccggtttccggtccagacgtacgtcgtggagtacaacgaggggcttgtcaaagaggccatcgagcgcgaactcgcccgcggcggacaggtgtacttcgtgtacaacgacgtccagaccatccaccgcatggccgagcgcgtgcagtcgctcgtgcccgatgcgcgcgtgagcgtggcgcacggtcagatggcggaggcggagctcgagcgcgtgatgctcgactttctcgagggcgagtacgacgtgctcgtcaccaccaccatcatcgagacggggctcgacattccgaacgtgaacaccttgattgtgtacgacgccgacaagttcggtctgtcccagttgtatcagctgcgcggccgcgtcggccgatccaaccggattgcgtacgcatatttcacctatcagccggccaaggtgctgtcggaggtcgcggaaaagcggctggcggccatcaaggagttcaccgagctcggcagcggcttcaagatcgccatgcgtgacctgtccatccgcggcgctggcaacttgctcggggccgagcaacacgggttcatcaactctgtgggcttcgacatgtacacggagctcttgcagcaggccattcgcgagctgcgcggcgagcagctggagaagcccgtcgaaccgaccatcgacgtgcccgtcgaggcgtacattccagacacctatatctccgatccgtctcagaaggtggccatgtacaagcggttccgggcgattcaggctgtgtccgaggcggacgatctcgaggacgagctcatcgatcgctacggcgatccgccgcaggaggtgcgcaatctgctcgacgtgacgaggctcaagagcctcgcgatgcaggcgcacgcggatcacatcgcgacgcagggtgccgacacgaccgtgcggtttccgaacgagaagcatgcgcccgtcgattatccgaagctcctgtccatggcggtcaagcacaaggcgcaggtcacctcgcggccgaacggcatgatctttgtcgcgttccgaaccaagggcctcgcgggggacgagatcgtccggaggatcatcgccttcttgacggattacctggagatggtgcggcagtcgaaaaagcaggaagaggtggcgggcgtctga

SEQ ID NO: 1408 - DNA, 3573 bp, Artificial
  Substituion in SEQ ID NO 1396
gtgtgctgggagggggacaaggtgaagggtctcgtcgaactcatggccgcggacggggcgctttcgtcattggcggatgggatggggccgcgcagaaacgacatactcatcacgggcgtgaccggggccgggcggcagctcgtgatggcggccttgtaccatctccgcaatcgccgtctcccagagtcgatgattgtggtgacgcatacggccagtcacgcccagaccatctgggaggacttgaaggagtacctgccggatgcgcgcgtctatctctatcccgagcgagacaacgcgctcgtcgattacctggcgtcgtcgtcggacgtactggcggatcggctgcacgtccttgaggccctcgcgcaggagggccctgtcgttgtggtcacgacccttttggccgcctggcagccggtgacgaaaaagagccattttctacactcgctggtgaacctcgcggtaggtgaatcgaagccgattgacgacgtcgtagcgcagctagtgcgcggcggctacgagcgcgtgagcctcgtggagagccgcggccagttcagcgtgcgcggcggcatcctcgacgtctttccgatgggccacgatctcccctaccgcatcgagtggttcgacacggacattgactccatccggacgttcgatcccgccacgcagcgatcccaggacaagcgggatcgcgtgtcgtttggccctgcattcgacctgatgcttcctcagcccgttgcggacaaggtggcggatgaactcgaggcgcggcttgaagccaggctgaagacggtgacggatgcggcgctccgggatcggctggagcagtccatctccgcggatatccgcaagctgcgcgaggggcagccgttcgcgggcgtggctcgttatcagcttctgtatcccgaacacgcggacaccctgttcgatcacgtcccccagcctgcgttcgtctgcttcgacgagacggctcgcatcctggagcgcgcggacgtgctcgagaaggagtttcgcgagtggctgtcgggcgccatgatgcggggcgaggtgctctcgggcacggtcgacgccattcactacgaggcgaagtttcaagagttgaatcggccgaaggtgcacttcgcgacgttcgcccacacgcgcggcagtcagcggtatcagcaggtgctcaacatctccgcgcgcagcatgcagaatttccacgggcagatgaacgtgttgaaacaagagctcgcgcgctgggagaaggcgcacacgcaggtggtgtttgcggccgcgaccaaggatcgggcggatcacctggcgcgcgtcctggacgactatcgcatccaggccgatcaggtggaggtctttacgccgggatcgaaggtgccgcagatcgtcgtcgccaacctgtcaagcgggttcgagttgccgatgcaccgcatcgccgtgatcgtcgagaccgaggtgttcacggcgaagcggaagcatcgccagacgcgcgcgcaggtctcggatgcggagcggatcaagagctaccaggaactgaatgtcggcgactacgtggtgcacgtgaatcacggcattggccggtacatgggtatcaagacgcttgaggtcgatggtcgccgcaacgactacctgtacctgagctacgcgggcggcgacagcctgtacgtgccggtggaccagatcgatcagatccagcggtacatcggctccggcgagaaggagccgaagctgcacagcctcgggtcgagcgaatggcagaagacgaagaaccgcgtcaagaagtcggtgcgcgacatcgcgggcgatctcctgaagctctacgcgaagcgcgaggcgacgcccgggcacgcgttctcgcccgacacgccatggcaggcggacttcgagaacatgttcccgtacgaggagacgccggaccagcttcgcgccatcgcggagatcaagcgggacatggagaagccgcgcccgatggataggctcctgtgcggcgacgtgggctacggcaagacggaggtcgccatgcgcgcggcgttcaaggcggtcatggacgggaaacaagtcgcggtgctggtgccgacgacggtcctcgcgcagcagcactacgagacgttcaaggagcggttcgccggcttcccagtgaagattgagatgctgagccgcttccggacgcgcaaagagacgcaggaggtgttgaagggcctcaaggaggggaccatcgacatcgtcatcggcacgcaccggcttttgcagaactcggtgcagttcaaggacctggggcttctgattgtggacgaggaacagcgcttcggcgtgacccacaaggaaaagctgaagcagttgcgcgcgaatgtggactgtttgacgctgaccgcgacgcccatcccgcgcacgctccacatgtccatgctcggcgtgcgcgatctgtccatcatcgagacgccgcccgagaaccggtttccggtccagacgtacgtcgtggagtacaacgaggggcttgtcaaagaggccatcgagcgcgaactcgcccgcggcggacaggtgtacttcgtgtacaacgacgtccagaccatccaccgcatggccgagcgcgtgcagtcgctcgtgcccgatgcgcgcgtgagcgtggcgcacggtcagatggcggaggcggagctcgagcgcgtgatgctcgactttctcgagggcgagtacgacgtgctcgtcaccaccaccatcatcgagacggggctcgacattccgaacgtgaacaccttgattgtgtacgacgccgacaagttcggtctgtcccagttgtatcagctgcgcggccgcgtcggccgatccaaccggattgcgtacgcatatttcacctatcagccggccaaggtgctgtcggaggtcgcggaaaagcggctggcggccatcaaggagttcaccgagctcggcagcggcttcaagatcgccatgcgtgacctgtccatccgcggcgctggcaacttgctcggggccgagcaacacgggttcatcaactctgtgggcttcgacatgtacacggagctcttgcagcaggccattcgcgagctgcgcggcgagcagctggagaagcccgtcgaaccgaccatcgacgtgcccgtcgaggcgtacattccagacacctatatctccgatccgtctcagaaggtggccatgtacaagcggttccgggcgattcaggctgtgtccgaggcggacgatctcgaggacgagctcatcgatcgctacggcgatccgccgcaggaggtgcgcaatctgctcgacgtgacgaggctcaagagcctcgcgatgcaggcgcacgcggatcacatcgcgacgcagggtgccgacacgaccgtgcggtttccgaacgagaagcatgcgcccgtcgattatccgaagctcctgtccatggcggtcaagcacaaggcgcaggtcacctcgcggccgaacggcatgatctttgtcgcgttccgaaccaagggcctcgcgggggacgagatcgtccggaggatcatcgccttcttgacggattacctggagatggtgcggcagtcgaaaaagcaggaagaggtggcgggcgtctga

SEQ ID NO: 1409 - DNA, 3573 bp, Artificial
  Substituion in SEQ ID NO 1396
gtgtgctgggagggggacaaggtgaagggtctcgtcgaactcatggccgcggacggggcgctttcgtcattggcggatgggatggggccgcgcagaaacgacatactcatcacgggcgtgaccggggccgggcggcagctcgtgatggcggccttgtaccatctccgcaatcgccgtctcccagagtcgatgattgtggtgacgcatacggccagtcacgcccagaccatctgggaggacttgaaggagtacctgccggatgcgcgcgtctatctctatcccgagcgagacaacgcgctcgtcgattacctggcgtcgtcgtcggacgtactggcggatcggctgcacgtccttgaggccctcgcgcaggagggccctgtcgttgtggtcacgacccttttggccgcctggcagccggtgacgaaaaagagccattttctacactcgctggtgaacctcgcggtaggtgaatcgaagccgattgacgacgtcgtagcgcagctagtgcgcggcggctacgagcgcgtgagcctcgtggagagccgcggccagttcagcgtgcgcggcggcatcctcgacgtctttccgatgggccacgatctcccctaccgcatcgagtggttcgacacggacattgactccatccggacgttcgatcccgccacgcagcgatcccaggacaagcgggatcgcgtgtcgtttggccctgcattcgacctgatgcttcctcagcccgttgcggacaaggtggcggatgaactcgaggcgcggcttgaagccaggctgaagacggtgacggatgcggcgctccgggatcggctggagcagtccatctccgcggatatccgcaagctgcgcgaggggcagccgttcgcgggcgtggctcgttatcagcttctgtatcccgaacacgcggacaccctgttcgatcacgtcccccagcctgcgttcgtctgcttcgacgagacggctcgcatcctggagcgcgcggacgtgctcgagaaggagtttcgcgagtggctgtcgggcgccatgatgcggggcgaggtgctctcgggcacggtcgacgccattcactacgaggcgaagtttcaagagttgaatcggccgaaggtgcacttcgcgacgttcgcccacacgcgcggcagtcagcggtatcagcaggtgctcaacatctccgcgcgcagcatgcagaatttccacgggcagatgaacgtgttgaaacaagagctcgcgcgctgggagaaggcgcacacgcaggtggtgtttgcggccgcgaccaaggagcgggcggatcacctggcgcgcgtcctggacgactatcgcatccaggccgatcaggtggaggtctttacgccgggatcgaaggtgccgcagatcgtcgtcgccaacctgtcaagcgggttcgagttgccgatgcaccgcatcgccgtgatcgtcgagaccgaggtgttcacggcgaagcggaagcatcgccagacgcgcgcgcaggtctcggatgcggagcggatcaagagctaccaggaactgaatgtcggcgactacgtggtgcacgtgaatcacggcattggccggtacatgggtatcaagacgcttgaggtcgatggtcgccgcaacgactacctgtacctgagctacgcgggcggcgacagcctgtacgtgccggtggaccagatcgatcagatccagcggtacatcggctccggcgagaaggagccgaagctgcacagcctcgggtcgagcgaatggcagaagacgaagaaccgcgtcaagaagtcggtgcgcgacatcgcgggcgatctcctgaagctctacgcgaagcgcgaggcgacgcccgggcacgcgttctcgcccgacacgccatggcaggcggacttcgagaacatgttcccgtacgaggagacgccggaccagcttcgcgccatcgcggagatcaagcgggacatggagaagccgcgcccgatggataggctcctgtgcggcgacgtgggctacggcaagacggaggtcgccatgcgcgcggcgttcaaggcggtcatggacgggaaacaagtcgcggtgctggtgccgacgacggtcctcgcgcagcagcactacgagacgttcaaggagcggttcgccggcttcccagtgaagattgagatgctgagccgcttccggacgcgcaaagagacgcaggaggtgttgaagggcctcaaggaggggaccatcgacatcgtcatcggcacgcaccggcttttgcagaactcggtgcagttcaaggacctggggcttctgattgtggacgaggaacagcgcttcggcgtgacccacaaggaaaagctgaagcagttgcgcgcgaatgtggactgtttgacgctgaccgcgacgcccatcccgcgcacgctccacatgtccatgctcggcgtgcgcgatctgtccatcatcgagacgccgcccgagaaccggtttccggtccagacgtacgtcgtggagtacaacgaggggcttgtcaaagaggccatcgagcgcgaactcgcccgcggcggacaggtgtacttcgtgtacaacgacgtccagaccatccaccgcatggccgagcgcgtgcagtcgctcgtgcccgatgcgcgcgtgagcgtggcgcacggtcagatggcggaggcggagctcgagcgcgtgatgctcgactttctcgagggcgagtacgacgtgctcgtcaccaccaccatcatcgagacggggctcgacattccgaacgtgaacaccttgattgtgtacgacgccgacaagttcggtctgtcccagttgtatcagctgcgcggccgcgtcggccgatccaaccggttagcgtacgcatatttcacctatcagccggccaaggtgctgtcggaggtcgcggaaaagcggctggcggccatcaaggagttcaccgagctcggcagcggcttcaagatcgccatgcgtgacctgtccatccgcggcgctggcaacttgctcggggccgagcaacacgggttcatcaactctgtgggcttcgacatgtacacggagctcttgcagcaggccattcgcgagctgcgcggcgagcagctggagaagcccgtcgaaccgaccatcgacgtgcccgtcgaggcgtacattccagacacctatatctccgatccgtctcagaaggtggccatgtacaagcggttccgggcgattcaggctgtgtccgaggcggacgatctcgaggacgagctcatcgatcgctacggcgatccgccgcaggaggtgcgcaatctgctcgacgtgacgaggctcaagagcctcgcgatgcaggcgcacgcggatcacatcgcgacgcagggtgccgacacgaccgtgcggtttccgaacgagaagcatgcgcccgtcgattatccgaagctcctgtccatggcggtcaagcacaaggcgcaggtcacctcgcggccgaacggcatgatctttgtcgcgttccgaaccaagggcctcgcgggggacgagatcgtccggaggatcatcgccttcttgacggattacctggagatggtgcggcagtcgaaaaagcaggaagaggtggcgggcgtctga

SEQ ID NO: 1410 - DNA, 3573 bp, Artificial
  Substituion in SEQ ID NO 1396
gtgtgctgggagggggacaaggtgaagggtctcgtcgaactcatggccgcggacggggcgctttcgtcattggcggatgggatggggccgcgcagaaacgacatactcatcacgggcgtgaccggggccgggcggcagctcgtgatggcggccttgtaccatctccgcaatcgccgtctcccagagtcgatgattgtggtgacgcatacggccagtcacgcccagaccatctgggaggacttgaaggagtacctgccggatgcgcgcgtctatctctatcccgagcgagacaacgcgctcgtcgattacctggcgtcgtcgtcggacgtactggcggatcggctgcacgtccttgaggccctcgcgcaggagggccctgtcgttgtggtcacgacccttttggccgcctggcagccggtgacgaaaaagagccattttctacactcgctggtgaacctcgcggtaggtgaatcgaagccgattgacgacgtcgtagcgcagctagtgcgcggcggctacgagcgcgtgagcctcgtggagagccgcggccagttcagcgtgcgcggcggcatcattgacgtctttccgatgggccacgatctcccctaccgcatcgagtggttcgacacggacattgactccatccggacgttcgatcccgccacgcagcgatcccaggacaagcgggatcgcgtgtcgtttggccctgcattcgacctgatgcttcctcagcccgttgcggacaaggtggcggatgaactcgaggcgcggcttgaagccaggctgaagacggtgacggatgcggcgctccgggatcggctggagcagtccatctccgcggatatccgcaagctgcgcgaggggcagccgttcgcgggcgtggctcgttatcagcttctgtatcccgaacacgcggacaccctgttcgatcacgtcccccagcctgcgttcgtctgcttcgacgagacggctcgcatcctggagcgcgcggacgtgctcgagaaggagtttcgcgagtggctgtcgggcgccatgatgcggggcgaggtgctctcgggcacggtcgacgccattcactacgaggcgaagtttcaagagttgaatcggccgaaggtgcacttcgcgacgttcgcccacacgcgcggcagtcagcggtatcagcaggtgctcaacatctccgcgcgcagcatgcagaatttccacgggcagatgaacgtgttgaaacaagagctcgcgcgctgggagaaggcgcacacgcaggtggtgtttgcggccgcgaccaaggagcgggcggatcacctggcgcgcgtcctggacgactatcgcatccaggccgatcaggtggaggtctttacgccgggatcgaaggtgccgcagatcgtcgtcgccaacctgtcaagcgggttcgagttgccgatgcaccgcatcgccgtgatcgtcgagaccgaggtgttcacggcgaagcggaagcatcgccagacgcgcgcgcaggtctcggatgcggagcggatcaagagctaccaggaactgaatgtcggcgactacgtggtgcacgtgaatcacggcattggccggtacatgggtatcaagacgcttgaggtcgatggtcgccgcaacgactacctgtacctgagctacgcgggcggcgacagcctgtacgtgccggtggaccagatcgatcagatccagcggtacatcggctccggcgagaaggagccgaagctgcacagcctcgggtcgagcgaatggcagaagacgaagaaccgcgtcaagaagtcggtgcgcgacatcgcgggcgatctcctgaagctctacgcgaagcgcgaggcgacgcccgggcacgcgttctcgcccgacacgccatggcaggcggacttcgagaacatgttcccgtacgaggagacgccggaccagcttcgcgccatcgcggagatcaagcgggacatggagaagccgcgcccgatggataggctcctgtgcggcgacgtgggctacggcaagacggaggtcgccatgcgcgcggcgttcaaggcggtcatggacgggaaacaagtcgcggtgctggtgccgacgacggtcctcgcgcagcagcactacgagacgttcaaggagcggttcgccggcttcccagtgaagattgagatgctgagccgcttccggacgcgcaaagagacgcaggaggtgttgaagggcctcaaggaggggaccatcgacatcgtcatcggcacgcaccggcttttgcagaactcggtgcagttcaaggacctggggcttctgattgtggacgaggaacagcgcttcggcgtgacccacaaggaaaagctgaagcagttgcgcgcgaatgtggactgtttgacgctgaccgcgacgcccatcccgcgcacgctccacatgtccatgctcggcgtgcgcgatctgtccatcatcgagacgccgcccgagaaccggtttccggtccagacgtacgtcgtggagtacaacgaggggcttgtcaaagaggccatcgagcgcgaactcgcccgcggcggacaggtgtacttcgtgtacaacgacgtccagaccatccaccgcatggccgagcgcgtgcagtcgctcgtgcccgatgcgcgcgtgagcgtggcgcacggtcagatggcggaggcggagctcgagcgcgtgatgctcgactttctcgagggcgagtacgacgtgctcgtcaccaccaccatcatcgagacggggctcgacattccgaacgtgaacaccttgattgtgtacgacgccgacaagttcggtctgtcccagttgtatcagctgcgcggccgcgtcggccgatccaaccggattgcgtacgcatatttcacctatcagccggccaaggtgctgtcggaggtcgcggaaaagcggctggcggccatcaaggagttcaccgagctcggcagcggcttcaagatcgccatgcgtgacctgtccatccgcggcgctggcaacttgctcggggccgagcaacacgggttcatcaactctgtgggcttcgacatgtacacggagctcttgcagcaggccattcgcgagctgcgcggcgagcagctggagaagcccgtcgaaccgaccatcgacgtgcccgtcgaggcgtacattccagacacctatatctccgatccgtctcagaaggtggccatgtacaagcggttccgggcgattcaggctgtgtccgaggcggacgatctcgaggacgagctcatcgatcgctacggcgatccgccgcaggaggtgcgcaatctgctcgacgtgacgaggctcaagagcctcgcgatgcaggcgcacgcggatcacatcgcgacgcagggtgccgacacgaccgtgcggtttccgaacgagaagcatgcgcccgtcgattatccgaagctcctgtccatggcggtcaagcacaaggcgcaggtcacctcgcggccgaacggcatgatctttgtcgcgttccgaaccaagggcctcgcgggggacgagatcgtccggaggatcatcgccttcttgacggattacctggagatggtgcggcagtcgaaaaagcaggaagaggtggcgggcgtctga

SEQ ID NO: 1411 - DNA, 3573 bp, Artificial
  Substituion in SEQ ID NO 1396
gtgtgctgggagggggacaaggtgaagggtctcgtcgaactcatggccgcggacggggcgctttcgtcattggcggatgggatggggccgcgcagaaacgacatactcatcacgggcgtgaccggggccgggcggcagctcgtgatggcggccttgtaccatctccgcaatcgccgtctcccagagtcgatgattgtggtgacgcatacggccagtcacgcccagaccatctgggaggacttgaaggagtacctgccggatgcgcgcgtctatctctatcccgagcgagacaacgcgctcgtcgattacctggcgtcgtcgtcggacgtactggcggatcggctgcacgtccttgaggccctcgcgcaggagggccctgtcgttgtggtcacgacccttttggccgcctggcagccggtgacgaaaaagagccattttctacactcgctggtgaacctcgcggtaggtgaatcgaagccgattgacgacgtcgtagcgcagctagtgcgcggcggctacgagcgcgtgagcctcgtggagagccgcggccagttcagcgtgcgcggcggcatcctcgacgtctttccgatgggccacgatctcccctaccgcatcgagtggttcgacacggacattgactccatccggacgttcgatcccgccacgcagcgatcccaggacaagcgggatcgcgtgtcgtttggccctgcattcgacctgatgcttcctcagcccgttgcggacaaggtggcggatgaactcgaggcgcggcttgaagccaggctgaagacggtgacggatgcggcgctccgggatcggctggagcagtccatctccgcggatatccgcaagctgcgcgaggggcagccgttcgcgggcgtggctcgttatcagcttctgtatcccgaacacgcggacaccctgttcgatcacgtcccccagcctgcgttcgtctgcttcgacgagacggctcgcatcctggagcgcgcggacgtgctcgagaaggagtttcgcgagtggctgtcgggcgccatgatgcggggcgaggtgctctcgggcacggtcgacgccattcactacgaggcgaagtttcaagagttgaatcggccgaaggtgcacttcgcgacgttcgcccacacgcgcggcagtcagcggtatcagcaggtgctcaacatctccgcgcgcagcatgcagaatttccacgggcagatgaacgtgttgaaacaagagctcgcgcgctgggagaaggcgcacacgcaggtggtgtttgcggccgcgaccaaggagcgggcggatcacctggcgcgcgtcctggacgactatcgcatccaggccgatcaggtggaggtctttacgccgggatcgaaggtgccgcagatcgtcgtcgccaacctgtcaagcgggttcgagttgccgatgcaccgcatcgccgtgatcgtcgagaccgaggtgttcacggcgaagcggaagcatcgccagacgcgcgcgcaggtctcggatgcggagcggatcaagagctaccaggaactgaatgtcggcgactacgtggtgcacgtgaatcacggcattggccggtacatgggtatcaagacgcttgaggtcgatggtcgccgcaacgactacctgtacctgagctacgcgggcggcgacagcctgtacgtgccggtggaccagatcgatcagatccagcggtacatcggctccggcgagaaggagccgaagctgcacagcctcgggtcgagcgaatggcagaagacgaagaaccgcgtcaagaagtcggtgcgcgacatcgcgggcgatctcctgaagctctacgcgaagcgcgaggcgacgcccgggcacgcgttctcgcccgacacgccatggcaggcggacttcgagaacatgttcccgtacgaggagacgccggaccagcttcgcgccatcgcggagatcaagcgggacatggagaagccgcgcccgatggataggctcctgtgcggcgacgtgggctacggcaagacggaggtcgccatgcgcgcggcgttcaaggcggtcatggacgggaaacaagtcgcggtgctggtgccgacgacggtcctcgcgcagcagcactacgagacgttcaaggagcggttcgccggcttcccagtgaagattgagatgctgagccgcttccggacgcgcaaagagacgaatgaggtgttgaagggcctcaaggaggggaccatcgacatcgtcatcggcacgcaccggcttttgcagaactcggtgcagttcaaggacctggggcttctgattgtggacgaggaacagcgcttcggcgtgacccacaaggaaaagctgaagcagttgcgcgcgaatgtggactgtttgacgctgaccgcgacgcccatcccgcgcacgctccacatgtccatgctcggcgtgcgcgatctgtccatcatcgagacgccgcccgagaaccggtttccggtccagacgtacgtcgtggagtacaacgaggggcttgtcaaagaggccatcgagcgcgaactcgcccgcggcggacaggtgtacttcgtgtacaacgacgtccagaccatccaccgcatggccgagcgcgtgcagtcgctcgtgcccgatgcgcgcgtgagcgtggcgcacggtcagatggcggaggcggagctcgagcgcgtgatgctcgactttctcgagggcgagtacgacgtgctcgtcaccaccaccatcatcgagacggggctcgacattccgaacgtgaacaccttgattgtgtacgacgccgacaagttcggtctgtcccagttgtatcagctgcgcggccgcgtcggccgatccaaccggattgcgtacgcatatttcacctatcagccggccaaggtgctgtcggaggtcgcggaaaagcggctggcggccatcaaggagttcaccgagctcggcagcggcttcaagatcgccatgcgtgacctgtccatccgcggcgctggcaacttgctcggggccgagcaacacgggttcatcaactctgtgggcttcgacatgtacacggagctcttgcagcaggccattcgcgagctgcgcggcgagcagctggagaagcccgtcgaaccgaccatcgacgtgcccgtcgaggcgtacattccagacacctatatctccgatccgtctcagaaggtggccatgtacaagcggttccgggcgattcaggctgtgtccgaggcggacgatctcgaggacgagctcatcgatcgctacggcgatccgccgcaggaggtgcgcaatctgctcgacgtgacgaggctcaagagcctcgcgatgcaggcgcacgcggatcacatcgcgacgcagggtgccgacacgaccgtgcggtttccgaacgagaagcatgcgcccgtcgattatccgaagctcctgtccatggcggtcaagcacaaggcgcaggtcacctcgcggccgaacggcatgatctttgtcgcgttccgaaccaagggcctcgcgggggacgagatcgtccggaggatcatcgccttcttgacggattacctggagatggtgcggcagtcgaaaaagcaggaagaggtggcgggcgtctga

SEQ ID NO: 1412 - protein, 90 aa, Alicyclobacillus acidocaldarius
MNKMELINRVAEKTNLKKKDAESAVNAVFEIIEEALANGEKVQIIGFGTFETRSRAARSGRNPQTGEVIEIPASTVPAFKPGNKLKEVTR

SEQ ID NO: 1413 - DNA, 273 bp, Alicyclobacillus acidocaldarius
gtgaataagatggaactcatcaaccgtgtcgcggaaaagaccaacttgaagaagaaggacgcggagagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgcgctga

SEQ ID NO: 1414 - protein, 90 aa, Bacillus selenitireducens MLS10
MNKTELINAVAESADLSKKDATSAVDAVFEVITDSLKKGDKVQLIGFGNFEVRERAARKGRNPQTGEEIEIPASNVPAFKPGKALKDAVK

SEQ ID NO: 1415 - protein, 89 aa, Lactobacillus salivarius UCC118
NKAALIERVAEKTGLTKKDATVAVDAVFETIQDALVDGEKVQLIGFGNFEVRERAARKGRNPQTGEEIEIPASKVPAFKPGKSLKDAVK

SEQ ID NO: 1416 - protein, 90 aa, Bacillus sp. SG-1
MNKTELINAVAEAAELSKKDATKAVDAVFESIQDALANGDKVQLIGFGNFEVRERAARKGRNPQTGEEIEISASKVPAFKPGKALKDAVK

SEQ ID NO: 1417 - protein, 87 aa, Oceanobacillus iheyensis HTE831
MNKTDLVNAVAEKSELSKKDATKAVDAVFESVMDSLKNGEKVQLIGFGNFEVRERSARKGRNPQTGEEIEIPASKVPAFKPGKALKD

SEQ ID NO: 1418 - protein, 87 aa, Carboxydothermus hydrogenoformans Z-2901
MNKAELVSVIAEKAEMTKKDAEKALNAVLAAIEEALKKGEKVQLVGFGTFEVRERAARKGRNPQTGQEIEIPASKVPVFKPGKLLKE

SEQ ID NO: 1419 - protein, 90 aa, Artificial
  Substituion in SEQ ID NO 1412
MNKMDLINRVAEKTNLKKKDAESAVNAVFEIIEEALANGEKVQIIGFGTFETRSRAARSGRNPQTGEVIEIPASTVPAFKPGNKLKEVTR

SEQ ID NO: 1420 - protein, 90 aa, Artificial
  Substituion in SEQ ID NO 1412
MNKMELINRVAEKTNLKKKDAESAVNAVFEIIEEALANGEKVQLIGFGTFETRSRAARSGRNPQTGEVIEIPASTVPAFKPGNKLKEVTR

SEQ ID NO: 1421 - protein, 90 aa, Artificial
  Substituion in SEQ ID NO 1412
MNKMELINRVAEKTQLKKKDAESAVNAVFEIIEEALANGEKVQIIGFGTFETRSRAARSGRNPQTGEVIEIPASTVPAFKPGNKLKEVTR

SEQ ID NO: 1422 - protein, 90 aa, Artificial
  Substituion in SEQ ID NO 1412
MNKMELINRVAEKTNLKKKDAESAVNAVFEIIEEALANGEKVQIIGFGTFETRSRAARSGRNPQTGEVIEIPASTVPAFKPGNKLKDVTR

SEQ ID NO: 1423 - protein, 90 aa, Artificial
  Substituion in SEQ ID NO 1412
MNKMELINRVAEKTNLKKKDADSAVNAVFEIIEEALANGEKVQIIGFGTFETRSRAARSGRNPQTGEVIEIPASTVPAFKPGNKLKEVTR

SEQ ID NO: 1424 - DNA, 273 bp, Artificial
  Substituion in SEQ ID NO 1413
gtgaataagatggatctcatcaaccgtgtcgcggaaaagaccaacttgaagaagaaggacgcggagagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgcgctga

SEQ ID NO: 1425 - DNA, 273 bp, Artificial
  Substituion in SEQ ID NO 1413
gtgaataagatggaactcatcaaccgtgtcgcggaaaagaccaacttgaagaagaaggacgcggagagtgcggtcaacgccgtgttcgagatcatcgaggaggccctcgccaacggcgagaaggtgcagttaatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgcgctga

SEQ ID NO: 1426 - DNA, 273 bp, Artificial
  Substituion in SEQ ID NO 1413
gtgaataagatggaactcatcaaccgtgtcgcggaaaagacccaattgaagaagaaggacgcggagagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgcgctga

SEQ ID NO: 1427 - DNA, 273 bp, Artificial
  Substituion in SEQ ID NO 1413
gtgaataagatggaactcatcaaccgtgtcgcggaaaagaccaacttgaagaagaaggacgcggagagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggatgtcacgcgctga

SEQ ID NO: 1428 - DNA, 273 bp, Artificial
  Substituion in SEQ ID NO 1413
gtgaataagatggaactcatcaaccgtgtcgcggaaaagaccaacttgaagaagaaggacgcggatagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgcgctga

SEQ ID NO: 1429 - protein, 106 aa, Alicyclobacillus acidocaldarius
MDAFGRRLRAFRKLKHMTQADLARALGVSLATIGGIERGTRQPTAHLVSAIASALSVDVEELCGPTWPGDGWDRGAAEDAADSRAGHGHATVDGPHSPLDQGAMVR

SEQ ID NO: 1430 - DNA, 321 bp, Alicyclobacillus acidocaldarius
ttggacgcttttggtaggcggctgcgcgcctttcgcaagttgaagcacatgacccaggccgatctcgcccgcgccctcggcgtaagcctcgccaccatcggcgggatcgagcgaggcacccgccagccgacggcccatctcgtgagcgccatcgcgagcgcgctctccgtcgacgtggaggagctgtgcggcccaacctggccgggggacggttgggaccgcggagcggcggaggacgcggccgattcgcgcgcgggccacgggcatgccaccgtggatggtccgcattcgccgctggatcagggcgcgatggtacgttga

SEQ ID NO: 1431 - protein, 61 aa, Bacillus pumilus SAFR-032
DVWGRRIRAYRKLKGYTQEGFAKRLGISVSVLGEIERGNRLPTNQLVGQIADALNITVEEL

SEQ ID NO: 1432 - protein, 64 aa, Geobacillus thermodenitrificans NG80-2
ERWGRRIRAFRKLKGYTQERLAKELGVSVSILGEIERGNRMPSDSLVEQIAELLNISVEELTPP

SEQ ID NO: 1433 - protein, 64 aa, Geobacillus kaustophilus HTA426
ERWGRRIRAFRKLKGYTQERLAKELGISVSILGEIERGNRMPSDSLVGQIAERLNISVEELAPP

SEQ ID NO: 1434 - protein, 61 aa, Bacillus licheniformis ATCC 14580
EIWGRRIRAYRKLKGYTQEGFAKALGISVSVLGEVERGNRMPTESMLRDVANTLNITVEEL

SEQ ID NO: 1435 - protein, 61 aa, Bacillus cereus ATCC 14579
EKWGRRIRAFRKLKGYTQEGFAKELGVSVSVLGEVERGNRSPSQDFVVEVAKALNVSIEEL

SEQ ID NO: 1436 - protein, 106 aa, Artificial
  Substituion in SEQ ID NO 1429
MDAFGRRLRAFRKLKHMTQADLARALGVSLATIGGIERGTRQPTAHLVSAIASALSVDVEELCGPTWPGDGWDRGAAEDAADSRAGHGHATVDGPHSPIDQGAMVR

SEQ ID NO: 1437 - protein, 106 aa, Artificial
  Substituion in SEQ ID NO 1429
MDAFGRRLRAFRKLKHMTQADLARALGVSLATIGGIERGTRQPTAHLVSAIASALSVDVEELCGPTWPGDGWDRGAAEDAADSKAGHGHATVDGPHSPLDQGAMVR

SEQ ID NO: 1438 - protein, 106 aa, Artificial
  Substituion in SEQ ID NO 1429
MDAFGRRIRAFRKLKHMTQADLARALGVSLATIGGIERGTRQPTAHLVSAIASALSVDVEELCGPTWPGDGWDRGAAEDAADSRAGHGHATVDGPHSPLDQGAMVR

SEQ ID NO: 1439 - protein, 106 aa, Artificial
  Substituion in SEQ ID NO 1429
MDAFGRRLRAFRKLKHMTQADLARALGVSLATIGGIERGTRQPTAHLVSAIASALSVDVEELCGPTWPGEGWDRGAAEDAADSRAGHGHATVDGPHSPLDQGAMVR

SEQ ID NO: 1440 - protein, 106 aa, Artificial
  Substituion in SEQ ID NO 1429
MDAFGRRLRAFRKLKHMTQADLARALGVSLATIGGIERGTRQPTAHLISAIASALSVDVEELCGPTWPGDGWDRGAAEDAADSRAGHGHATVDGPHSPLDQGAMVR

SEQ ID NO: 1441 - DNA, 321 bp, Artificial
  Substituion in SEQ ID NO 1430
ttggacgcttttggtaggcggctgcgcgcctttcgcaagttgaagcacatgacccaggccgatctcgcccgcgccctcggcgtaagcctcgccaccatcggcgggatcgagcgaggcacccgccagccgacggcccatctcgtgagcgccatcgcgagcgcgctctccgtcgacgtggaggagctgtgcggcccaacctggccgggggacggttgggaccgcggagcggcggaggacgcggccgattcgcgcgcgggccacgggcatgccaccgtggatggtccgcattcgccgattgatcagggcgcgatggtacgttga

SEQ ID NO: 1442 - DNA, 321 bp, Artificial
  Substituion in SEQ ID NO 1430
ttggacgcttttggtaggcggctgcgcgcctttcgcaagttgaagcacatgacccaggccgatctcgcccgcgccctcggcgtaagcctcgccaccatcggcgggatcgagcgaggcacccgccagccgacggcccatctcgtgagcgccatcgcgagcgcgctctccgtcgacgtggaggagctgtgcggcccaacctggccgggggacggttgggaccgcggagcggcggaggacgcggccgattcgaaagcgggccacgggcatgccaccgtggatggtccgcattcgccgctggatcagggcgcgatggtacgttga

SEQ ID NO: 1443 - DNA, 321 bp, Artificial
  Substituion in SEQ ID NO 1430
ttggacgcttttggtaggcggattcgcgcctttcgcaagttgaagcacatgacccaggccgatctcgcccgcgccctcggcgtaagcctcgccaccatcggcgggatcgagcgaggcacccgccagccgacggcccatctcgtgagcgccatcgcgagcgcgctctccgtcgacgtggaggagctgtgcggcccaacctggccgggggacggttgggaccgcggagcggcggaggacgcggccgattcgcgcgcgggccacgggcatgccaccgtggatggtccgcattcgccgctggatcagggcgcgatggtacgttga

SEQ ID NO: 1444 - DNA, 321 bp, Artificial
  Substituion in SEQ ID NO 1430
ttggacgcttttggtaggcggctgcgcgcctttcgcaagttgaagcacatgacccaggccgatctcgcccgcgccctcggcgtaagcctcgccaccatcggcgggatcgagcgaggcacccgccagccgacggcccatctcgtgagcgccatcgcgagcgcgctctccgtcgacgtggaggagctgtgcggcccaacctggccgggggaaggttgggaccgcggagcggcggaggacgcggccgattcgcgcgcgggccacgggcatgccaccgtggatggtccgcattcgccgctggatcagggcgcgatggtacgttga

SEQ ID NO: 1445 - DNA, 321 bp, Artificial
  Substituion in SEQ ID NO 1430
ttggacgcttttggtaggcggctgcgcgcctttcgcaagttgaagcacatgacccaggccgatctcgcccgcgccctcggcgtaagcctcgccaccatcggcgggatcgagcgaggcacccgccagccgacggcccatctcattagcgccatcgcgagcgcgctctccgtcgacgtggaggagctgtgcggcccaacctggccgggggacggttgggaccgcggagcggcggaggacgcggccgattcgcgcgcgggccacgggcatgccaccgtggatggtccgcattcgccgctggatcagggcgcgatggtacgttga

SEQ ID NO: 1446 - protein, 202 aa, Alicyclobacillus acidocaldarius
MTIPFFRTMVSSMAHSARAARDGMHASRYSGSLEAPTGSKGETAMADKEVLLTPEGLRKLEEELELLKSVKRREVAERIKVAISYGDISENSEYEDAKNEQAFIEGRIMTLEKQLRNARVINEDEVDTNVVSIGSTVKVLDLDLDEEVEYTIVGSAEANPAENKISNESPVGKALLGKQIGSIVEVNVPAGVIKFKILEIKR

SEQ ID NO: 1447 - DNA, 609 bp, Alicyclobacillus acidocaldarius
gtgacgattccgtttttccggacaatggtatcctcaatggctcacagcgcgcgtgctgccagggatggcatgcacgcttctcgctattccgggagccttgaagcaccgactgggagcaaaggagagacagccatggcagataaagaagtgttgctcacgcccgagggcctgcggaagctcgaggaggagctcgagctcctgaagagcgtcaagcggcgcgaggttgcggagcgcatcaaggttgccatcagctacggagatattagtgagaattctgagtatgaagatgcgaagaacgagcaggcgttcatcgaaggccgcatcatgaccctcgagaagcagctgcgcaacgcgcgggtcatcaacgaggacgaggtcgacaccaacgtcgtcagcatcggatcgaccgtcaaggtgttggatctggatctggacgaggaagtggaatacaccatcgtcggttccgctgaggccaaccccgcggagaacaagatctcgaacgagtcgcccgtgggcaaggcgctgcttggcaagcagattggctcgatcgtcgaggtgaacgtgcccgcaggcgtcatcaagttcaaaatccttgagatcaagcggtaa

SEQ ID NO: 1448 - protein, 158 aa, Thermosinus carboxydivorans Nor1
MAEKQTILTVDGLKKIEQKLEHLKSVRRREVAERIKQAIEFGDISENSEYEDAKNEQAFIEGEILTLEKMLRNAKVIDEGEISTDTVTIGSTVVLKDLEFGDELEYTLVGSAEADPMEFKISNESPVGQAIMGQKVGSVVEVNVPAGILKYKILEIKR

SEQ ID NO: 1449 - protein, 156 aa, Clostridium thermocellum ATCC 27405
NKEVVLTYEGLQKLEQELENLKTVKRREVAERIKQALSFGDISENSEYDEAKNEQAYIEGRIFQLENMLKNAKVIDEEDIQTDVVSIGSKVKVLDMEFDEEVEYYIVGSTEADPSQYKISNESPVGKALIGGKIGDIVEVTVPDGVIKFKILEIRK

SEQ ID NO: 1450 - protein, 158 aa, Pelotomaculum thermopropionicum SI
MKEKEVILTVNGLKKLESELELLKSVKRREVAERIKQAIEFGDITENSEYEDAKNEQAFIEGRILTLEKMLRNAKIIDDENIGTEVVSIGSTVLLKDLECGDEYKYTIVGSAEADPGANKISNESPVGRAILGQPKGSVVEVTVPAGQLKYQIIDILR

SEQ ID NO: 1451 - protein, 158 aa, Desulfotomaculum reducens MI-1
MKEKDVMLTVTGLKQLEDELEQLKTVKRRQVAERIKQAIEFGDISENSEYEDAKNEQAFIEGRILTLEKMLRNAKIIDDENLDNEVVSLGSKVILKDLEFGDELEYSIVGSVEADPDANKISNESPVGRAILGQSKGSVVEVNVPAGILKYEIVDILR

SEQ ID NO: 1452 - protein, 158 aa, Clostridium cellulolyticum H10
MSAKEVVLTYEGLKKLEEELEFLRGTKRKEVAERIKQALSFGDISENSEYDEAKNEQAQVEGRIVQLESMLKHARIIDEDEVNTDVVSIGSKVRIFDIEFDEEVEYLIVGSTEANPLKSKISNESPVGAALIGHTKGETVEVQVPDGVLKFKILEISK

SEQ ID NO: 1453 - protein, 202 aa, Artificial
  Substituion in SEQ ID NO 1446
MTIPFFRTMVSSMAHSARAAREGMHASRYSGSLEAPTGSKGETAMADKEVLLTPEGLRKLEEELELLKSVKRREVAERIKVAISYGDISENSEYEDAKNEQAFIEGRIMTLEKQLRNARVINEDEVDTNVVSIGSTVKVLDLDLDEEVEYTIVGSAEANPAENKISNESPVGKALLGKQIGSIVEVNVPAGVIKFKILEIKR

SEQ ID NO: 1454 - protein, 202 aa, Artificial
  Substituion in SEQ ID NO 1446
MTIPFFRTMVSSMAHSARAARDGMHASRYSGSLEAPTGSKGETAMADKEVLLTPEGLRKLEEELELLKSVKRREVAERIKVAISYGDISENSEYEDAKNEQAFIEGRIMTLEKQLRNARVINDDEVDTNVVSIGSTVKVLDLDLDEEVEYTIVGSAEANPAENKISNESPVGKALLGKQIGSIVEVNVPAGVIKFKILEIKR

SEQ ID NO: 1455 - protein, 202 aa, Artificial
  Substituion in SEQ ID NO 1446
MTIPFFRTMVSSMAHSARAARDGMHASRYSGSLEAPTGSKGETAMAEKEVLLTPEGLRKLEEELELLKSVKRREVAERIKVAISYGDISENSEYEDAKNEQAFIEGRIMTLEKQLRNARVINEDEVDTNVVSIGSTVKVLDLDLDEEVEYTIVGSAEANPAENKISNESPVGKALLGKQIGSIVEVNVPAGVIKFKILEIKR

SEQ ID NO: 1456 - protein, 202 aa, Artificial
  Substituion in SEQ ID NO 1446
MTIPFFRTMVSSMAHSARAARDGMHASRYSGSLEAPTGSKGETAMADKEVLLTPEGLRKLEEELEILKSVKRREVAERIKVAISYGDISENSEYEDAKNEQAFIEGRIMTLEKQLRNARVINEDEVDTNVVSIGSTVKVLDLDLDEEVEYTIVGSAEANPAENKISNESPVGKALLGKQIGSIVEVNVPAGVIKFKILEIKR

SEQ ID NO: 1457 - protein, 202 aa, Artificial
  Substituion in SEQ ID NO 1446
MTIPFFRTMVSSMAHSARAARDGMHASRYSGSLEAPTGSKGETAMADKEVLLTPEGLRKLEEELELLKSVKRREVAERIKVAISYGDISENSEYEDAKNEQAFIEGRIMTLEKQLRNARVIQEDEVDTNVVSIGSTVKVLDLDLDEEVEYTIVGSAEANPAENKISNESPVGKALLGKQIGSIVEVNVPAGVIKFKILEIKR

SEQ ID NO: 1458 - DNA, 609 bp, Artificial
  Substituion in SEQ ID NO 1447
gtgacgattccgtttttccggacaatggtatcctcaatggctcacagcgcgcgtgctgccagggaaggcatgcacgcttctcgctattccgggagccttgaagcaccgactgggagcaaaggagagacagccatggcagataaagaagtgttgctcacgcccgagggcctgcggaagctcgaggaggagctcgagctcctgaagagcgtcaagcggcgcgaggttgcggagcgcatcaaggttgccatcagctacggagatattagtgagaattctgagtatgaagatgcgaagaacgagcaggcgttcatcgaaggccgcatcatgaccctcgagaagcagctgcgcaacgcgcgggtcatcaacgaggacgaggtcgacaccaacgtcgtcagcatcggatcgaccgtcaaggtgttggatctggatctggacgaggaagtggaatacaccatcgtcggttccgctgaggccaaccccgcggagaacaagatctcgaacgagtcgcccgtgggcaaggcgctgcttggcaagcagattggctcgatcgtcgaggtgaacgtgcccgcaggcgtcatcaagttcaaaatccttgagatcaagcggtaa

SEQ ID NO: 1459 - DNA, 609 bp, Artificial
  Substituion in SEQ ID NO 1447
gtgacgattccgtttttccggacaatggtatcctcaatggctcacagcgcgcgtgctgccagggatggcatgcacgcttctcgctattccgggagccttgaagcaccgactgggagcaaaggagagacagccatggcagataaagaagtgttgctcacgcccgagggcctgcggaagctcgaggaggagctcgagctcctgaagagcgtcaagcggcgcgaggttgcggagcgcatcaaggttgccatcagctacggagatattagtgagaattctgagtatgaagatgcgaagaacgagcaggcgttcatcgaaggccgcatcatgaccctcgagaagcagctgcgcaacgcgcgggtcatcaacgatgacgaggtcgacaccaacgtcgtcagcatcggatcgaccgtcaaggtgttggatctggatctggacgaggaagtggaatacaccatcgtcggttccgctgaggccaaccccgcggagaacaagatctcgaacgagtcgcccgtgggcaaggcgctgcttggcaagcagattggctcgatcgtcgaggtgaacgtgcccgcaggcgtcatcaagttcaaaatccttgagatcaagcggtaa

SEQ ID NO: 1460 - DNA, 609 bp, Artificial
  Substituion in SEQ ID NO 1447
gtgacgattccgtttttccggacaatggtatcctcaatggctcacagcgcgcgtgctgccagggatggcatgcacgcttctcgctattccgggagccttgaagcaccgactgggagcaaaggagagacagccatggcagaaaaagaagtgttgctcacgcccgagggcctgcggaagctcgaggaggagctcgagctcctgaagagcgtcaagcggcgcgaggttgcggagcgcatcaaggttgccatcagctacggagatattagtgagaattctgagtatgaagatgcgaagaacgagcaggcgttcatcgaaggccgcatcatgaccctcgagaagcagctgcgcaacgcgcgggtcatcaacgaggacgaggtcgacaccaacgtcgtcagcatcggatcgaccgtcaaggtgttggatctggatctggacgaggaagtggaatacaccatcgtcggttccgctgaggccaaccccgcggagaacaagatctcgaacgagtcgcccgtgggcaaggcgctgcttggcaagcagattggctcgatcgtcgaggtgaacgtgcccgcaggcgtcatcaagttcaaaatccttgagatcaagcggtaa

SEQ ID NO: 1461 - DNA, 609 bp, Artificial
  Substituion in SEQ ID NO 1447
gtgacgattccgtttttccggacaatggtatcctcaatggctcacagcgcgcgtgctgccagggatggcatgcacgcttctcgctattccgggagccttgaagcaccgactgggagcaaaggagagacagccatggcagataaagaagtgttgctcacgcccgagggcctgcggaagctcgaggaggagctcgagattctgaagagcgtcaagcggcgcgaggttgcggagcgcatcaaggttgccatcagctacggagatattagtgagaattctgagtatgaagatgcgaagaacgagcaggcgttcatcgaaggccgcatcatgaccctcgagaagcagctgcgcaacgcgcgggtcatcaacgaggacgaggtcgacaccaacgtcgtcagcatcggatcgaccgtcaaggtgttggatctggatctggacgaggaagtggaatacaccatcgtcggttccgctgaggccaaccccgcggagaacaagatctcgaacgagtcgcccgtgggcaaggcgctgcttggcaagcagattggctcgatcgtcgaggtgaacgtgcccgcaggcgtcatcaagttcaaaatccttgagatcaagcggtaa

SEQ ID NO: 1462 - DNA, 609 bp, Artificial
  Substituion in SEQ ID NO 1447
gtgacgattccgtttttccggacaatggtatcctcaatggctcacagcgcgcgtgctgccagggatggcatgcacgcttctcgctattccgggagccttgaagcaccgactgggagcaaaggagagacagccatggcagataaagaagtgttgctcacgcccgagggcctgcggaagctcgaggaggagctcgagctcctgaagagcgtcaagcggcgcgaggttgcggagcgcatcaaggttgccatcagctacggagatattagtgagaattctgagtatgaagatgcgaagaacgagcaggcgttcatcgaaggccgcatcatgaccctcgagaagcagctgcgcaacgcgcgggtcatccaagaggacgaggtcgacaccaacgtcgtcagcatcggatcgaccgtcaaggtgttggatctggatctggacgaggaagtggaatacaccatcgtcggttccgctgaggccaaccccgcggagaacaagatctcgaacgagtcgcccgtgggcaaggcgctgcttggcaagcagattggctcgatcgtcgaggtgaacgtgcccgcaggcgtcatcaagttcaaaatccttgagatcaagcggtaa

SEQ ID NO: 1463 - protein, 429 aa, Alicyclobacillus acidocaldarius
MFKRLSLRLTLLTVVLLVVLYSITSLALYGIIRGFVMRSIDFNLRQAAYRVANTAVLTGIPSFASTGSPEINFVLADNGVYTSIADPDLASALENRLNRAVDRPTFFNFTYQGEHYRVYDLPIAAGSGGPAYVATILDDTQTVRAMSDLRSVIVIVGLFGICGATLVGFILSDRMLQPIRRAFQRQLEFVADASHELRTPLAVIQSNLGIVMEHTDQTVEENLEWLNNAHGEARRLAKLVQDLLTLARSDSERMPVERRPVALNDLLERIHDLYETIAEMRGIELTVRAEEPLVVLGDRDRLHQLLVILIDNAMKFTDAGGKVEIAATRNRNQAILSVRDTGIGIAKEHLERVFDRFYTVDTARSRHGEAKGTGLGLSIAKWIVEAHGGRISIASEGIGKGTTVRVELPLSPKRAAGSDEGDVTAKSEA

SEQ ID NO: 1464 - DNA, 1290 bp, Alicyclobacillus acidocaldarius
ttgtttaagcgactgagcctccggctgacgctattgaccgtcgtcctcttggtggtcctgtacagcatcacgtcgctcgcactctacgggattatccggggattcgtgatgcgaagtatcgacttcaatctgcgccaggcggcctaccgcgtggccaacacggccgtcttgacgggcattccgagcttcgcctccaccggatcacccgagatcaacttcgtcctcgcggacaacggcgtctacacgtccatcgcggacccggacctggcgagcgcgctggaaaatcgtctgaaccgagccgtggaccggccgacgttcttcaatttcacgtaccagggcgagcattaccgcgtctacgacctgcccatcgccgccggatccggcgggccggcctacgtcgccacgatcctcgacgacacgcagaccgtgcgcgccatgagcgacctgcgctccgtgatcgtcatcgtggggctgtttggcatctgcggggcgacgctcgtcggcttcatcttgtccgatcgcatgcttcagcccattcgccgggcgtttcagcgccagctcgagtttgtcgcggacgcctcgcacgagctcaggacgccgctcgcggtcatccagtcgaacctcggcattgtgatggaacacacggaccaaaccgtcgaggaaaacctggagtggctgaacaacgcccacggcgaggcgcgcaggctcgcgaaactggtgcaggatttgctcacgctggcgcggtcagactccgagcgcatgccggtggaacggcgcccggttgcgctcaacgacctgctcgagcgcatccacgatctgtacgagaccatcgcggagatgcgcggcattgagctcaccgtgcgcgcggaggaaccgctcgtcgtcttgggcgatcgcgaccggctccatcagctcttggtgattttgatcgacaacgcgatgaaattcacggatgcgggcggcaaggtcgaaattgccgcgacgcgcaaccggaatcaggcgattctgtcggtccgcgacacgggcatcggcatcgccaaggagcatctggagcgcgtgttcgaccggttttacaccgttgacacggcgcgatcgcgccacggggaggccaaggggacgggacttgggctgtccatcgccaagtggattgtggaagcgcacggcggccgaatctccatcgcgagcgagggcattggcaaggggacgacggtccgcgtggaactgccgctttcgcccaagcgagccgccggatcggacgagggcgacgtcacggcgaaaagcgaggcgtga

SEQ ID NO: 1465 - protein, 249 aa, Bacillus coagulans 36D1
AVIAGLVLAERALKPIKAAWDKQTQFVSDASHEIRTPLAVIQSRVELLLRKPNETVRDVLQDISTVLNECRRLTKLVSNLLTLARSDSDKIEIERKPFYLDELLREIMDHFSELAAIQGKTLILKSAPPVTFSGDRDRIHQLIVILLDNAMKYTGDGGKIELACFESKNHVGISVQDNGIGLKEEDREKIFDRFFQVSKSRTKTESLGLGLSIAKWIVEKHSGKIRVDSKLGEGTTFTITFPKKKRKDA

SEQ ID NO: 1466 - protein, 392 aa, Thermosinus carboxydivorans Nor1
LYGYVAYRLFDKVDDAMRFKAENFKIVNGRAILPGRVRFLFDPRIIILVRDSQGRVTSSFPSEVAELERLAALASQVDAGKVHISEVDSHAYRLISLPYRYEENVLQTERGPIVVKDVIAVSIVDSEVALLRNLFMIIVSGLVIGMLIIIMAGYYLARRAMVPIQAAWEKQQQFVADASHELRTPLAVIKSNAELMLRHPDHTIEDESIRVTNIVREVRRMTRLVADLLTLARADANQSELQLGAVSLSELVDAVSEQFKPLAQLEGHTLTVAVYEQLELVGDRERLYQLLVILLDNAVKYTPPPGHILITGVRQGSHILLTVEDSGQGIPPEDLPRVFDRFYRGDKARSREKGGTGLGLAIAKWIVEKHGGKIWVESKVGVGTKFSVLLPV

SEQ ID NO: 1467 - protein, 333 aa, Bacillus thuringiensis serovar israelensis ATCC 35646
TWNGKIVKIEGDNRKFRSIFEENLEKFSPKKLGELQDIEVQGRYFRAFSLQKDGEIVQIVRDITAEERMLNTLFLILVIGCSIGSLCAIGIGFFLAGRALVPIQNSWEKQQQFVSDASHELRTPLAVIQSKTDVLFQSPSATIEEKAMDISTISKECRRLSKLVSNLLLLARSDSNQIEMDKKTFELDKLLEEIVAPYKEIASYQEKEMILKVERGVSFMGDRERIHQMMVILLDNAMKYTNEGGHIQIDCTQMSSSIRIQVKDDGIGVKEEDIPKLFDRFYQGDKARSTSEGAGLGLSIANWIVEKHYGKISVESRWGNGTCFEVIFPKNQK

SEQ ID NO: 1468 - protein, 274 aa, Clostridium thermocellum ATCC 27405
YIIVFLDYTVEEKMYKPLIIISIYIVLLSIVLVFTVSFFLANRSIKPIKTSWEKQTAFIADASHELRTPLAVINSNLEIVMENENETVGSQMKWLGNIQSELERMKKLVDDLLFLARADAEDEMPKEYFDLSRLVHKIYDEFTPLCQKKSLEFLLDAKDNIVFYGNEFRIKQLITILLDNAIKFTGEGGKIILKLKVHANSIQLSVSDTGEGIAKEHIDKIFDRFYRVDKSRSRNHGGSGLGLAIAKCIVNEHKGTIDVFSEVSRGTEFTVSLP

SEQ ID NO: 1469 - protein, 333 aa, Bacillus cereus ATCC 14579
TWNGKIVKIEGDNRKFRSIFEENLESFSPEKLEELQDIEVQGRYFRAFSLQKDGEIVQIVRDITAEEGMLNTLFLILVIGCSIGSLCAIGIGFFLAGRALVPIQSSWEKQQQFVSDASHELRTPLAVIQSKTDVLFQSPSATIEEKAMDISTISKECRRLSKLVSNLLLLARSDSNQIEMDKKIFELDKLLEEIVAPYKEIASYQEKEMMLKVERGVSFMGDRERIHQMMVILLDNAMKYTNEGGHIQIDCTQTSSSIRIQVKDDGIGVKEEDIPKLFDRFYQGDKARSTSEGAGLGLSIANWIVEKHYGKISVESKWGDGTCFEVIFPKNQK

SEQ ID NO: 1470 - protein, 429 aa, Artificial
  Substituion in SEQ ID NO 1463
MFKRLSLRLTLLTVVLLVVLYSITSLALYGIIRGFVMRSIDFNLRQAAYRVANTAVLTGIPSFASTGSPEINFVLADNGVYTSIADPDLASALENRLNRAVDRPTFFNFTYQGEHYRVYDLPIAAGSGGPAYVATILDDTQTVRAMSDLRSVIVIVGLFGICGATLVGFILSDRMLQPIRRAFQRQLEFVADASHELRTPLAVIQSNLGIVMEHTDQTVEENLEWLNNAHGEARRLAKLVQDLLTLARSDSERMPVERRPVALNDLLERIHDLYETIAEMRGIELTVRAEEPLVVLGDRDRLHQLLVILIDNAMKFTDAGGKVEIAATRNRNQAILSVRDTGIGIAKEHLERVFDRFYTVDTARSRHGEAKGTGLGLSIAKWIVDAHGGRISIASEGIGKGTTVRVELPLSPKRAAGSDEGDVTAKSEA

SEQ ID NO: 1471 - protein, 429 aa, Artificial
  Substituion in SEQ ID NO 1463
MFKRLSLRLTLLTVVLLVVLYSITSLALYGIIRGFVMRSIDFNLRQAAYRVANTAVLTGIPSFASTGSPEINFVLADNGVYTSIADPDLASALENRLNRAVDRPTFFNFTYQGEHYRVYDLPIAAGSGGPAYVATILDDTQTVRAMSDLRSVIVIVGLFGICGATLVGFILSDRMLQPIRRAFQRQLEFVADASHELRTPLAVIQSNLGIVMEHTDQTVEENLEWLNNAHGEARRLAKLVQDLLTLARSDSERMPVERRPVALNDLLERIHDLYETIAEMRGIELTVRAEEPLIVLGDRDRLHQLLVILIDNAMKFTDAGGKVEIAATRNRNQAILSVRDTGIGIAKEHLERVFDRFYTVDTARSRHGEAKGTGLGLSIAKWIVEAHGGRISIASEGIGKGTTVRVELPLSPKRAAGSDEGDVTAKSEA

SEQ ID NO: 1472 - protein, 429 aa, Artificial
  Substituion in SEQ ID NO 1463
MFKRLSLRLTLLTVVLLVVLYSITSLALYGIIRGFVMRSIDFNLRQAAYRVANTAVLTGIPSFASTGSPEINFVLADNGVYTSIADPDLASALENRLNRAVDRPTFFNFTYQGEHYRVYDLPIAAGSGGPAYVATILDDTQTVRAMSDLRSVIVIVGLFGICGATLVGFILSDRMLNPIRRAFQRQLEFVADASHELRTPLAVIQSNLGIVMEHTDQTVEENLEWLNNAHGEARRLAKLVQDLLTLARSDSERMPVERRPVALNDLLERIHDLYETIAEMRGIELTVRAEEPLVVLGDRDRLHQLLVILIDNAMKFTDAGGKVEIAATRNRNQAILSVRDTGIGIAKEHLERVFDRFYTVDTARSRHGEAKGTGLGLSIAKWIVEAHGGRISIASEGIGKGTTVRVELPLSPKRAAGSDEGDVTAKSEA

SEQ ID NO: 1473 - protein, 429 aa, Artificial
  Substituion in SEQ ID NO 1463
MFKRLSLRLTLLTVVLLVVLYSITSLALYGIIRGFVMRSIDFNLRQAAYRVANTAVLTGIPSFASTGSPEINFVLADNGVYTSIADPDLASALDNRLNRAVDRPTFFNFTYQGEHYRVYDLPIAAGSGGPAYVATILDDTQTVRAMSDLRSVIVIVGLFGICGATLVGFILSDRMLQPIRRAFQRQLEFVADASHELRTPLAVIQSNLGIVMEHTDQTVEENLEWLNNAHGEARRLAKLVQDLLTLARSDSERMPVERRPVALNDLLERIHDLYETIAEMRGIELTVRAEEPLVVLGDRDRLHQLLVILIDNAMKFTDAGGKVEIAATRNRNQAILSVRDTGIGIAKEHLERVFDRFYTVDTARSRHGEAKGTGLGLSIAKWIVEAHGGRISIASEGIGKGTTVRVELPLSPKRAAGSDEGDVTAKSEA

SEQ ID NO: 1474 - protein, 429 aa, Artificial
  Substituion in SEQ ID NO 1463
MFKRLSLRLTLLTVVLLVVLYSITSLALYGIIRGFVMRSIDFNLRQAAYRVANTAVLTGIPSFASTGSPEINFVLADNGVYTSIADPDLASALENRLNRAVDRPTFFNFTYQGEHYRVYDLPIAAGSGGPAYVATILDDTQTVRAMSDLRSVIVIVGLFGICGATLVGFILSDRMLQPIRRAFQRQLEFVADASHELRTPLAVIQSNLGIVMEHTDQTVEENLEWLNNAHGEARRLAKLVQDLLTLARSDSERMPVDRRPVALNDLLERIHDLYETIAEMRGIELTVRAEEPLVVLGDRDRLHQLLVILIDNAMKFTDAGGKVEIAATRNRNQAILSVRDTGIGIAKEHLERVFDRFYTVDTARSRHGEAKGTGLGLSIAKWIVEAHGGRISIASEGIGKGTTVRVELPLSPKRAAGSDEGDVTAKSEA

SEQ ID NO: 1475 - DNA, 1290 bp, Artificial
  Substituion in SEQ ID NO 1464
ttgtttaagcgactgagcctccggctgacgctattgaccgtcgtcctcttggtggtcctgtacagcatcacgtcgctcgcactctacgggattatccggggattcgtgatgcgaagtatcgacttcaatctgcgccaggcggcctaccgcgtggccaacacggccgtcttgacgggcattccgagcttcgcctccaccggatcacccgagatcaacttcgtcctcgcggacaacggcgtctacacgtccatcgcggacccggacctggcgagcgcgctggaaaatcgtctgaaccgagccgtggaccggccgacgttcttcaatttcacgtaccagggcgagcattaccgcgtctacgacctgcccatcgccgccggatccggcgggccggcctacgtcgccacgatcctcgacgacacgcagaccgtgcgcgccatgagcgacctgcgctccgtgatcgtcatcgtggggctgtttggcatctgcggggcgacgctcgtcggcttcatcttgtccgatcgcatgcttcagcccattcgccgggcgtttcagcgccagctcgagtttgtcgcggacgcctcgcacgagctcaggacgccgctcgcggtcatccagtcgaacctcggcattgtgatggaacacacggaccaaaccgtcgaggaaaacctggagtggctgaacaacgcccacggcgaggcgcgcaggctcgcgaaactggtgcaggatttgctcacgctggcgcggtcagactccgagcgcatgccggtggaacggcgcccggttgcgctcaacgacctgctcgagcgcatccacgatctgtacgagaccatcgcggagatgcgcggcattgagctcaccgtgcgcgcggaggaaccgctcgtcgtcttgggcgatcgcgaccggctccatcagctcttggtgattttgatcgacaacgcgatgaaattcacggatgcgggcggcaaggtcgaaattgccgcgacgcgcaaccggaatcaggcgattctgtcggtccgcgacacgggcatcggcatcgccaaggagcatctggagcgcgtgttcgaccggttttacaccgttgacacggcgcgatcgcgccacggggaggccaaggggacgggacttgggctgtccatcgccaagtggattgtggatgcgcacggcggccgaatctccatcgcgagcgagggcattggcaaggggacgacggtccgcgtggaactgccgctttcgcccaagcgagccgccggatcggacgagggcgacgtcacggcgaaaagcgaggcgtga

SEQ ID NO: 1476 - DNA, 1290 bp, Artificial
  Substituion in SEQ ID NO 1464
ttgtttaagcgactgagcctccggctgacgctattgaccgtcgtcctcttggtggtcctgtacagcatcacgtcgctcgcactctacgggattatccggggattcgtgatgcgaagtatcgacttcaatctgcgccaggcggcctaccgcgtggccaacacggccgtcttgacgggcattccgagcttcgcctccaccggatcacccgagatcaacttcgtcctcgcggacaacggcgtctacacgtccatcgcggacccggacctggcgagcgcgctggaaaatcgtctgaaccgagccgtggaccggccgacgttcttcaatttcacgtaccagggcgagcattaccgcgtctacgacctgcccatcgccgccggatccggcgggccggcctacgtcgccacgatcctcgacgacacgcagaccgtgcgcgccatgagcgacctgcgctccgtgatcgtcatcgtggggctgtttggcatctgcggggcgacgctcgtcggcttcatcttgtccgatcgcatgcttcagcccattcgccgggcgtttcagcgccagctcgagtttgtcgcggacgcctcgcacgagctcaggacgccgctcgcggtcatccagtcgaacctcggcattgtgatggaacacacggaccaaaccgtcgaggaaaacctggagtggctgaacaacgcccacggcgaggcgcgcaggctcgcgaaactggtgcaggatttgctcacgctggcgcggtcagactccgagcgcatgccggtggaacggcgcccggttgcgctcaacgacctgctcgagcgcatccacgatctgtacgagaccatcgcggagatgcgcggcattgagctcaccgtgcgcgcggaggaaccgctcattgtcttgggcgatcgcgaccggctccatcagctcttggtgattttgatcgacaacgcgatgaaattcacggatgcgggcggcaaggtcgaaattgccgcgacgcgcaaccggaatcaggcgattctgtcggtccgcgacacgggcatcggcatcgccaaggagcatctggagcgcgtgttcgaccggttttacaccgttgacacggcgcgatcgcgccacggggaggccaaggggacgggacttgggctgtccatcgccaagtggattgtggaagcgcacggcggccgaatctccatcgcgagcgagggcattggcaaggggacgacggtccgcgtggaactgccgctttcgcccaagcgagccgccggatcggacgagggcgacgtcacggcgaaaagcgaggcgtga

SEQ ID NO: 1477 - DNA, 1290 bp, Artificial
  Substituion in SEQ ID NO 1464
ttgtttaagcgactgagcctccggctgacgctattgaccgtcgtcctcttggtggtcctgtacagcatcacgtcgctcgcactctacgggattatccggggattcgtgatgcgaagtatcgacttcaatctgcgccaggcggcctaccgcgtggccaacacggccgtcttgacgggcattccgagcttcgcctccaccggatcacccgagatcaacttcgtcctcgcggacaacggcgtctacacgtccatcgcggacccggacctggcgagcgcgctggaaaatcgtctgaaccgagccgtggaccggccgacgttcttcaatttcacgtaccagggcgagcattaccgcgtctacgacctgcccatcgccgccggatccggcgggccggcctacgtcgccacgatcctcgacgacacgcagaccgtgcgcgccatgagcgacctgcgctccgtgatcgtcatcgtggggctgtttggcatctgcggggcgacgctcgtcggcttcatcttgtccgatcgcatgcttaatcccattcgccgggcgtttcagcgccagctcgagtttgtcgcggacgcctcgcacgagctcaggacgccgctcgcggtcatccagtcgaacctcggcattgtgatggaacacacggaccaaaccgtcgaggaaaacctggagtggctgaacaacgcccacggcgaggcgcgcaggctcgcgaaactggtgcaggatttgctcacgctggcgcggtcagactccgagcgcatgccggtggaacggcgcccggttgcgctcaacgacctgctcgagcgcatccacgatctgtacgagaccatcgcggagatgcgcggcattgagctcaccgtgcgcgcggaggaaccgctcgtcgtcttgggcgatcgcgaccggctccatcagctcttggtgattttgatcgacaacgcgatgaaattcacggatgcgggcggcaaggtcgaaattgccgcgacgcgcaaccggaatcaggcgattctgtcggtccgcgacacgggcatcggcatcgccaaggagcatctggagcgcgtgttcgaccggttttacaccgttgacacggcgcgatcgcgccacggggaggccaaggggacgggacttgggctgtccatcgccaagtggattgtggaagcgcacggcggccgaatctccatcgcgagcgagggcattggcaaggggacgacggtccgcgtggaactgccgctttcgcccaagcgagccgccggatcggacgagggcgacgtcacggcgaaaagcgaggcgtga

SEQ ID NO: 1478 - DNA, 1290 bp, Artificial
  Substituion in SEQ ID NO 1464
ttgtttaagcgactgagcctccggctgacgctattgaccgtcgtcctcttggtggtcctgtacagcatcacgtcgctcgcactctacgggattatccggggattcgtgatgcgaagtatcgacttcaatctgcgccaggcggcctaccgcgtggccaacacggccgtcttgacgggcattccgagcttcgcctccaccggatcacccgagatcaacttcgtcctcgcggacaacggcgtctacacgtccatcgcggacccggacctggcgagcgcgctggataatcgtctgaaccgagccgtggaccggccgacgttcttcaatttcacgtaccagggcgagcattaccgcgtctacgacctgcccatcgccgccggatccggcgggccggcctacgtcgccacgatcctcgacgacacgcagaccgtgcgcgccatgagcgacctgcgctccgtgatcgtcatcgtggggctgtttggcatctgcggggcgacgctcgtcggcttcatcttgtccgatcgcatgcttcagcccattcgccgggcgtttcagcgccagctcgagtttgtcgcggacgcctcgcacgagctcaggacgccgctcgcggtcatccagtcgaacctcggcattgtgatggaacacacggaccaaaccgtcgaggaaaacctggagtggctgaacaacgcccacggcgaggcgcgcaggctcgcgaaactggtgcaggatttgctcacgctggcgcggtcagactccgagcgcatgccggtggaacggcgcccggttgcgctcaacgacctgctcgagcgcatccacgatctgtacgagaccatcgcggagatgcgcggcattgagctcaccgtgcgcgcggaggaaccgctcgtcgtcttgggcgatcgcgaccggctccatcagctcttggtgattttgatcgacaacgcgatgaaattcacggatgcgggcggcaaggtcgaaattgccgcgacgcgcaaccggaatcaggcgattctgtcggtccgcgacacgggcatcggcatcgccaaggagcatctggagcgcgtgttcgaccggttttacaccgttgacacggcgcgatcgcgccacggggaggccaaggggacgggacttgggctgtccatcgccaagtggattgtggaagcgcacggcggccgaatctccatcgcgagcgagggcattggcaaggggacgacggtccgcgtggaactgccgctttcgcccaagcgagccgccggatcggacgagggcgacgtcacggcgaaaagcgaggcgtga

SEQ ID NO: 1479 - DNA, 1290 bp, Artificial
  Substituion in SEQ ID NO 1464
ttgtttaagcgactgagcctccggctgacgctattgaccgtcgtcctcttggtggtcctgtacagcatcacgtcgctcgcactctacgggattatccggggattcgtgatgcgaagtatcgacttcaatctgcgccaggcggcctaccgcgtggccaacacggccgtcttgacgggcattccgagcttcgcctccaccggatcacccgagatcaacttcgtcctcgcggacaacggcgtctacacgtccatcgcggacccggacctggcgagcgcgctggaaaatcgtctgaaccgagccgtggaccggccgacgttcttcaatttcacgtaccagggcgagcattaccgcgtctacgacctgcccatcgccgccggatccggcgggccggcctacgtcgccacgatcctcgacgacacgcagaccgtgcgcgccatgagcgacctgcgctccgtgatcgtcatcgtggggctgtttggcatctgcggggcgacgctcgtcggcttcatcttgtccgatcgcatgcttcagcccattcgccgggcgtttcagcgccagctcgagtttgtcgcggacgcctcgcacgagctcaggacgccgctcgcggtcatccagtcgaacctcggcattgtgatggaacacacggaccaaaccgtcgaggaaaacctggagtggctgaacaacgcccacggcgaggcgcgcaggctcgcgaaactggtgcaggatttgctcacgctggcgcggtcagactccgagcgcatgccggtggatcggcgcccggttgcgctcaacgacctgctcgagcgcatccacgatctgtacgagaccatcgcggagatgcgcggcattgagctcaccgtgcgcgcggaggaaccgctcgtcgtcttgggcgatcgcgaccggctccatcagctcttggtgattttgatcgacaacgcgatgaaattcacggatgcgggcggcaaggtcgaaattgccgcgacgcgcaaccggaatcaggcgattctgtcggtccgcgacacgggcatcggcatcgccaaggagcatctggagcgcgtgttcgaccggttttacaccgttgacacggcgcgatcgcgccacggggaggccaaggggacgggacttgggctgtccatcgccaagtggattgtggaagcgcacggcggccgaatctccatcgcgagcgagggcattggcaaggggacgacggtccgcgtggaactgccgctttcgcccaagcgagccgccggatcggacgagggcgacgtcacggcgaaaagcgaggcgtga

SEQ ID NO: 1480 - protein, 318 aa, Alicyclobacillus acidocaldarius
MICIIFMLNLYGVMDMFEALRALVTVVSLGSVSEAARALHVTQPTVTRQIQQLERHFGQALFDRSGKRLALTPAGERVHAYALEVLRKQEELAESLLEMSNPEAGLVRMGAGLSPTLYRLPAMVARYASMHPRVRFQVVTGSSKVTLERLASRVVDLAIVTTPPEDEAGVEQVALWRDELVAVAPSYHALAGKRATIVELAQYPLVVMHGESGLRRQIDDLLHRAGVERPAPPVMETDSLEAMNRFVQAGLGLAVVPWPAVADDVTQGRLKLVHIVGCDLGQRTVTLVWRKESHIPAAARAFIEWLASVGAASSSELR

SEQ ID NO: 1481 - DNA, 957 bp, Alicyclobacillus acidocaldarius
atgatatgtatcattttcatgctcaacttgtatggagtgatggacatgtttgaggccctgcgggcgttggtcaccgtggtctcgctcggaagcgtgtccgaggcggcccgagcgctccacgtgacgcaaccaaccgtgacgcgccagattcagcaactggagcgccacttcgggcaggcgctctttgaccggagcgggaaacggcttgcgctgacgcccgccggtgagcgcgtgcacgcgtacgcgcttgaagtgctgcgcaagcaggaggagttggcggagtcgctcctcgagatgtcgaatccggaggcgggcctggtgcgcatgggagcggggctctcccccacgctgtaccgcctgcctgcgatggtggctcgatacgcgtccatgcacccgcgcgtgaggttccaggtggtgacgggatcgtccaaagtgacgctcgagcgcctcgcatcgcgcgtggtcgatctcgccattgtgacgacgcccccggaagacgaggcgggcgtggaacaggtcgcgctctggcgcgacgagctcgtggccgtggcgccttcctaccacgcgctcgcgggcaagcgcgcgaccatcgtcgagctggcccagtatccgttggtggtcatgcacggcgagtcgggactgcggcggcagatcgacgatcttctgcatcgcgctggggtggaacggcccgccccgccggtgatggaaacggacagcctcgaggcgatgaaccggttcgtgcaggcgggactcggcctggcggtcgtgccttggccggcggtggcggacgatgtgacccagggccgattgaaactcgtccatatcgtgggctgcgatctcggccagcgcaccgtgaccttggtctggcgcaaggaatcgcacatcccggcggctgcgcgcgcattcatcgagtggctcgcgtcggtgggagcggcgtcgtcgtccgaattgcggtaa

SEQ ID NO: 1482 - protein, 289 aa, Symbiobacterium thermophilum IAM 14863
LLQHLTTFCRVVEEGSFTRAAQVLNLTQPSVTKQVGALEDYLQVQLFTRQGKRVHLTPVGELVYDYARQVIHLVQRCEEAVREYRSPGSGSVTVGCVHTIGLFTLPELLAAYVREHPRVKINVKTGNNRETVTMLLHGEVDVGLVTTPQVHERIEVVPLFEDPLVVVAGPSFAADLPPVVSNADLAQLPFIGYVRGARFRMTTDQVLEEMGIQPQFVMEFDNHEAIKTMVALGFGIALEPVSAVQRELISGQLVRLNVPGLPRLSRTTSLILRRGERRSEAVRAFLSLL

SEQ ID NO: 1483 - protein, 288 aa, Moorella thermoacetica ATCC 39073
LITFITTVEKGTLSAAAEELHLTQPAVSKQLQALEDYFGLRLLERRGREVRLTAAGEICYRHARIIASHLNQTRRELAELTQLVRGRLLLGASTTPGQYILPRLIGAFRREYPRVEVILTIADTQEVVQRLQEGEIDLGVVGAAGGRGKNLSYSRLAGDELVLIVPPGHRLAGATAISPGELKEEPLVWRESGSGTRRVVEERLAAAGFTVDPEQIVMELGSTEAIVSAVEAGLGISLVTSWAVEKSVKLGRLAVVTLQGVDLKRDLYLVRRRQPLSPAAEAFVNFAA

SEQ ID NO: 1484 - protein, 296 aa, Acidobacteria bacterium Ellin345
FDQLLTFLEVAKLGNFSRAGEKVYRSQSAVSAQIRQLEQEYGERLFDRSGKIVRLSPAGEVLLEYAQRMVALRNESLRAVADQGETPRGVLSIGANEATCLYVLPDIFTEYCQQFPQVQITVYRNFSRKILQAVEDGVIDLGIATLPVKSPSLKVHPIFRDRLELMVPVRHPLAAKESVTIEEIAEYPQIFPKTGYTRQQLDKLFRPYNSKLRVAMEIPSVGLIKSFVVSGVGVTLLSSTFAQDEVRAGKAKMLPIAGVDMWRELGLIYRNDRTLPRSATAFIDLMRHRPVAKKSK

SEQ ID NO: 1485 - protein, 281 aa, Synechococcus sp. JA-2-3B'a(2-13)
IAQQGSFRRAADSLFVSQPAVSLQVQNLERQLGVVLFDRSGRKVELTDAGKVVLQYSERILKLCREAVEALADLQKMEGGHLVLGASQTVGTYVMPSLIAQYHRRYPQISVQLLVQSTRRIAQKLVDGQLDVAIVGGEIPFELQRHLKVMALAEDEYVLVGAPGCAIDSPALVDLLALPFITLDPQSSTRQTIDRVLNRHGINPAQLNVRLELSSIEAIKNAVQAGLGVAFLSTVAVGSDVEQGRFRKLAVEGLQIRRTLWLAFNPERYQSQAATRFLQGL

SEQ ID NO: 1486 - protein, 235 aa, Pseudomonas putida GB-1
EQLITFATVAEHGNISHAAQALHLSQPAVSGQLKLLQEAFGEPLYQRAGRGVRLTAAGEQLLAHAERLRETFRQAQALREAMRGLERGTLRIGASTTPASYLLPYLIADFHARHPEVLVTTSHGNTAEIVAALDSVDIALIEGPPGQELPLGTAVTAWREDEIVAIVPSGHPLAGSDQQALASLGAYPLVLRESGSGVRQIVERAFARDGVAMRVALEIAGVEGVKEAVRAGMGV

SEQ ID NO: 1487 - protein, 318 aa, Artificial
  Substituion in SEQ ID NO 1480
MICIIFMLNLYGVMDMFEALRALVTVVSLGSVSEAARALHVTQPTVTRQIQQLERHFGQALFDRSGKRLALTPAGERVHAYALEVLRKQEELAESLLEMSNPEAGLVRMGAGLSPTLYRLPAMVARYASMHPRVRFQVVTGSSKVTLERLASRVVDLAIVTTPPEDEAGVEQVALWRDELVAVAPSYHALAGKRATIVELAQYPLVVMHGESGLRRQIDDLLHRAGVERPAPPVMETDSLEAMNRFVQAGLGLAVVPWPAVADDVTQGRLKLVHIVGCDLGQRTVTLVWRKESHIPAAARAFIEWLASVGAASSSEIR

SEQ ID NO: 1488 - protein, 318 aa, Artificial
  Substituion in SEQ ID NO 1480
MICIIFMLNLYGVMDMFEALRALVTVVSLGSVSEAARALHVTQPTVTRQIQQLERHFGQALFDRSGKRLALTPAGERVHAYALEVLKKQEELAESLLEMSNPEAGLVRMGAGLSPTLYRLPAMVARYASMHPRVRFQVVTGSSKVTLERLASRVVDLAIVTTPPEDEAGVEQVALWRDELVAVAPSYHALAGKRATIVELAQYPLVVMHGESGLRRQIDDLLHRAGVERPAPPVMETDSLEAMNRFVQAGLGLAVVPWPAVADDVTQGRLKLVHIVGCDLGQRTVTLVWRKESHIPAAARAFIEWLASVGAASSSELR

SEQ ID NO: 1489 - protein, 318 aa, Artificial
  Substituion in SEQ ID NO 1480
MICIIFMLNLYGVMDMFEALRALVTVVSLGSVSEAARALHVTQPTVTRQIQQLERHFGQALFDRSGKRLALTPAGERVHAYALEVLRKQEELAESLLEMSNPEAGLVRMGAGISPTLYRLPAMVARYASMHPRVRFQVVTGSSKVTLERLASRVVDLAIVTTPPEDEAGVEQVALWRDELVAVAPSYHALAGKRATIVELAQYPLVVMHGESGLRRQIDDLLHRAGVERPAPPVMETDSLEAMNRFVQAGLGLAVVPWPAVADDVTQGRLKLVHIVGCDLGQRTVTLVWRKESHIPAAARAFIEWLASVGAASSSELR

SEQ ID NO: 1490 - protein, 318 aa, Artificial
  Substituion in SEQ ID NO 1480
MICIIFMLNLYGVMDMFEALRALVTVISLGSVSEAARALHVTQPTVTRQIQQLERHFGQALFDRSGKRLALTPAGERVHAYALEVLRKQEELAESLLEMSNPEAGLVRMGAGLSPTLYRLPAMVARYASMHPRVRFQVVTGSSKVTLERLASRVVDLAIVTTPPEDEAGVEQVALWRDELVAVAPSYHALAGKRATIVELAQYPLVVMHGESGLRRQIDDLLHRAGVERPAPPVMETDSLEAMNRFVQAGLGLAVVPWPAVADDVTQGRLKLVHIVGCDLGQRTVTLVWRKESHIPAAARAFIEWLASVGAASSSELR

SEQ ID NO: 1491 - protein, 318 aa, Artificial
  Substituion in SEQ ID NO 1480
MICIIFMLNLYGVMDMFEALRALVTVVSLGSVSEAARALHITQPTVTRQIQQLERHFGQALFDRSGKRLALTPAGERVHAYALEVLRKQEELAESLLEMSNPEAGLVRMGAGLSPTLYRLPAMVARYASMHPRVRFQVVTGSSKVTLERLASRVVDLAIVTTPPEDEAGVEQVALWRDELVAVAPSYHALAGKRATIVELAQYPLVVMHGESGLRRQIDDLLHRAGVERPAPPVMETDSLEAMNRFVQAGLGLAVVPWPAVADDVTQGRLKLVHIVGCDLGQRTVTLVWRKESHIPAAARAFIEWLASVGAASSSELR

SEQ ID NO: 1492 - DNA, 957 bp, Artificial
  Substituion in SEQ ID NO 1481
atgatatgtatcattttcatgctcaacttgtatggagtgatggacatgtttgaggccctgcgggcgttggtcaccgtggtctcgctcggaagcgtgtccgaggcggcccgagcgctccacgtgacgcaaccaaccgtgacgcgccagattcagcaactggagcgccacttcgggcaggcgctctttgaccggagcgggaaacggcttgcgctgacgcccgccggtgagcgcgtgcacgcgtacgcgcttgaagtgctgcgcaagcaggaggagttggcggagtcgctcctcgagatgtcgaatccggaggcgggcctggtgcgcatgggagcggggctctcccccacgctgtaccgcctgcctgcgatggtggctcgatacgcgtccatgcacccgcgcgtgaggttccaggtggtgacgggatcgtccaaagtgacgctcgagcgcctcgcatcgcgcgtggtcgatctcgccattgtgacgacgcccccggaagacgaggcgggcgtggaacaggtcgcgctctggcgcgacgagctcgtggccgtggcgccttcctaccacgcgctcgcgggcaagcgcgcgaccatcgtcgagctggcccagtatccgttggtggtcatgcacggcgagtcgggactgcggcggcagatcgacgatcttctgcatcgcgctggggtggaacggcccgccccgccggtgatggaaacggacagcctcgaggcgatgaaccggttcgtgcaggcgggactcggcctggcggtcgtgccttggccggcggtggcggacgatgtgacccagggccgattgaaactcgtccatatcgtgggctgcgatctcggccagcgcaccgtgaccttggtctggcgcaaggaatcgcacatcccggcggctgcgcgcgcattcatcgagtggctcgcgtcggtgggagcggcgtcgtcgtccgaaattcggtaa

SEQ ID NO: 1493 - DNA, 957 bp, Artificial
  Substituion in SEQ ID NO 1481
atgatatgtatcattttcatgctcaacttgtatggagtgatggacatgtttgaggccctgcgggcgttggtcaccgtggtctcgctcggaagcgtgtccgaggcggcccgagcgctccacgtgacgcaaccaaccgtgacgcgccagattcagcaactggagcgccacttcgggcaggcgctctttgaccggagcgggaaacggcttgcgctgacgcccgccggtgagcgcgtgcacgcgtacgcgcttgaagtgctgaaaaagcaggaggagttggcggagtcgctcctcgagatgtcgaatccggaggcgggcctggtgcgcatgggagcggggctctcccccacgctgtaccgcctgcctgcgatggtggctcgatacgcgtccatgcacccgcgcgtgaggttccaggtggtgacgggatcgtccaaagtgacgctcgagcgcctcgcatcgcgcgtggtcgatctcgccattgtgacgacgcccccggaagacgaggcgggcgtggaacaggtcgcgctctggcgcgacgagctcgtggccgtggcgccttcctaccacgcgctcgcgggcaagcgcgcgaccatcgtcgagctggcccagtatccgttggtggtcatgcacggcgagtcgggactgcggcggcagatcgacgatcttctgcatcgcgctggggtggaacggcccgccccgccggtgatggaaacggacagcctcgaggcgatgaaccggttcgtgcaggcgggactcggcctggcggtcgtgccttggccggcggtggcggacgatgtgacccagggccgattgaaactcgtccatatcgtgggctgcgatctcggccagcgcaccgtgaccttggtctggcgcaaggaatcgcacatcccggcggctgcgcgcgcattcatcgagtggctcgcgtcggtgggagcggcgtcgtcgtccgaattgcggtaa

SEQ ID NO: 1494 - DNA, 957 bp, Artificial
  Substituion in SEQ ID NO 1481
atgatatgtatcattttcatgctcaacttgtatggagtgatggacatgtttgaggccctgcgggcgttggtcaccgtggtctcgctcggaagcgtgtccgaggcggcccgagcgctccacgtgacgcaaccaaccgtgacgcgccagattcagcaactggagcgccacttcgggcaggcgctctttgaccggagcgggaaacggcttgcgctgacgcccgccggtgagcgcgtgcacgcgtacgcgcttgaagtgctgcgcaagcaggaggagttggcggagtcgctcctcgagatgtcgaatccggaggcgggcctggtgcgcatgggagcggggatttcccccacgctgtaccgcctgcctgcgatggtggctcgatacgcgtccatgcacccgcgcgtgaggttccaggtggtgacgggatcgtccaaagtgacgctcgagcgcctcgcatcgcgcgtggtcgatctcgccattgtgacgacgcccccggaagacgaggcgggcgtggaacaggtcgcgctctggcgcgacgagctcgtggccgtggcgccttcctaccacgcgctcgcgggcaagcgcgcgaccatcgtcgagctggcccagtatccgttggtggtcatgcacggcgagtcgggactgcggcggcagatcgacgatcttctgcatcgcgctggggtggaacggcccgccccgccggtgatggaaacggacagcctcgaggcgatgaaccggttcgtgcaggcgggactcggcctggcggtcgtgccttggccggcggtggcggacgatgtgacccagggccgattgaaactcgtccatatcgtgggctgcgatctcggccagcgcaccgtgaccttggtctggcgcaaggaatcgcacatcccggcggctgcgcgcgcattcatcgagtggctcgcgtcggtgggagcggcgtcgtcgtccgaattgcggtaa

SEQ ID NO: 1495 - DNA, 957 bp, Artificial
  Substituion in SEQ ID NO 1481
atgatatgtatcattttcatgctcaacttgtatggagtgatggacatgtttgaggccctgcgggcgttggtcaccgtgatttcgctcggaagcgtgtccgaggcggcccgagcgctccacgtgacgcaaccaaccgtgacgcgccagattcagcaactggagcgccacttcgggcaggcgctctttgaccggagcgggaaacggcttgcgctgacgcccgccggtgagcgcgtgcacgcgtacgcgcttgaagtgctgcgcaagcaggaggagttggcggagtcgctcctcgagatgtcgaatccggaggcgggcctggtgcgcatgggagcggggctctcccccacgctgtaccgcctgcctgcgatggtggctcgatacgcgtccatgcacccgcgcgtgaggttccaggtggtgacgggatcgtccaaagtgacgctcgagcgcctcgcatcgcgcgtggtcgatctcgccattgtgacgacgcccccggaagacgaggcgggcgtggaacaggtcgcgctctggcgcgacgagctcgtggccgtggcgccttcctaccacgcgctcgcgggcaagcgcgcgaccatcgtcgagctggcccagtatccgttggtggtcatgcacggcgagtcgggactgcggcggcagatcgacgatcttctgcatcgcgctggggtggaacggcccgccccgccggtgatggaaacggacagcctcgaggcgatgaaccggttcgtgcaggcgggactcggcctggcggtcgtgccttggccggcggtggcggacgatgtgacccagggccgattgaaactcgtccatatcgtgggctgcgatctcggccagcgcaccgtgaccttggtctggcgcaaggaatcgcacatcccggcggctgcgcgcgcattcatcgagtggctcgcgtcggtgggagcggcgtcgtcgtccgaattgcggtaa

SEQ ID NO: 1496 - DNA, 957 bp, Artificial
  Substituion in SEQ ID NO 1481
atgatatgtatcattttcatgctcaacttgtatggagtgatggacatgtttgaggccctgcgggcgttggtcaccgtggtctcgctcggaagcgtgtccgaggcggcccgagcgctccacattacgcaaccaaccgtgacgcgccagattcagcaactggagcgccacttcgggcaggcgctctttgaccggagcgggaaacggcttgcgctgacgcccgccggtgagcgcgtgcacgcgtacgcgcttgaagtgctgcgcaagcaggaggagttggcggagtcgctcctcgagatgtcgaatccggaggcgggcctggtgcgcatgggagcggggctctcccccacgctgtaccgcctgcctgcgatggtggctcgatacgcgtccatgcacccgcgcgtgaggttccaggtggtgacgggatcgtccaaagtgacgctcgagcgcctcgcatcgcgcgtggtcgatctcgccattgtgacgacgcccccggaagacgaggcgggcgtggaacaggtcgcgctctggcgcgacgagctcgtggccgtggcgccttcctaccacgcgctcgcgggcaagcgcgcgaccatcgtcgagctggcccagtatccgttggtggtcatgcacggcgagtcgggactgcggcggcagatcgacgatcttctgcatcgcgctggggtggaacggcccgccccgccggtgatggaaacggacagcctcgaggcgatgaaccggttcgtgcaggcgggactcggcctggcggtcgtgccttggccggcggtggcggacgatgtgacccagggccgattgaaactcgtccatatcgtgggctgcgatctcggccagcgcaccgtgaccttggtctggcgcaaggaatcgcacatcccggcggctgcgcgcgcattcatcgagtggctcgcgtcggtgggagcggcgtcgtcgtccgaattgcggtaa

SEQ ID NO: 1497 - protein, 364 aa, Alicyclobacillus acidocaldarius
MTMRRSGMEWTVWAAVERVAPELVRAMEHRVRVMQRIDAHAPIGRRALAQAMGQSERTLRTELDYLKQLGLVATSSSGVSLTPEGKALLGELEPLVAEIAGRSDLAWRVSALLRIPRVIVVEGDADEDAWVTDRIGQAGSDVLAEVLQDGDIIAVTGGTTVAAVAKAMSAKPLRQRITVVPARGTVGEIVAYQANTIASELAAKLGGSSVLLQISDSLSQKALEQLLDDPYIQERLPIIRQATVVVHGVGDALAMARRRHATEEEIKLLEAREAKAEAFGHYFNARGEVVYAMRTIGLRLDDVARARVVIAVAGGQKKAQAIASVANAYRIDVLVTDEGAARRILQLETPAGKERVEHGSEGWY

SEQ ID NO: 1498 - DNA, 1095 bp, Alicyclobacillus acidocaldarius
gtgacgatgaggagaagtggcatggagtggacggtgtgggccgcggttgaacgggtcgcgcctgagttggtgagagccatggaacaccgcgtgcgggtgatgcaacgcattgacgcgcacgcgcccatcggccggcgagctctcgcgcaagccatgggccagtcggagcgcacgcttcgcaccgaactggactatctcaagcaactcgggctcgtcgcgacgtcctcgtccggcgtgtcgctgacgccggaaggcaaagcgcttttgggtgagctcgagccgctcgtcgcggaaatcgcggggcgctccgatttggcctggcgcgtctctgcgcttcttcgcattccccgcgtcatcgtggtggaaggcgatgcggacgaggacgcctgggtgacggatcgcatcggccaggctggcagcgatgtgctcgccgaggtgctccaggacggggacatcatcgcggtgacgggcggcaccacggtcgcagctgtggcgaaggccatgagcgcaaagcctcttcggcagcggatcacggtggttcccgccaggggcacggtcggcgagatcgtcgcttaccaggcgaacaccattgcgtccgagctcgcggcgaaactcggcggatcgtccgtcctcctgcagatctccgacagcctgtcgcagaaggcgctcgagcagcttctggacgatccgtacattcaggagcggctgcccatcattcgccaggcgaccgtcgtggtgcacggcgtgggggatgccctggcgatggcccggcgtcgccacgcgaccgaggaagagatcaaactgctcgaggcgcgcgaagcgaaggccgaggccttcgggcattacttcaatgcgcggggcgaggtcgtctacgccatgcggaccattgggcttcggctcgatgacgtcgcgcgggcgagggtcgtgatcgcggtggctggcggacagaaaaaagcgcaggccatcgccagtgtggcaaacgcctatcgaatcgacgtgttggtgacggatgaaggcgcagcgcgccgcatcttgcagctcgaaactccagcaggcaaggagagggtcgaacatggcagtgaaggttggtattaa

SEQ ID NO: 1499 - protein, 331 aa, Geobacillus thermodenitrificans NG80-2
AQKKLLPDLLEVMQKRYQILHSISLMAPIGRRALAASLGMSERVLRSETEFLKGQNLLSTDVSGMRLTEEGQALLHTLNDLMREALGLKELETALKQRLNVARVVVVAGDSDRSPWVKKELGRACVACMKEQLRPGDIVAVAGGTTMAAVAEMMTPDPKLADVLFVPARGGLGEDVENQANTICAKMAEKATGRYRLLHVPDQLSGEAYASLIEEPAVKEVLELIQSCRMVVHGIGEAVTMAKRRKTPPVEMEKIIARHAVAEAFGYYFNEHGDVVHKVKTVGIQLENLPHVEHVIAVAGGASKAKAIQAYIKRAPHSLLVTDEGAAKALV

SEQ ID NO: 1500 - protein, 328 aa, Geobacillus kaustophilus HTA426
AQKKLLPDLLDVMQKRYQILHSISLMAPIGRRALAASLGMSERVLRSETEFLKGQNLLSADVSGMRLTEEGQALLHTLNDLMREALGLKELEAALQEQLGIPRVIVVAGDSDRSPWVKKEMGRACVACMKELLEPGDIVAVAGGTTMAAVAEMMTPDSKLRDVLFVPARGGLGEDVENQANTICAKMAEKAMGRYRLLHVPDQLSDEAYASLVEEPAVKEVLELIQSCRMVVHGIGEAVTMAKRRKTPPVEMENIIARHAVAEAFGYYFNEYGDVVHKVKTVGIQLEHLPHVEHVIAVAGGASKAKAIRAYMKRAPHSLLVTDEGAAK

SEQ ID NO: 1501 - protein, 331 aa, Bacillus coagulans 36D1
KKLYPDILAVMQKRYRILRSISFAEPVGRRTLAQMLGMSERVLRSETDFLKNQKLIDVKPSGMSVTNDGAALLQNMESMMREISGINETEEKLKQALGLEDVVVVQGDSDKEPWVKNELGRACAVRMKAALTGNNIIAVTGGSTMAAVADVLTPDISAKRQLLFVPARGGIGEDVANQANTICAKMAERTGGKHRVLYVPDQVSPEVYKSVVNEPSIKEVLTLIKQADIVLHGIGEAMTMAERRKTGKEEMEKIIRGHAVGEAFGYYFNEQGEIVHKVRTIGLQLEDLHRIRHVFAVAGGASKAKAIKAYMNTKPESTVLITDEGAAKQIL

SEQ ID NO: 1502 - protein, 327 aa, Bacillus clausii KSM-K16
QIVPELMETMAKRYRLLQYIRLMQPIGRRSLATNLQTSERIVRGEVTLLKDQGLIELTTAGMRLTEAGEALFLELADMMAELLGHRRLEEKLKEKLGVSQAIVVAGDSDEEEWVKQELGRACVDELKRVAKKGDVFAVMGGTTLAAVANMVTPDETLATTTFVPARGGLGEKVEIQANTISAEFARRSGASYRLLHVPDQLSEEAYHSLVLERSVREILDVITSSAVVMHGIGDARRMAARRDSGQPFIETLKREEAVAEAFGYYFNANGEIIHKQRTIGLQLGELEGKYVISIAGGHTKANAILAYMKNRPSDVLVTDEGAARRLL

SEQ ID NO: 1503 - protein, 331 aa, Bacillus sp. NRRL B-14911
KRLLPDLLTVMQKRYQILQYIGFMQPVGRRSLAVSLGSTERVLRSEVDFLKNQNLISVASSGMNLTAEGKDLLERLESIMRDITGIDILEARLKEVLGVRQVIVVAGNSDESPWVKSELGRACAASMKQRLKGKNTVAVTGGSTMAAVAEMLTPNLFDDELLFVPARGGIGEEVKNQANTICAMMAEHTASRHKFLHVPDQVSKTMYETIMKEPVINEVLNLIQSAGMVLHGIGDAITMAERRKTTPEDLLKIQERKAVGEAFGYYFDEAGEVVHKVQTIGLQLKDLADIEHVIAVAGGSSKAKAIRAYMKQAPSSTILITDEGAAKQLLK

SEQ ID NO: 1504 - protein, 364 aa, Artificial
  Substituion in SEQ ID NO 1497
MTMRRSGMEWTVWAAVERVAPELVRAMEHRVRVMQRIDAHAPIGRRALAQAMGQSERTLRTELDYLKQLGLVATSSSGVSLTPEGKALLGELEPLVAEIAGRSDLAWKVSALLRIPRVIVVEGDADEDAWVTDRIGQAGSDVLAEVLQDGDIIAVTGGTTVAAVAKAMSAKPLRQRITVVPARGTVGEIVAYQANTIASELAAKLGGSSVLLQISDSLSQKALEQLLDDPYIQERLPIIRQATVVVHGVGDALAMARRRHATEEEIKLLEAREAKAEAFGHYFNARGEVVYAMRTIGLRLDDVARARVVIAVAGGQKKAQAIASVANAYRIDVLVTDEGAARRILQLETPAGKERVEHGSEGWY

SEQ ID NO: 1505 - protein, 364 aa, Artificial
  Substituion in SEQ ID NO 1497
MTMRRSGMEWTVWAAVERVAPELVRAMEHRVRVMQRIDAHAPIGRRALAQAMGQSERTLRTELDYLKQLGLVATSSSGVSLTPEGKALLGELEPLVAEIAGRSDLAWRVSALLRIPRVIVVEGDADEDAWVTDRIGQAGSDVLAEVLQDGDIIAVTGGTTVAAVAKAMSAKPLRQRITVVPARGTVGEIVAYQANTIASELAAKLGGSSVLLQISDSLSQKALEQLLDDPYIQERLPIIRQATVVVHGVGDALAMARRRHATEEEIKLLEAREAKAEAFGHYFNARGEVVYAMRTIGLRLDDVARARVVIAVAGGQKKAQAIASVANAYRIDVLVTDEGAARRILQLETPAGKERVEHGSDGWY

SEQ ID NO: 1506 - protein, 364 aa, Artificial
  Substituion in SEQ ID NO 1497
MTMRRSGMEWTVWAAVERVAPELVRAMEHRVRVMQRIDAHAPIGRRALAQAMGQSERTLRTELDYLKQLGLVATSSSGVSLTPEGKALLGELEPLVAEIAGRSDLAWRVSALLRIPRVIVVEGDADEDAWVTDRIGQAGSDVLAEVLQDGDIIAVTGGTTVAAVAKAMSAKPLRQRITVVPARGTVGEIVAYQANTIASELAAKIGGSSVLLQISDSLSQKALEQLLDDPYIQERLPIIRQATVVVHGVGDALAMARRRHATEEEIKLLEAREAKAEAFGHYFNARGEVVYAMRTIGLRLDDVARARVVIAVAGGQKKAQAIASVANAYRIDVLVTDEGAARRILQLETPAGKERVEHGSEGWY

SEQ ID NO: 1507 - protein, 364 aa, Artificial
  Substituion in SEQ ID NO 1497
MTMRRSGMEWTVWAAVERVAPELVRAMDHRVRVMQRIDAHAPIGRRALAQAMGQSERTLRTELDYLKQLGLVATSSSGVSLTPEGKALLGELEPLVAEIAGRSDLAWRVSALLRIPRVIVVEGDADEDAWVTDRIGQAGSDVLAEVLQDGDIIAVTGGTTVAAVAKAMSAKPLRQRITVVPARGTVGEIVAYQANTIASELAAKLGGSSVLLQISDSLSQKALEQLLDDPYIQERLPIIRQATVVVHGVGDALAMARRRHATEEEIKLLEAREAKAEAFGHYFNARGEVVYAMRTIGLRLDDVARARVVIAVAGGQKKAQAIASVANAYRIDVLVTDEGAARRILQLETPAGKERVEHGSEGWY

SEQ ID NO: 1508 - protein, 364 aa, Artificial
  Substituion in SEQ ID NO 1497
MTMRRSGMEWTVWAAVERVAPELVRAMEHRVRVMQRIDAHAPIGRRALAQAMGQSERTLRTELDYLKQLGLVATSSSGVSLTPEGKALLGELEPLVAEIAGRSDLAWRVSALLRIPRVIVVEGDADEDAWVTDRIGQAGSDVLAEVLQDGDLIAVTGGTTVAAVAKAMSAKPLRQRITVVPARGTVGEIVAYQANTIASELAAKLGGSSVLLQISDSLSQKALEQLLDDPYIQERLPIIRQATVVVHGVGDALAMARRRHATEEEIKLLEAREAKAEAFGHYFNARGEVVYAMRTIGLRLDDVARARVVIAVAGGQKKAQAIASVANAYRIDVLVTDEGAARRILQLETPAGKERVEHGSEGWY

SEQ ID NO: 1509 - DNA, 1095 bp, Artificial
  Substituion in SEQ ID NO 1498
gtgacgatgaggagaagtggcatggagtggacggtgtgggccgcggttgaacgggtcgcgcctgagttggtgagagccatggaacaccgcgtgcgggtgatgcaacgcattgacgcgcacgcgcccatcggccggcgagctctcgcgcaagccatgggccagtcggagcgcacgcttcgcaccgaactggactatctcaagcaactcgggctcgtcgcgacgtcctcgtccggcgtgtcgctgacgccggaaggcaaagcgcttttgggtgagctcgagccgctcgtcgcggaaatcgcggggcgctccgatttggcctggaaagtctctgcgcttcttcgcattccccgcgtcatcgtggtggaaggcgatgcggacgaggacgcctgggtgacggatcgcatcggccaggctggcagcgatgtgctcgccgaggtgctccaggacggggacatcatcgcggtgacgggcggcaccacggtcgcagctgtggcgaaggccatgagcgcaaagcctcttcggcagcggatcacggtggttcccgccaggggcacggtcggcgagatcgtcgcttaccaggcgaacaccattgcgtccgagctcgcggcgaaactcggcggatcgtccgtcctcctgcagatctccgacagcctgtcgcagaaggcgctcgagcagcttctggacgatccgtacattcaggagcggctgcccatcattcgccaggcgaccgtcgtggtgcacggcgtgggggatgccctggcgatggcccggcgtcgccacgcgaccgaggaagagatcaaactgctcgaggcgcgcgaagcgaaggccgaggccttcgggcattacttcaatgcgcggggcgaggtcgtctacgccatgcggaccattgggcttcggctcgatgacgtcgcgcgggcgagggtcgtgatcgcggtggctggcggacagaaaaaagcgcaggccatcgccagtgtggcaaacgcctatcgaatcgacgtgttggtgacggatgaaggcgcagcgcgccgcatcttgcagctcgaaactccagcaggcaaggagagggtcgaacatggcagtgaaggttggtattaa

SEQ ID NO: 1510 - DNA, 1095 bp, Artificial
  Substituion in SEQ ID NO 1498
gtgacgatgaggagaagtggcatggagtggacggtgtgggccgcggttgaacgggtcgcgcctgagttggtgagagccatggaacaccgcgtgcgggtgatgcaacgcattgacgcgcacgcgcccatcggccggcgagctctcgcgcaagccatgggccagtcggagcgcacgcttcgcaccgaactggactatctcaagcaactcgggctcgtcgcgacgtcctcgtccggcgtgtcgctgacgccggaaggcaaagcgcttttgggtgagctcgagccgctcgtcgcggaaatcgcggggcgctccgatttggcctggcgcgtctctgcgcttcttcgcattccccgcgtcatcgtggtggaaggcgatgcggacgaggacgcctgggtgacggatcgcatcggccaggctggcagcgatgtgctcgccgaggtgctccaggacggggacatcatcgcggtgacgggcggcaccacggtcgcagctgtggcgaaggccatgagcgcaaagcctcttcggcagcggatcacggtggttcccgccaggggcacggtcggcgagatcgtcgcttaccaggcgaacaccattgcgtccgagctcgcggcgaaactcggcggatcgtccgtcctcctgcagatctccgacagcctgtcgcagaaggcgctcgagcagcttctggacgatccgtacattcaggagcggctgcccatcattcgccaggcgaccgtcgtggtgcacggcgtgggggatgccctggcgatggcccggcgtcgccacgcgaccgaggaagagatcaaactgctcgaggcgcgcgaagcgaaggccgaggccttcgggcattacttcaatgcgcggggcgaggtcgtctacgccatgcggaccattgggcttcggctcgatgacgtcgcgcgggcgagggtcgtgatcgcggtggctggcggacagaaaaaagcgcaggccatcgccagtgtggcaaacgcctatcgaatcgacgtgttggtgacggatgaaggcgcagcgcgccgcatcttgcagctcgaaactccagcaggcaaggagagggtcgaacatggcagtgatggttggtattaa

SEQ ID NO: 1511 - DNA, 1095 bp, Artificial
  Substituion in SEQ ID NO 1498
gtgacgatgaggagaagtggcatggagtggacggtgtgggccgcggttgaacgggtcgcgcctgagttggtgagagccatggaacaccgcgtgcgggtgatgcaacgcattgacgcgcacgcgcccatcggccggcgagctctcgcgcaagccatgggccagtcggagcgcacgcttcgcaccgaactggactatctcaagcaactcgggctcgtcgcgacgtcctcgtccggcgtgtcgctgacgccggaaggcaaagcgcttttgggtgagctcgagccgctcgtcgcggaaatcgcggggcgctccgatttggcctggcgcgtctctgcgcttcttcgcattccccgcgtcatcgtggtggaaggcgatgcggacgaggacgcctgggtgacggatcgcatcggccaggctggcagcgatgtgctcgccgaggtgctccaggacggggacatcatcgcggtgacgggcggcaccacggtcgcagctgtggcgaaggccatgagcgcaaagcctcttcggcagcggatcacggtggttcccgccaggggcacggtcggcgagatcgtcgcttaccaggcgaacaccattgcgtccgagctcgcggcgaaaattggcggatcgtccgtcctcctgcagatctccgacagcctgtcgcagaaggcgctcgagcagcttctggacgatccgtacattcaggagcggctgcccatcattcgccaggcgaccgtcgtggtgcacggcgtgggggatgccctggcgatggcccggcgtcgccacgcgaccgaggaagagatcaaactgctcgaggcgcgcgaagcgaaggccgaggccttcgggcattacttcaatgcgcggggcgaggtcgtctacgccatgcggaccattgggcttcggctcgatgacgtcgcgcgggcgagggtcgtgatcgcggtggctggcggacagaaaaaagcgcaggccatcgccagtgtggcaaacgcctatcgaatcgacgtgttggtgacggatgaaggcgcagcgcgccgcatcttgcagctcgaaactccagcaggcaaggagagggtcgaacatggcagtgaaggttggtattaa

SEQ ID NO: 1512 - DNA, 1095 bp, Artificial
  Substituion in SEQ ID NO 1498
gtgacgatgaggagaagtggcatggagtggacggtgtgggccgcggttgaacgggtcgcgcctgagttggtgagagccatggatcaccgcgtgcgggtgatgcaacgcattgacgcgcacgcgcccatcggccggcgagctctcgcgcaagccatgggccagtcggagcgcacgcttcgcaccgaactggactatctcaagcaactcgggctcgtcgcgacgtcctcgtccggcgtgtcgctgacgccggaaggcaaagcgcttttgggtgagctcgagccgctcgtcgcggaaatcgcggggcgctccgatttggcctggcgcgtctctgcgcttcttcgcattccccgcgtcatcgtggtggaaggcgatgcggacgaggacgcctgggtgacggatcgcatcggccaggctggcagcgatgtgctcgccgaggtgctccaggacggggacatcatcgcggtgacgggcggcaccacggtcgcagctgtggcgaaggccatgagcgcaaagcctcttcggcagcggatcacggtggttcccgccaggggcacggtcggcgagatcgtcgcttaccaggcgaacaccattgcgtccgagctcgcggcgaaactcggcggatcgtccgtcctcctgcagatctccgacagcctgtcgcagaaggcgctcgagcagcttctggacgatccgtacattcaggagcggctgcccatcattcgccaggcgaccgtcgtggtgcacggcgtgggggatgccctggcgatggcccggcgtcgccacgcgaccgaggaagagatcaaactgctcgaggcgcgcgaagcgaaggccgaggccttcgggcattacttcaatgcgcggggcgaggtcgtctacgccatgcggaccattgggcttcggctcgatgacgtcgcgcgggcgagggtcgtgatcgcggtggctggcggacagaaaaaagcgcaggccatcgccagtgtggcaaacgcctatcgaatcgacgtgttggtgacggatgaaggcgcagcgcgccgcatcttgcagctcgaaactccagcaggcaaggagagggtcgaacatggcagtgaaggttggtattaa

SEQ ID NO: 1513 - DNA, 1095 bp, Artificial
  Substituion in SEQ ID NO 1498
gtgacgatgaggagaagtggcatggagtggacggtgtgggccgcggttgaacgggtcgcgcctgagttggtgagagccatggaacaccgcgtgcgggtgatgcaacgcattgacgcgcacgcgcccatcggccggcgagctctcgcgcaagccatgggccagtcggagcgcacgcttcgcaccgaactggactatctcaagcaactcgggctcgtcgcgacgtcctcgtccggcgtgtcgctgacgccggaaggcaaagcgcttttgggtgagctcgagccgctcgtcgcggaaatcgcggggcgctccgatttggcctggcgcgtctctgcgcttcttcgcattccccgcgtcatcgtggtggaaggcgatgcggacgaggacgcctgggtgacggatcgcatcggccaggctggcagcgatgtgctcgccgaggtgctccaggacggggacttaatcgcggtgacgggcggcaccacggtcgcagctgtggcgaaggccatgagcgcaaagcctcttcggcagcggatcacggtggttcccgccaggggcacggtcggcgagatcgtcgcttaccaggcgaacaccattgcgtccgagctcgcggcgaaactcggcggatcgtccgtcctcctgcagatctccgacagcctgtcgcagaaggcgctcgagcagcttctggacgatccgtacattcaggagcggctgcccatcattcgccaggcgaccgtcgtggtgcacggcgtgggggatgccctggcgatggcccggcgtcgccacgcgaccgaggaagagatcaaactgctcgaggcgcgcgaagcgaaggccgaggccttcgggcattacttcaatgcgcggggcgaggtcgtctacgccatgcggaccattgggcttcggctcgatgacgtcgcgcgggcgagggtcgtgatcgcggtggctggcggacagaaaaaagcgcaggccatcgccagtgtggcaaacgcctatcgaatcgacgtgttggtgacggatgaaggcgcagcgcgccgcatcttgcagctcgaaactccagcaggcaaggagagggtcgaacatggcagtgaaggttggtattaa

SEQ ID NO: 1514 - protein, 334 aa, Alicyclobacillus acidocaldarius
MVTIRDVARKAGVSVSTVSRVINGSGYVGEDTERKVLLAMKELNYQPNRIARGLVSRRTSTIGLLIPDVANPFFSEMARGVEDAAIAEGYSVLLCNSDWKSERELMYIDLLKGRWVDGIVIVGSRSDSRVIEAAVGDTPLVIVDRRSSEFRWSVWTDNRQGAALVVEHLLKMGCSKIVHIAGPSDSPSAQERRKGYEQAISQAGLVAIVYEGDFRFASGFEIATMILEGSQRPDGIFAANDLMAIGVLQAAVKLGVQVPHEVAIVGYDNIPSAGYVSPSLTTVHQPSYQMGVSAFDLLLEQFVTNSGQSARKVKFEPKLVVRDSSLKCPSRNSV

SEQ ID NO: 1515 - DNA, 1005 bp, Alicyclobacillus acidocaldarius
ttggtcacgattcgagatgtggctcgcaaagcaggagtttctgtttctacggtttctagagtcatcaatggaagtggttacgtaggggaagatacagagcgtaaggtacttcttgctatgaaggagctcaactaccaacccaatcgaattgcgcgcggactagtcagtcgtcggacgtcgacgattggcttgctcatcccggatgtcgcaaaccccttcttttcggagatggcacgaggtgtcgaagacgccgcaattgccgaggggtattcggttcttctatgtaactcggattggaaatctgaacgcgaactgatgtacatcgatcttcttaagggacgatgggttgacggaatcgtcatcgtgggaagccgaagtgacagtcgggtgattgaagctgctgttggcgatacaccgctggtcattgtggatcgtcgttcatctgaatttaggtggtcagtgtggacggacaatcgtcagggtgctgcactggtagttgagcacttattgaagatgggatgctcaaagatcgtccatatcgccggaccgagtgattctccgtcggctcaggaaagacggaagggatatgaacaggccatatctcaagctgggcttgtagcgatagtgtacgaaggagattttcgcttcgcttcagggtttgaaattgcaacgatgatactcgagggctcccaacgacctgatgggatttttgcagccaatgatttaatggcaataggcgttttgcaagccgcagtaaagcttggagttcaggttcctcatgaagtggcgattgtaggttatgacaatattccgtctgcggggtatgtgagtccttcacttacgaccgttcatcagccttcatatcagatgggcgtgtcagccttcgatttgctgcttgagcagtttgtcaccaactcaggtcagagtgctcgcaaggttaagttcgaaccgaagcttgttgtccgggactctagtttgaagtgtccatcgagaaatagcgtttga

SEQ ID NO: 1516 - protein, 323 aa, Geobacillus kaustophilus HTA426
MATIRDVAKRAGVSVATVSRVLNQNGYVNEETERRVRQAMKELNYKPNEVARALFKKTSKTVGLIVPDITNPFFPELVRAVEDVMNIYDYTVILCNSDEKVEKEREYIEVLKQKYVDGVILTTNQFAPEEVEEWDVPIVVLDRPLHERYPSVVADNYEGARLATRHLYEVGCRRIAHIQGPNHVVNAMERFRGYQDEMRALGLGDRQLVIQGNYQLKQAKEAVMAALAEHDMDGIFAGNDAMAVGALKAVQQCGLRVPDDIAIIGYDGIPLTEMTTPELSTVSQPIYEMGAMAARILIKQIEGKPLEKLHYQLPVQLVVRQST

SEQ ID NO: 1517 - protein, 323 aa, Geobacillus thermodenitrificans NG80-2
MATIRDVAKRAGVSVATVSRVLNQNGYVNEETEKRVRRAMKELNYKPSEVARALFKKTSKTVGLIVPDITNPFFPELVRAVEDVMNIYDYTVILCNSDEKAEKEREYIEVLKQKYVDGVILTTNQLTPDEVDEWDVPIVVLDRPFNEKYPSVVVDNYRGARLATRHLYDMGCRRIAHIQGPMYVVNAVERFRGYQDEMMELGIWEQRLVIQGNYQLKQAKEAVMAALAQQEIDGIFAGNDAMAVGALKAVQQCGLRVPDDIAIIGYDGIPLTEMTTPELSTVSQPIYDMGAIAARILIKQIEGKPLEKLHYQLPVQLIVRQST

SEQ ID NO: 1518 - protein, 329 aa, Symbiobacterium thermophilum IAM 14863
MTIRDVARRAGVGVATVSRVLNGTGYVKAETRERVLAAAAELGYVPSQLARGLVRRLSGTVGLVVPDITNPFFPLITRGVEDAASEAGYTVFLCNTDNDPVLEAQDVRKLREHRVDGIIFVGTTERRELVDQLLADDIPVVVMDRQLEHADVDTVTVDNVAGAQAACRHLIELGHRRIAHAAGHQSTRTGQDRCQGYRMALEEADIPYDPACVTWGDFTFESGFRVGQVLLGLSPRPTAVFAGNDLIALGVIRAAEEAGLSVPDDLSVVGFDNIQMAALVRPGLTTVRQPAREMGRLAMTMLLERIRGEFSGPGRRHVYPPELIVRGTT

SEQ ID NO: 1519 - protein, 330 aa, Thermoanaerobacter sp. X514
VTIKDIAKLANVSITTVSRVINNKSEGVSEETRNRILQLVKELGYQPNAIARGLVTKKTKTIGLIIPDISNPFFPDIARGVEDSAHIYGYNVFLCNTDDNLEKESEYINALKEKYVDGIIFTSSSIPKHEHIMELVKSGIPIVIMDRRVDSEDIYGVFLDNYEGGYIATKHLIDLGHKKIACITGPLYTKSAKERLEGYKKALVENGMDVDERLIFEGDYKINSGIIGTEKLLGNNENVTAIFACNDLMAYGAYKTIRSYGYKIPDDISIVGFDDIQLSQILEPQLTTIKQPAYDMGLAAARMLIKLVEGKKLKKKIINFRPQLIIRQST

SEQ ID NO: 1520 - protein, 330 aa, Thermoanaerobacter tengcongensis MB4
VTIKDIARLANVSVTTVSRVINNKPEGVSEETRQKILKLVKELGYQPNAIARGLVTKKTKTIGLIIPDISNPFFPDIARGVEDSAHIYGYNVFLCNTDDNLEKESEYIRALKEKYVDGIIFTSSSIPKHEHIIELVESGIPVVIMDRRVDSENIYGVFLDNYEGGYIATKHLIDLGHEKIGCITGPLYTKSAKERLEGYKKALLDSGIKIDEKLIFEGDYKINGGIIGAERLLKDNKDMSAIFACNDLMAYGAYKTIRSFGYKIPDDISVVGFDDIQLSQILEPQLSTIKQPAYDMGLTAARMLIKLIEGKKLKKKIINFRPQLVIRQST

SEQ ID NO: 1521 - protein, 334 aa, Artificial
  Substituion in SEQ ID NO 1514
MVTIRDVARKAGVSVSTVSRVINGSGYVGEDTERKVLLAMKELNYQPNRIARGLVSRRTSTIGLLIPDVANPFFSEMARGVEDAAIAEGYSVLLCNSDWKSERELMYIDILKGRWVDGIVIVGSRSDSRVIEAAVGDTPLVIVDRRSSEFRWSVWTDNRQGAALVVEHLLKMGCSKIVHIAGPSDSPSAQERRKGYEQAISQAGLVAIVYEGDFRFASGFEIATMILEGSQRPDGIFAANDLMAIGVLQAAVKLGVQVPHEVAIVGYDNIPSAGYVSPSLTTVHQPSYQMGVSAFDLLLEQFVTNSGQSARKVKFEPKLVVRDSSLKCPSRNSV

SEQ ID NO: 1522 - protein, 334 aa, Artificial
  Substituion in SEQ ID NO 1514
MVTIRDVARKAGVSVSTVSRVINGSGYVGEDTERRVLLAMKELNYQPNRIARGLVSRRTSTIGLLIPDVANPFFSEMARGVEDAAIAEGYSVLLCNSDWKSERELMYIDLLKGRWVDGIVIVGSRSDSRVIEAAVGDTPLVIVDRRSSEFRWSVWTDNRQGAALVVEHLLKMGCSKIVHIAGPSDSPSAQERRKGYEQAISQAGLVAIVYEGDFRFASGFEIATMILEGSQRPDGIFAANDLMAIGVLQAAVKLGVQVPHEVAIVGYDNIPSAGYVSPSLTTVHQPSYQMGVSAFDLLLEQFVTNSGQSARKVKFEPKLVVRDSSLKCPSRNSV

SEQ ID NO: 1523 - protein, 334 aa, Artificial
  Substituion in SEQ ID NO 1514
MVTIRDVARRAGVSVSTVSRVINGSGYVGEDTERKVLLAMKELNYQPNRIARGLVSRRTSTIGLLIPDVANPFFSEMARGVEDAAIAEGYSVLLCNSDWKSERELMYIDLLKGRWVDGIVIVGSRSDSRVIEAAVGDTPLVIVDRRSSEFRWSVWTDNRQGAALVVEHLLKMGCSKIVHIAGPSDSPSAQERRKGYEQAISQAGLVAIVYEGDFRFASGFEIATMILEGSQRPDGIFAANDLMAIGVLQAAVKLGVQVPHEVAIVGYDNIPSAGYVSPSLTTVHQPSYQMGVSAFDLLLEQFVTNSGQSARKVKFEPKLVVRDSSLKCPSRNSV

SEQ ID NO: 1524 - protein, 334 aa, Artificial
  Substituion in SEQ ID NO 1514
MVTIRDVARKAGVSVSTVSRVINGSGYVGEDTERKVLLAMKELNYQPNRIARGLVSRRTSTIGLLIPDVANPFFSEMARGVEDAAIAEGYSVLLCNSDWKSERELMYIDLLKGRWVDGIVIVGSRSDSRVIEAAVGDTPLVIVDRRSSEFRWSVWTDNRQGAALVVDHLLKMGCSKIVHIAGPSDSPSAQERRKGYEQAISQAGLVAIVYEGDFRFASGFEIATMILEGSQRPDGIFAANDLMAIGVLQAAVKLGVQVPHEVAIVGYDNIPSAGYVSPSLTTVHQPSYQMGVSAFDLLLEQFVTNSGQSARKVKFEPKLVVRDSSLKCPSRNSV

SEQ ID NO: 1525 - protein, 334 aa, Artificial
  Substituion in SEQ ID NO 1514
MVTIRDVARKAGVSVSTVSRVINGSGYVGEDTERKVLLAMKELNYQPNRIARGLVSRRTSTIGLLIPDVANPFFSEMARGVEDAAIAEGYSVLLCNSDWKSERELMYIDLLKGRWVDGIVIVGSRSDSRVIEAAVGDTPLVIVDRRSSEFRWSVWTDNRQGAALVVEHLLKMGCSKIVHIAGPSDSPSAQERRKGYEQAISQAGLVAIVYDGDFRFASGFEIATMILEGSQRPDGIFAANDLMAIGVLQAAVKLGVQVPHEVAIVGYDNIPSAGYVSPSLTTVHQPSYQMGVSAFDLLLEQFVTNSGQSARKVKFEPKLVVRDSSLKCPSRNSV

SEQ ID NO: 1526 - DNA, 1005 bp, Artificial
  Substituion in SEQ ID NO 1515
ttggtcacgattcgagatgtggctcgcaaagcaggagtttctgtttctacggtttctagagtcatcaatggaagtggttacgtaggggaagatacagagcgtaaggtacttcttgctatgaaggagctcaactaccaacccaatcgaattgcgcgcggactagtcagtcgtcggacgtcgacgattggcttgctcatcccggatgtcgcaaaccccttcttttcggagatggcacgaggtgtcgaagacgccgcaattgccgaggggtattcggttcttctatgtaactcggattggaaatctgaacgcgaactgatgtacatcgatattcttaagggacgatgggttgacggaatcgtcatcgtgggaagccgaagtgacagtcgggtgattgaagctgctgttggcgatacaccgctggtcattgtggatcgtcgttcatctgaatttaggtggtcagtgtggacggacaatcgtcagggtgctgcactggtagttgagcacttattgaagatgggatgctcaaagatcgtccatatcgccggaccgagtgattctccgtcggctcaggaaagacggaagggatatgaacaggccatatctcaagctgggcttgtagcgatagtgtacgaaggagattttcgcttcgcttcagggtttgaaattgcaacgatgatactcgagggctcccaacgacctgatgggatttttgcagccaatgatttaatggcaataggcgttttgcaagccgcagtaaagcttggagttcaggttcctcatgaagtggcgattgtaggttatgacaatattccgtctgcggggtatgtgagtccttcacttacgaccgttcatcagccttcatatcagatgggcgtgtcagccttcgatttgctgcttgagcagtttgtcaccaactcaggtcagagtgctcgcaaggttaagttcgaaccgaagcttgttgtccgggactctagtttgaagtgtccatcgagaaatagcgtttga

SEQ ID NO: 1527 - DNA, 1005 bp, Artificial
  Substituion in SEQ ID NO 1515
ttggtcacgattcgagatgtggctcgcaaagcaggagtttctgtttctacggtttctagagtcatcaatggaagtggttacgtaggggaagatacagagcgtcgtgtacttcttgctatgaaggagctcaactaccaacccaatcgaattgcgcgcggactagtcagtcgtcggacgtcgacgattggcttgctcatcccggatgtcgcaaaccccttcttttcggagatggcacgaggtgtcgaagacgccgcaattgccgaggggtattcggttcttctatgtaactcggattggaaatctgaacgcgaactgatgtacatcgatcttcttaagggacgatgggttgacggaatcgtcatcgtgggaagccgaagtgacagtcgggtgattgaagctgctgttggcgatacaccgctggtcattgtggatcgtcgttcatctgaatttaggtggtcagtgtggacggacaatcgtcagggtgctgcactggtagttgagcacttattgaagatgggatgctcaaagatcgtccatatcgccggaccgagtgattctccgtcggctcaggaaagacggaagggatatgaacaggccatatctcaagctgggcttgtagcgatagtgtacgaaggagattttcgcttcgcttcagggtttgaaattgcaacgatgatactcgagggctcccaacgacctgatgggatttttgcagccaatgatttaatggcaataggcgttttgcaagccgcagtaaagcttggagttcaggttcctcatgaagtggcgattgtaggttatgacaatattccgtctgcggggtatgtgagtccttcacttacgaccgttcatcagccttcatatcagatgggcgtgtcagccttcgatttgctgcttgagcagtttgtcaccaactcaggtcagagtgctcgcaaggttaagttcgaaccgaagcttgttgtccgggactctagtttgaagtgtccatcgagaaatagcgtttga

SEQ ID NO: 1528 - DNA, 1005 bp, Artificial
  Substituion in SEQ ID NO 1515
ttggtcacgattcgagatgtggctcgccgtgcaggagtttctgtttctacggtttctagagtcatcaatggaagtggttacgtaggggaagatacagagcgtaaggtacttcttgctatgaaggagctcaactaccaacccaatcgaattgcgcgcggactagtcagtcgtcggacgtcgacgattggcttgctcatcccggatgtcgcaaaccccttcttttcggagatggcacgaggtgtcgaagacgccgcaattgccgaggggtattcggttcttctatgtaactcggattggaaatctgaacgcgaactgatgtacatcgatcttcttaagggacgatgggttgacggaatcgtcatcgtgggaagccgaagtgacagtcgggtgattgaagctgctgttggcgatacaccgctggtcattgtggatcgtcgttcatctgaatttaggtggtcagtgtggacggacaatcgtcagggtgctgcactggtagttgagcacttattgaagatgggatgctcaaagatcgtccatatcgccggaccgagtgattctccgtcggctcaggaaagacggaagggatatgaacaggccatatctcaagctgggcttgtagcgatagtgtacgaaggagattttcgcttcgcttcagggtttgaaattgcaacgatgatactcgagggctcccaacgacctgatgggatttttgcagccaatgatttaatggcaataggcgttttgcaagccgcagtaaagcttggagttcaggttcctcatgaagtggcgattgtaggttatgacaatattccgtctgcggggtatgtgagtccttcacttacgaccgttcatcagccttcatatcagatgggcgtgtcagccttcgatttgctgcttgagcagtttgtcaccaactcaggtcagagtgctcgcaaggttaagttcgaaccgaagcttgttgtccgggactctagtttgaagtgtccatcgagaaatagcgtttga

SEQ ID NO: 1529 - DNA, 1005 bp, Artificial
  Substituion in SEQ ID NO 1515
ttggtcacgattcgagatgtggctcgcaaagcaggagtttctgtttctacggtttctagagtcatcaatggaagtggttacgtaggggaagatacagagcgtaaggtacttcttgctatgaaggagctcaactaccaacccaatcgaattgcgcgcggactagtcagtcgtcggacgtcgacgattggcttgctcatcccggatgtcgcaaaccccttcttttcggagatggcacgaggtgtcgaagacgccgcaattgccgaggggtattcggttcttctatgtaactcggattggaaatctgaacgcgaactgatgtacatcgatcttcttaagggacgatgggttgacggaatcgtcatcgtgggaagccgaagtgacagtcgggtgattgaagctgctgttggcgatacaccgctggtcattgtggatcgtcgttcatctgaatttaggtggtcagtgtggacggacaatcgtcagggtgctgcactggtagttgatcacttattgaagatgggatgctcaaagatcgtccatatcgccggaccgagtgattctccgtcggctcaggaaagacggaagggatatgaacaggccatatctcaagctgggcttgtagcgatagtgtacgaaggagattttcgcttcgcttcagggtttgaaattgcaacgatgatactcgagggctcccaacgacctgatgggatttttgcagccaatgatttaatggcaataggcgttttgcaagccgcagtaaagcttggagttcaggttcctcatgaagtggcgattgtaggttatgacaatattccgtctgcggggtatgtgagtccttcacttacgaccgttcatcagccttcatatcagatgggcgtgtcagccttcgatttgctgcttgagcagtttgtcaccaactcaggtcagagtgctcgcaaggttaagttcgaaccgaagcttgttgtccgggactctagtttgaagtgtccatcgagaaatagcgtttga

SEQ ID NO: 1530 - DNA, 1005 bp, Artificial
  Substituion in SEQ ID NO 1515
ttggtcacgattcgagatgtggctcgcaaagcaggagtttctgtttctacggtttctagagtcatcaatggaagtggttacgtaggggaagatacagagcgtaaggtacttcttgctatgaaggagctcaactaccaacccaatcgaattgcgcgcggactagtcagtcgtcggacgtcgacgattggcttgctcatcccggatgtcgcaaaccccttcttttcggagatggcacgaggtgtcgaagacgccgcaattgccgaggggtattcggttcttctatgtaactcggattggaaatctgaacgcgaactgatgtacatcgatcttcttaagggacgatgggttgacggaatcgtcatcgtgggaagccgaagtgacagtcgggtgattgaagctgctgttggcgatacaccgctggtcattgtggatcgtcgttcatctgaatttaggtggtcagtgtggacggacaatcgtcagggtgctgcactggtagttgagcacttattgaagatgggatgctcaaagatcgtccatatcgccggaccgagtgattctccgtcggctcaggaaagacggaagggatatgaacaggccatatctcaagctgggcttgtagcgatagtgtacgatggagattttcgcttcgcttcagggtttgaaattgcaacgatgatactcgagggctcccaacgacctgatgggatttttgcagccaatgatttaatggcaataggcgttttgcaagccgcagtaaagcttggagttcaggttcctcatgaagtggcgattgtaggttatgacaatattccgtctgcggggtatgtgagtccttcacttacgaccgttcatcagccttcatatcagatgggcgtgtcagccttcgatttgctgcttgagcagtttgtcaccaactcaggtcagagtgctcgcaaggttaagttcgaaccgaagcttgttgtccgggactctagtttgaagtgtccatcgagaaatagcgtttga

SEQ ID NO: 1531 - protein, 431 aa, Alicyclobacillus acidocaldarius
MFAMPSKVVVTLGSAYAPMASKDNDFCRPDEVSGATSPPRLRAPYLLVRASAREMSFFEFVRDLAATHPDPDPFLCLVLDAEGGVMTSAAHGEWEKDEMAACLSAASREFPAVAAQETSMSPRTEFGLSAVALLRTDGWHTAWTRLPMAVGRARHLAVIRRASDEDPRSLGRLALHLAHAATQAWTSCERTLVRRSQCVIERMRKKLQEFEKVSALAQLCAGIAHEIRNPLTTARGFLQLFAERCDDKDRGYLELTISELDRIRELLEDFMGLCRPDREEAAEVDMVEIARSVHRFLVPEASLCDIAFELNVPAHPIPAAVRPAQIKQVLINLVQNALQACRGQAHAVVRLDVAEKEDRVLVQVVDNGCGIEHMDRIFRPFYTTKSTGTGLGLFVCKHIIESHGGSISVRSQVGAGTTVTVEIPKCASRRA

SEQ ID NO: 1532 - DNA, 1296 bp, Alicyclobacillus acidocaldarius
ttgttcgcgatgccgtcaaaggtggttgtcacgttgggctctgcatacgcacccatggcttcgaaagacaacgacttctgcaggcctgatgaggtctcgggcgcgacctctccgccccgcctcagagcgccgtacctccttgtgcgcgcgagcgcgcgcgaaatgtcctttttcgagttcgtgcgcgatctcgccgccacgcaccccgatcccgatccgttcctgtgcctggtgctcgacgccgagggcggcgtcatgacgagcgcggcacacggcgaatgggagaaggacgaaatggccgcgtgcctgagcgcagcctcgcgcgaattccctgccgtggccgcccaagagacgagcatgtcgccgcgaaccgagttcggcctatcggcggtcgcccttctgcgcaccgatggatggcacacggcgtggacgcggttacctatggccgttggacgagcccgccatctcgccgtgatccggcgcgcatcggacgaggaccctcgcagcctcgggcgcctcgcgctccacctcgcgcacgcggcgacccaggcgtggacaagctgcgagcgcacgctcgtgcggagaagtcaatgcgtgatcgaacgcatgcgaaagaaattgcaggaattcgagaaagtgtccgcattggcccaattgtgtgccgggatcgcgcacgagatccgaaacccgctcacgacggcgcgtggatttctgcagctcttcgcggagcgctgcgacgacaaggaccgcggctacctcgagctcaccatcagcgagctggatcgcatacgggaactgttggaggatttcatgggcctgtgccgaccggaccgagaggaggcggccgaggtcgacatggttgaaattgcgcgatccgtccatcggtttctcgtccccgaggcgagcctctgcgatattgcgttcgaactgaacgtccccgcgcatcccatcccggccgccgtgcgtcccgctcagatcaagcaggttctcatcaatttggtacagaatgcgcttcaggcatgtcgcggccaggcacatgccgtggtgaggctggacgtggcagagaaggaggaccgcgtgctcgtgcaggtggtggacaacggctgcgggatcgaacacatggatcgcattttccgaccgttctacaccacgaagtccacgggcaccgggctcggcctcttcgtgtgcaaacacatcatcgagtcgcacggggggtccatctcggtccgctcgcaggtcggtgcgggcacgacggtcaccgtggagatcccgaaatgcgcctcgcggcgcgcctag

SEQ ID NO: 1533 - protein, 231 aa, Thermosinus carboxydivorans Nor1
IREVRHRMHHLETLAALGQLAAGTAHEIRNPLTSIRGFTQLIQTRALRRNDATTADYCRLIMQEIDHINNILTDILSLARPTTRQLSLLNIVKIVHDVIAFMYGEAILSGITLRPELPPEELWVQGHIDKLKEVLINICRNAFQAMGPGGVLTLSVAADTATVKIVLADTGCGMTKEVMDQIFTPFFTTKETGTGLGLAICQQIMHEHGGDIQVESTPGQGSTFTLLLPRC

SEQ ID NO: 1534 - protein, 231 aa, Bacillus cereus AH820
RKKTEELLNKSDTLAAIGQLAAGVAHEVRNPLTVIKGFIQLFQINKEDQEKYFDLMLSEIERIEAILQEFLSIAKTDEISTEKKNIYQIFKNVVSLINTKAIMTNIQVELYADSKDIIIECSENQLKQVFINILQNSIEAMPDGGRISIHIKEIGKDGIIISVIDKGIGIPEERIKRLGEPFYSTKEKGTGIGLMLSYKIIESHQGNISIMSEVGVGTTVTIYLPKIQSKK

SEQ ID NO: 1535 - protein, 231 aa, Bacillus thuringiensis serovar konkukian str. 97-27
RKKTEELLNKSDTLAAIGQLAAGVAHEVRNPLTVIKGFIQLFQINKEDQEKYFDLMLSEIERIEAILQEFLSIAKTDEISTEKKNIYQIFKNVVSLINTKAIMTNIQVELYTDSKDIIIECSENQLKQVFINILQNSIEAMPDGGRISIHIKEIGKDGIIISVIDKGIGIPEERIKRLGEPFYSTKEKGTGIGLMLSYKIIESHQGNISIMSEVGVGTTVTIYLPKIQSKK

SEQ ID NO: 1536 - protein, 231 aa, Bacillus anthracis str. Sterne
RKKTEELLNKSDTLAAIGQLAAGVAHEVRNPLTVIKGFIQLFQINKEDQEKYFDLMLSEIERIEAILQEFLSIAKTDEISTEKKNIYQIFKNVVSLINTKAIMTNIQVELYTDSKDIIIECSENQLKQVFINILQNSIEAMPDGGRISIHIKEIGKDGIIISVIDKGIGIPAERIKRLGEPFYSTKEKGTGIGLMLSYKIIESHQGNISIMSEVGVGTTVTIYLPKIQSKK

SEQ ID NO: 1537 - protein, 231 aa, Bacillus cereus E33L; identical to SEQ ID NO: 1535

SEQ ID NO: 1538 - protein, 431 aa, Artificial
  Substituion in SEQ ID NO 1531
MFAMPSKVVVTLGSAYAPMASKDNDFCRPDEVSGATSPPRLRAPYLLVRASAREMSFFEFVRDLAATHPDPDPFLCLVLDAEGGVMTSAAHGEWEKDEMAACLSAASREFPAVAAQETSMSPRTEFGLSAVALLRTDGWHTAWTRLPMAVGRARHLAVIRRASDEDPRSLGRLALHLAHAATQAWTSCERTLVRRSQCVIERMRKKLQEFEKVSALAQLCAGIAHEIRNPLTTARGFLQLFAERCDDKDRGYLELTISELDRIRELLEDFMGLCRPDREEAAEVDMVEIARSVHRFLVPEASLCDIAFELNVPAHPIPAAVRPAQIKQVLINLVQNALQACRGQAHAVVRLDVAEREDRVLVQVVDNGCGIEHMDRIFRPFYTTKSTGTGLGLFVCKHIIESHGGSISVRSQVGAGTTVTVEIPKCASRRA

SEQ ID NO: 1539 - protein, 431 aa, Artificial
  Substituion in SEQ ID NO 1531
MFAMPSKVVVTLGSAYAPMASKDNDFCRPDEVSGATSPPRLRAPYLLVRASAREMSFFEFVRDLAATHPDPDPFLCLVLDAEGGVMTSAAHGEWEKDEMAACLSAASREFPAVAAQETSMSPRTEFGLSAVALLRTDGWHTAWTRLPMAVGRARHLAVIRRASDEDPRSLGRLALHLAHAATQAWTSCERTLVRRSQCVIERMRKKLQEFEKVSALAQLCAGIAHEIRNPLTTARGFLQLFAERCDDKERGYLELTISELDRIRELLEDFMGLCRPDREEAAEVDMVEIARSVHRFLVPEASLCDIAFELNVPAHPIPAAVRPAQIKQVLINLVQNALQACRGQAHAVVRLDVAEKEDRVLVQVVDNGCGIEHMDRIFRPFYTTKSTGTGLGLFVCKHIIESHGGSISVRSQVGAGTTVTVEIPKCASRRA

SEQ ID NO: 1540 - protein, 431 aa, Artificial
  Substituion in SEQ ID NO 1531
MFAMPSKVVVTLGSAYAPMASKDNDFCRPDEVSGATSPPRLRAPYLLVRASAREMSFFEFVRDLAATHPDPDPFLCLVLDAEGGVMTSAAHGEWEKDEMAACLSAASREFPAVAAQETSMSPRTEFGLSAVALLRTDGWHTAWTRLPMAVGRARHLAVIRKASDEDPRSLGRLALHLAHAATQAWTSCERTLVRRSQCVIERMRKKLQEFEKVSALAQLCAGIAHEIRNPLTTARGFLQLFAERCDDKDRGYLELTISELDRIRELLEDFMGLCRPDREEAAEVDMVEIARSVHRFLVPEASLCDIAFELNVPAHPIPAAVRPAQIKQVLINLVQNALQACRGQAHAVVRLDVAEKEDRVLVQVVDNGCGIEHMDRIFRPFYTTKSTGTGLGLFVCKHIIESHGGSISVRSQVGAGTTVTVEIPKCASRRA

SEQ ID NO: 1541 - protein, 431 aa, Artificial
  Substituion in SEQ ID NO 1531
MFAMPSKVVVTLGSAYAPMASKDNDFCRPDEVSGATSPPRLRAPYLLVRASAREMSFFEFVRDLAATHPDPDPFLCLVLDAEGGVMTSAAHGEWEKDEMAACLSAASREFPAVAAQETSMSPRTEFGLSAVALLRTDGWHTAWTRLPMAVGRARHLAVIRRASDEDPRSLGRLALHLAHAATQAWTSCERTLVRRSQCVIERMRKKLQEFEKVSALAQLCAGIAHEIRNPLTTARGFLQLFAERCDDKDRGYLELTISELDRIRELLEDFMGLCRPDREEAAEVDMVEIARSVHRFLVPEASLCDIAFELNVPAHPIPAAVRPAQIKQVLINLVQNALQACRGQAHAVVRLDVAEKEDRVLVQVVDNGCGIEHMDRIFRPFYTTKSTGTGLGLFVCKHILESHGGSISVRSQVGAGTTVTVEIPKCASRRA

SEQ ID NO: 1542 - protein, 431 aa, Artificial
  Substituion in SEQ ID NO 1531
MFAMPSKVVVTLGSAYAPMASKDNDFCRPDEVSGATSPPRLRAPYLLVRASAREMSFFEFVRDLAATHPDPDPFLCLVLDAEGGVMTSAAHGEWEKDEMAACLSAASREFPAVAAQETSMSPRTEFGLSAVALLRTDGWHTAWTRLPMAVGRARHLAVIRRASDEDPRSLGRLALHLAHAATQAWTSCERTLVRRSQCVIERMRKKLQEFEKVSALAQLCAGIAHEIRNPLTTARGFLQLFAERCDDKDRGYLELTISELDRIRELLEDFMGLCRPDREEAAEVDMVEIARSVHRFLVPEASLCDIAFELNVPAHPIPAAVRPAQIKQVLINLVQNALQACRGQAHAVVRLDVAEKEDRVLVQVVDNGCGIEHMERIFRPFYTTKSTGTGLGLFVCKHIIESHGGSISVRSQVGAGTTVTVEIPKCASRRA

SEQ ID NO: 1543 - DNA, 1296 bp, Artificial
  Substituion in SEQ ID NO 1532
ttgttcgcgatgccgtcaaaggtggttgtcacgttgggctctgcatacgcacccatggcttcgaaagacaacgacttctgcaggcctgatgaggtctcgggcgcgacctctccgccccgcctcagagcgccgtacctccttgtgcgcgcgagcgcgcgcgaaatgtcctttttcgagttcgtgcgcgatctcgccgccacgcaccccgatcccgatccgttcctgtgcctggtgctcgacgccgagggcggcgtcatgacgagcgcggcacacggcgaatgggagaaggacgaaatggccgcgtgcctgagcgcagcctcgcgcgaattccctgccgtggccgcccaagagacgagcatgtcgccgcgaaccgagttcggcctatcggcggtcgcccttctgcgcaccgatggatggcacacggcgtggacgcggttacctatggccgttggacgagcccgccatctcgccgtgatccggcgcgcatcggacgaggaccctcgcagcctcgggcgcctcgcgctccacctcgcgcacgcggcgacccaggcgtggacaagctgcgagcgcacgctcgtgcggagaagtcaatgcgtgatcgaacgcatgcgaaagaaattgcaggaattcgagaaagtgtccgcattggcccaattgtgtgccgggatcgcgcacgagatccgaaacccgctcacgacggcgcgtggatttctgcagctcttcgcggagcgctgcgacgacaaggaccgcggctacctcgagctcaccatcagcgagctggatcgcatacgggaactgttggaggatttcatgggcctgtgccgaccggaccgagaggaggcggccgaggtcgacatggttgaaattgcgcgatccgtccatcggtttctcgtccccgaggcgagcctctgcgatattgcgttcgaactgaacgtccccgcgcatcccatcccggccgccgtgcgtcccgctcagatcaagcaggttctcatcaatttggtacagaatgcgcttcaggcatgtcgcggccaggcacatgccgtggtgaggctggacgtggcagagcgtgaggaccgcgtgctcgtgcaggtggtggacaacggctgcgggatcgaacacatggatcgcattttccgaccgttctacaccacgaagtccacgggcaccgggctcggcctcttcgtgtgcaaacacatcatcgagtcgcacggggggtccatctcggtccgctcgcaggtcggtgcgggcacgacggtcaccgtggagatcccgaaatgcgcctcgcggcgcgcctag

SEQ ID NO: 1544 - DNA, 1296 bp, Artificial
  Substituion in SEQ ID NO 1532
ttgttcgcgatgccgtcaaaggtggttgtcacgttgggctctgcatacgcacccatggcttcgaaagacaacgacttctgcaggcctgatgaggtctcgggcgcgacctctccgccccgcctcagagcgccgtacctccttgtgcgcgcgagcgcgcgcgaaatgtcctttttcgagttcgtgcgcgatctcgccgccacgcaccccgatcccgatccgttcctgtgcctggtgctcgacgccgagggcggcgtcatgacgagcgcggcacacggcgaatgggagaaggacgaaatggccgcgtgcctgagcgcagcctcgcgcgaattccctgccgtggccgcccaagagacgagcatgtcgccgcgaaccgagttcggcctatcggcggtcgcccttctgcgcaccgatggatggcacacggcgtggacgcggttacctatggccgttggacgagcccgccatctcgccgtgatccggcgcgcatcggacgaggaccctcgcagcctcgggcgcctcgcgctccacctcgcgcacgcggcgacccaggcgtggacaagctgcgagcgcacgctcgtgcggagaagtcaatgcgtgatcgaacgcatgcgaaagaaattgcaggaattcgagaaagtgtccgcattggcccaattgtgtgccgggatcgcgcacgagatccgaaacccgctcacgacggcgcgtggatttctgcagctcttcgcggagcgctgcgacgacaaggaacgcggctacctcgagctcaccatcagcgagctggatcgcatacgggaactgttggaggatttcatgggcctgtgccgaccggaccgagaggaggcggccgaggtcgacatggttgaaattgcgcgatccgtccatcggtttctcgtccccgaggcgagcctctgcgatattgcgttcgaactgaacgtccccgcgcatcccatcccggccgccgtgcgtcccgctcagatcaagcaggttctcatcaatttggtacagaatgcgcttcaggcatgtcgcggccaggcacatgccgtggtgaggctggacgtggcagagaaggaggaccgcgtgctcgtgcaggtggtggacaacggctgcgggatcgaacacatggatcgcattttccgaccgttctacaccacgaagtccacgggcaccgggctcggcctcttcgtgtgcaaacacatcatcgagtcgcacggggggtccatctcggtccgctcgcaggtcggtgcgggcacgacggtcaccgtggagatcccgaaatgcgcctcgcggcgcgcctag

SEQ ID NO: 1545 - DNA, 1296 bp, Artificial
  Substituion in SEQ ID NO 1532
ttgttcgcgatgccgtcaaaggtggttgtcacgttgggctctgcatacgcacccatggcttcgaaagacaacgacttctgcaggcctgatgaggtctcgggcgcgacctctccgccccgcctcagagcgccgtacctccttgtgcgcgcgagcgcgcgcgaaatgtcctttttcgagttcgtgcgcgatctcgccgccacgcaccccgatcccgatccgttcctgtgcctggtgctcgacgccgagggcggcgtcatgacgagcgcggcacacggcgaatgggagaaggacgaaatggccgcgtgcctgagcgcagcctcgcgcgaattccctgccgtggccgcccaagagacgagcatgtcgccgcgaaccgagttcggcctatcggcggtcgcccttctgcgcaccgatggatggcacacggcgtggacgcggttacctatggccgttggacgagcccgccatctcgccgtgatccggaaagcatcggacgaggaccctcgcagcctcgggcgcctcgcgctccacctcgcgcacgcggcgacccaggcgtggacaagctgcgagcgcacgctcgtgcggagaagtcaatgcgtgatcgaacgcatgcgaaagaaattgcaggaattcgagaaagtgtccgcattggcccaattgtgtgccgggatcgcgcacgagatccgaaacccgctcacgacggcgcgtggatttctgcagctcttcgcggagcgctgcgacgacaaggaccgcggctacctcgagctcaccatcagcgagctggatcgcatacgggaactgttggaggatttcatgggcctgtgccgaccggaccgagaggaggcggccgaggtcgacatggttgaaattgcgcgatccgtccatcggtttctcgtccccgaggcgagcctctgcgatattgcgttcgaactgaacgtccccgcgcatcccatcccggccgccgtgcgtcccgctcagatcaagcaggttctcatcaatttggtacagaatgcgcttcaggcatgtcgcggccaggcacatgccgtggtgaggctggacgtggcagagaaggaggaccgcgtgctcgtgcaggtggtggacaacggctgcgggatcgaacacatggatcgcattttccgaccgttctacaccacgaagtccacgggcaccgggctcggcctcttcgtgtgcaaacacatcatcgagtcgcacggggggtccatctcggtccgctcgcaggtcggtgcgggcacgacggtcaccgtggagatcccgaaatgcgcctcgcggcgcgcctag

SEQ ID NO: 1546 - DNA, 1296 bp, Artificial
  Substituion in SEQ ID NO 1532
ttgttcgcgatgccgtcaaaggtggttgtcacgttgggctctgcatacgcacccatggcttcgaaagacaacgacttctgcaggcctgatgaggtctcgggcgcgacctctccgccccgcctcagagcgccgtacctccttgtgcgcgcgagcgcgcgcgaaatgtcctttttcgagttcgtgcgcgatctcgccgccacgcaccccgatcccgatccgttcctgtgcctggtgctcgacgccgagggcggcgtcatgacgagcgcggcacacggcgaatgggagaaggacgaaatggccgcgtgcctgagcgcagcctcgcgcgaattccctgccgtggccgcccaagagacgagcatgtcgccgcgaaccgagttcggcctatcggcggtcgcccttctgcgcaccgatggatggcacacggcgtggacgcggttacctatggccgttggacgagcccgccatctcgccgtgatccggcgcgcatcggacgaggaccctcgcagcctcgggcgcctcgcgctccacctcgcgcacgcggcgacccaggcgtggacaagctgcgagcgcacgctcgtgcggagaagtcaatgcgtgatcgaacgcatgcgaaagaaattgcaggaattcgagaaagtgtccgcattggcccaattgtgtgccgggatcgcgcacgagatccgaaacccgctcacgacggcgcgtggatttctgcagctcttcgcggagcgctgcgacgacaaggaccgcggctacctcgagctcaccatcagcgagctggatcgcatacgggaactgttggaggatttcatgggcctgtgccgaccggaccgagaggaggcggccgaggtcgacatggttgaaattgcgcgatccgtccatcggtttctcgtccccgaggcgagcctctgcgatattgcgttcgaactgaacgtccccgcgcatcccatcccggccgccgtgcgtcccgctcagatcaagcaggttctcatcaatttggtacagaatgcgcttcaggcatgtcgcggccaggcacatgccgtggtgaggctggacgtggcagagaaggaggaccgcgtgctcgtgcaggtggtggacaacggctgcgggatcgaacacatggatcgcattttccgaccgttctacaccacgaagtccacgggcaccgggctcggcctcttcgtgtgcaaacacatcttagagtcgcacggggggtccatctcggtccgctcgcaggtcggtgcgggcacgacggtcaccgtggagatcccgaaatgcgcctcgcggcgcgcctag

SEQ ID NO: 1547 - DNA, 1296 bp, Artificial
  Substituion in SEQ ID NO 1532
ttgttcgcgatgccgtcaaaggtggttgtcacgttgggctctgcatacgcacccatggcttcgaaagacaacgacttctgcaggcctgatgaggtctcgggcgcgacctctccgccccgcctcagagcgccgtacctccttgtgcgcgcgagcgcgcgcgaaatgtcctttttcgagttcgtgcgcgatctcgccgccacgcaccccgatcccgatccgttcctgtgcctggtgctcgacgccgagggcggcgtcatgacgagcgcggcacacggcgaatgggagaaggacgaaatggccgcgtgcctgagcgcagcctcgcgcgaattccctgccgtggccgcccaagagacgagcatgtcgccgcgaaccgagttcggcctatcggcggtcgcccttctgcgcaccgatggatggcacacggcgtggacgcggttacctatggccgttggacgagcccgccatctcgccgtgatccggcgcgcatcggacgaggaccctcgcagcctcgggcgcctcgcgctccacctcgcgcacgcggcgacccaggcgtggacaagctgcgagcgcacgctcgtgcggagaagtcaatgcgtgatcgaacgcatgcgaaagaaattgcaggaattcgagaaagtgtccgcattggcccaattgtgtgccgggatcgcgcacgagatccgaaacccgctcacgacggcgcgtggatttctgcagctcttcgcggagcgctgcgacgacaaggaccgcggctacctcgagctcaccatcagcgagctggatcgcatacgggaactgttggaggatttcatgggcctgtgccgaccggaccgagaggaggcggccgaggtcgacatggttgaaattgcgcgatccgtccatcggtttctcgtccccgaggcgagcctctgcgatattgcgttcgaactgaacgtccccgcgcatcccatcccggccgccgtgcgtcccgctcagatcaagcaggttctcatcaatttggtacagaatgcgcttcaggcatgtcgcggccaggcacatgccgtggtgaggctggacgtggcagagaaggaggaccgcgtgctcgtgcaggtggtggacaacggctgcgggatcgaacacatggaacgcattttccgaccgttctacaccacgaagtccacgggcaccgggctcggcctcttcgtgtgcaaacacatcatcgagtcgcacggggggtccatctcggtccgctcgcaggtcggtgcgggcacgacggtcaccgtggagatcccgaaatgcgcctcgcggcgcgcctag

SEQ ID NO: 1548 - protein, 368 aa, Alicyclobacillus acidocaldarius
MEIFLCIFTRKIILSLSPVICVKGGGKVLATMKDVAELARVSIAVVSRVLNEDRSLSVPESTRKRVIEAANQLNYKVKRRQNRSATSKIKTIAIVDFHPEEQERDDPYFWPMVRGIELECQEKGLIHPVKFYVKTPAEFSPSELSNFDGVLVIGAEEWSGWDDFHHPNVVFLDHCPNVARYSSVLLNFSSAVKDVFNHFWRLGYRTFAYIGGTRRFGMDERESTFRTCVKSTVGAEPPVYHGDWSTGGGYEAMKLMLQEGAPLPRAIFVASDPMAIGVIRALTEIGKRVPEDVAVVGFDDIDMAAYVNPALTTIRVQPEVMGRIGVRMLMCPYDPNVPVQVVMPYQLVIRESCGACGSLAAGGRDFGL

SEQ ID NO: 1549 - DNA, 1107 bp, Alicyclobacillus acidocaldarius
atggagatatttttgtgtatttttactcgtaaaatcatactttctttaagcccagtcatctgtgtgaaagggggcggcaaggtattggctacgatgaaggatgttgctgaactcgctcgcgtctcaattgccgtggtttctcgagtgctgaacgaagatcgttccttgtccgttcctgaatccactcgaaaacgggtcatagaagcagcaaatcagctaaattacaaagtaaaacggcggcaaaatagatctgctacgagtaagataaaaacaattgcaattgtcgatttccatccagaagagcaagagcgtgatgacccatatttttggcctatggtgcgtgggatcgagttggagtgtcaggaaaaggggttgatccatcccgttaagttttacgtaaaaacccccgctgaattcagtccaagtgagttgtcgaactttgacggggtgctcgtgatcggtgctgaggaatggtctggttgggacgatttccaccaccccaatgttgtatttctcgatcattgtccaaatgtggctcgttattcatctgtacttcttaatttttctagtgccgtaaaagatgtttttaaccacttttggaggttgggttatcgaacttttgcctacatcggtgggacccgcagattcggcatggatgagcgtgagtccacgttccgcacttgtgtcaagtcaacggtcggtgccgaaccccctgtgtaccacggagactggtcaactggcgggggttatgaggccatgaagcttatgctccaagaaggcgcgccgctcccaagagcgattttcgttgcaagcgatccgatggcgattggggtcatacgggcgctaactgagataggaaagcgggtgcctgaagacgtagctgtggtcgggttcgatgacatcgacatggcggcctatgtcaacccagcgctcaccacaatacgtgtgcagccagaagtcatggggaggataggagtgcggatgctaatgtgcccttatgatccaaacgtaccagttcaggttgtcatgccatatcagctggtcattcgagagagttgcggggcttgtggcagtctggccgccggagggagggacttcggcttatga

SEQ ID NO: 1550 - protein, 337 aa, Bacillus licheniformis ATCC 14580
MATIKEIALQAKVSSTTVSRVLNHDQSLSVAPETRQRILDIAARLGYKSTRRRREVYASGSGESPRIGIVVCQSQEEELNDPYFYSIRQGIESECFERGAFITKFIQLSSIRSNQPVGDVDGLIVIGRINFAGLQQCMGALNNVVYINHTDNEELRDSVVVDFEKATGRALNHLKSLGYTRIGYIGGREKEHFRISDQETSAIEIEDKRLTAFLEMAGSDNAKHIYIGEYSMQQGYELMKKALLEKNVPEAFFIASDSMAIGALRALRESGLKVPEDVAIVSFNGIEASEFANPPLTTVKVHTEEMGRTGVKLLLDRLKGRELPLKVTVPSELIIRE

SEQ ID NO: 1551 - protein, 337 aa, Bacillus licheniformis ATCC 14580; identical to SEQ ID NO: 1550

SEQ ID NO: 1552 - protein, 332 aa, Bacillus halodurans C-125
MATIKDIAKLANVSNATVSRVLNRDATLSVTEETRERIYSIAKELGYKRIKERQETKKQVAPNIGIIILQSPEEEIDDPYFNSIRNGVEQTLQAKGIYSTKVIHVQDSTTTSNIDGLDGLIIIGGVTSDKIKQMTAPLEHLVFVNRCPSEEEFDSVVIDFEKATSKALDYLFLKGFRRIGYIGGTERQLSDQGKVEIEDFRHTVYVKKMEELGLYEPSLVFIGEYKMTEGYKLMKRAIEAGNLPEAFFISSDPMAVGALRALKEANIAVPRDVSLVSFNDNEMAQFVDPPLTTVKVFTEQMGEMAVQLLLDRLNGRTLPLKVVVPTELVVRE

SEQ ID NO: 1553 - protein, 328 aa, Geobacillus thermodenitrificans NG80-2
MATLKEIAEKVGVSVATVSRVLNYDTTLSVSDETRKRIFEVAQELNYKTLRERSQQARESFRLGLIHWYSERQEIDDPYYMAIRLGVEKECFERGIQLVKLFKQNGAYPIERMKELDGIIAVGKFGPKEVSDFARGAKQIVFVDCSPDERQFDSVVIDLRQATITVLDYLLQLGHTKIGYIGGREYVDGETPIRDERETAFYEYLYVKGMYDSRDVWIGAFTAEDGYRLMKEAIAKGDLPTAFFIASDSMAIGALRALHEAGIAVPQDVAIVGFNDLPTAAFLHPPLSTVKVYTEFMGETAVELLIERLTTKRTICKKVIVPTELVVR

SEQ ID NO: 1554 - protein, 333 aa, Bacillus amyloliquefaciens FZB42
MVRLKDIALQASVSSATVSRILNKDDSLAVTDETREKVLRIADELGYQPSAKRRKNRSRSDSAPLIGVVSCLSPEVERQDPYFSAIRKGIEEECFRQKVFITSSIHLGSFQEHMFHELDGVIVIGSLQDEALTNISAAFRHAVFVNGTPDPARYDSVSVDFYAAAQKAIEHLLSLGYQRLGYIGGREREHTVIDGVNSNKTIEDKRLTAFLQMAGAEPEHVLIGEYSMHEGFRLMNEAIKGGSLPDAFFIASDSMAVGALKALQEAGLQVPRDTAVVSFNGIDEAEYASTPLSTVKVYTEEMGRTGVKLLLDRLNGRTVPLAVTLPTSLIVRQ

SEQ ID NO: 1555 - protein, 368 aa, Artificial
  Substituion in SEQ ID NO 1548
MEIFLCIFTRKIILSLSPVICVKGGGKVIATMKDVAELARVSIAVVSRVLNEDRSLSVPESTRKRVIEAANQLNYKVKRRQNRSATSKIKTIAIVDFHPEEQERDDPYFWPMVRGIELECQEKGLIHPVKFYVKTPAEFSPSELSNFDGVLVIGAEEWSGWDDFHHPNVVFLDHCPNVARYSSVLLNFSSAVKDVFNHFWRLGYRTFAYIGGTRRFGMDERESTFRTCVKSTVGAEPPVYHGDWSTGGGYEAMKLMLQEGAPLPRAIFVASDPMAIGVIRALTEIGKRVPEDVAVVGFDDIDMAAYVNPALTTIRVQPEVMGRIGVRMLMCPYDPNVPVQVVMPYQLVIRESCGACGSLAAGGRDFGL

SEQ ID NO: 1556 - protein, 368 aa, Artificial
  Substituion in SEQ ID NO 1548
MEIFLCIFTRKIILSLSPVICVKGGGKVLATMKDVAELARVSIAVVSRVLNEDRSLSVPESTRRRVIEAANQLNYKVKRRQNRSATSKIKTIAIVDFHPEEQERDDPYFWPMVRGIELECQEKGLIHPVKFYVKTPAEFSPSELSNFDGVLVIGAEEWSGWDDFHHPNVVFLDHCPNVARYSSVLLNFSSAVKDVFNHFWRLGYRTFAYIGGTRRFGMDERESTFRTCVKSTVGAEPPVYHGDWSTGGGYEAMKLMLQEGAPLPRAIFVASDPMAIGVIRALTEIGKRVPEDVAVVGFDDIDMAAYVNPALTTIRVQPEVMGRIGVRMLMCPYDPNVPVQVVMPYQLVIRESCGACGSLAAGGRDFGL

SEQ ID NO: 1557 - protein, 368 aa, Artificial
  Substituion in SEQ ID NO 1548
MEIFLCIFTRKIILSLSPVICVKGGGKVLATMKDVAELARVSIAVVSRVLNEDRSLSVPESTRKRVIEAANQLNYKVRRRQNRSATSKIKTIAIVDFHPEEQERDDPYFWPMVRGIELECQEKGLIHPVKFYVKTPAEFSPSELSNFDGVLVIGAEEWSGWDDFHHPNVVFLDHCPNVARYSSVLLNFSSAVKDVFNHFWRLGYRTFAYIGGTRRFGMDERESTFRTCVKSTVGAEPPVYHGDWSTGGGYEAMKLMLQEGAPLPRAIFVASDPMAIGVIRALTEIGKRVPEDVAVVGFDDIDMAAYVNPALTTIRVQPEVMGRIGVRMLMCPYDPNVPVQVVMPYQLVIRESCGACGSLAAGGRDFGL

SEQ ID NO: 1558 - protein, 368 aa, Artificial
  Substituion in SEQ ID NO 1548
MEIFLCIFTRKIILSLSPVICVKGGGKVLATMKDVAELARVSIAVVSRVLNEDRSLSVPESTRKRVIEAANQLQYKVKRRQNRSATSKIKTIAIVDFHPEEQERDDPYFWPMVRGIELECQEKGLIHPVKFYVKTPAEFSPSELSNFDGVLVIGAEEWSGWDDFHHPNVVFLDHCPNVARYSSVLLNFSSAVKDVFNHFWRLGYRTFAYIGGTRRFGMDERESTFRTCVKSTVGAEPPVYHGDWSTGGGYEAMKLMLQEGAPLPRAIFVASDPMAIGVIRALTEIGKRVPEDVAVVGFDDIDMAAYVNPALTTIRVQPEVMGRIGVRMLMCPYDPNVPVQVVMPYQLVIRESCGACGSLAAGGRDFGL

SEQ ID NO: 1559 - protein, 368 aa, Artificial
  Substituion in SEQ ID NO 1548
MEIFLCIFTRKIILSLSPVICVKGGGKVLATMKDVAELARVSIAVVSRVLNEDRSLSVPESTRKRVIEAANQLNYKVKRRQNRSATSKIKTIAIVDFHPEEQERDDPYFWPMVRGIELECQEKGLIHPVKFYVKTPAEFSPSELSNFDGVLVIGAEEWSGWEDFHHPNVVFLDHCPNVARYSSVLLNFSSAVKDVFNHFWRLGYRTFAYIGGTRRFGMDERESTFRTCVKSTVGAEPPVYHGDWSTGGGYEAMKLMLQEGAPLPRAIFVASDPMAIGVIRALTEIGKRVPEDVAVVGFDDIDMAAYVNPALTTIRVQPEVMGRIGVRMLMCPYDPNVPVQVVMPYQLVIRESCGACGSLAAGGRDFGL

SEQ ID NO: 1560 - DNA, 1107 bp, Artificial
  Substituion in SEQ ID NO 1549
atggagatatttttgtgtatttttactcgtaaaatcatactttctttaagcccagtcatctgtgtgaaagggggcggcaaggtaattgctacgatgaaggatgttgctgaactcgctcgcgtctcaattgccgtggtttctcgagtgctgaacgaagatcgttccttgtccgttcctgaatccactcgaaaacgggtcatagaagcagcaaatcagctaaattacaaagtaaaacggcggcaaaatagatctgctacgagtaagataaaaacaattgcaattgtcgatttccatccagaagagcaagagcgtgatgacccatatttttggcctatggtgcgtgggatcgagttggagtgtcaggaaaaggggttgatccatcccgttaagttttacgtaaaaacccccgctgaattcagtccaagtgagttgtcgaactttgacggggtgctcgtgatcggtgctgaggaatggtctggttgggacgatttccaccaccccaatgttgtatttctcgatcattgtccaaatgtggctcgttattcatctgtacttcttaatttttctagtgccgtaaaagatgtttttaaccacttttggaggttgggttatcgaacttttgcctacatcggtgggacccgcagattcggcatggatgagcgtgagtccacgttccgcacttgtgtcaagtcaacggtcggtgccgaaccccctgtgtaccacggagactggtcaactggcgggggttatgaggccatgaagcttatgctccaagaaggcgcgccgctcccaagagcgattttcgttgcaagcgatccgatggcgattggggtcatacgggcgctaactgagataggaaagcgggtgcctgaagacgtagctgtggtcgggttcgatgacatcgacatggcggcctatgtcaacccagcgctcaccacaatacgtgtgcagccagaagtcatggggaggataggagtgcggatgctaatgtgcccttatgatccaaacgtaccagttcaggttgtcatgccatatcagctggtcattcgagagagttgcggggcttgtggcagtctggccgccggagggagggacttcggcttatga

SEQ ID NO: 1561 - DNA, 1107 bp, Artificial
  Substituion in SEQ ID NO 1549
atggagatatttttgtgtatttttactcgtaaaatcatactttctttaagcccagtcatctgtgtgaaagggggcggcaaggtattggctacgatgaaggatgttgctgaactcgctcgcgtctcaattgccgtggtttctcgagtgctgaacgaagatcgttccttgtccgttcctgaatccactcgacgtcgggtcatagaagcagcaaatcagctaaattacaaagtaaaacggcggcaaaatagatctgctacgagtaagataaaaacaattgcaattgtcgatttccatccagaagagcaagagcgtgatgacccatatttttggcctatggtgcgtgggatcgagttggagtgtcaggaaaaggggttgatccatcccgttaagttttacgtaaaaacccccgctgaattcagtccaagtgagttgtcgaactttgacggggtgctcgtgatcggtgctgaggaatggtctggttgggacgatttccaccaccccaatgttgtatttctcgatcattgtccaaatgtggctcgttattcatctgtacttcttaatttttctagtgccgtaaaagatgtttttaaccacttttggaggttgggttatcgaacttttgcctacatcggtgggacccgcagattcggcatggatgagcgtgagtccacgttccgcacttgtgtcaagtcaacggtcggtgccgaaccccctgtgtaccacggagactggtcaactggcgggggttatgaggccatgaagcttatgctccaagaaggcgcgccgctcccaagagcgattttcgttgcaagcgatccgatggcgattggggtcatacgggcgctaactgagataggaaagcgggtgcctgaagacgtagctgtggtcgggttcgatgacatcgacatggcggcctatgtcaacccagcgctcaccacaatacgtgtgcagccagaagtcatggggaggataggagtgcggatgctaatgtgcccttatgatccaaacgtaccagttcaggttgtcatgccatatcagctggtcattcgagagagttgcggggcttgtggcagtctggccgccggagggagggacttcggcttatga

SEQ ID NO: 1562 - DNA, 1107 bp, Artificial
  Substituion in SEQ ID NO 1549
atggagatatttttgtgtatttttactcgtaaaatcatactttctttaagcccagtcatctgtgtgaaagggggcggcaaggtattggctacgatgaaggatgttgctgaactcgctcgcgtctcaattgccgtggtttctcgagtgctgaacgaagatcgttccttgtccgttcctgaatccactcgaaaacgggtcatagaagcagcaaatcagctaaattacaaagtacgtcggcggcaaaatagatctgctacgagtaagataaaaacaattgcaattgtcgatttccatccagaagagcaagagcgtgatgacccatatttttggcctatggtgcgtgggatcgagttggagtgtcaggaaaaggggttgatccatcccgttaagttttacgtaaaaacccccgctgaattcagtccaagtgagttgtcgaactttgacggggtgctcgtgatcggtgctgaggaatggtctggttgggacgatttccaccaccccaatgttgtatttctcgatcattgtccaaatgtggctcgttattcatctgtacttcttaatttttctagtgccgtaaaagatgtttttaaccacttttggaggttgggttatcgaacttttgcctacatcggtgggacccgcagattcggcatggatgagcgtgagtccacgttccgcacttgtgtcaagtcaacggtcggtgccgaaccccctgtgtaccacggagactggtcaactggcgggggttatgaggccatgaagcttatgctccaagaaggcgcgccgctcccaagagcgattttcgttgcaagcgatccgatggcgattggggtcatacgggcgctaactgagataggaaagcgggtgcctgaagacgtagctgtggtcgggttcgatgacatcgacatggcggcctatgtcaacccagcgctcaccacaatacgtgtgcagccagaagtcatggggaggataggagtgcggatgctaatgtgcccttatgatccaaacgtaccagttcaggttgtcatgccatatcagctggtcattcgagagagttgcggggcttgtggcagtctggccgccggagggagggacttcggcttatga

SEQ ID NO: 1563 - DNA, 1107 bp, Artificial
  Substituion in SEQ ID NO 1549
atggagatatttttgtgtatttttactcgtaaaatcatactttctttaagcccagtcatctgtgtgaaagggggcggcaaggtattggctacgatgaaggatgttgctgaactcgctcgcgtctcaattgccgtggtttctcgagtgctgaacgaagatcgttccttgtccgttcctgaatccactcgaaaacgggtcatagaagcagcaaatcagctacaatacaaagtaaaacggcggcaaaatagatctgctacgagtaagataaaaacaattgcaattgtcgatttccatccagaagagcaagagcgtgatgacccatatttttggcctatggtgcgtgggatcgagttggagtgtcaggaaaaggggttgatccatcccgttaagttttacgtaaaaacccccgctgaattcagtccaagtgagttgtcgaactttgacggggtgctcgtgatcggtgctgaggaatggtctggttgggacgatttccaccaccccaatgttgtatttctcgatcattgtccaaatgtggctcgttattcatctgtacttcttaatttttctagtgccgtaaaagatgtttttaaccacttttggaggttgggttatcgaacttttgcctacatcggtgggacccgcagattcggcatggatgagcgtgagtccacgttccgcacttgtgtcaagtcaacggtcggtgccgaaccccctgtgtaccacggagactggtcaactggcgggggttatgaggccatgaagcttatgctccaagaaggcgcgccgctcccaagagcgattttcgttgcaagcgatccgatggcgattggggtcatacgggcgctaactgagataggaaagcgggtgcctgaagacgtagctgtggtcgggttcgatgacatcgacatggcggcctatgtcaacccagcgctcaccacaatacgtgtgcagccagaagtcatggggaggataggagtgcggatgctaatgtgcccttatgatccaaacgtaccagttcaggttgtcatgccatatcagctggtcattcgagagagttgcggggcttgtggcagtctggccgccggagggagggacttcggcttatga

SEQ ID NO: 1564 - DNA, 1107 bp, Artificial
  Substituion in SEQ ID NO 1549
atggagatatttttgtgtatttttactcgtaaaatcatactttctttaagcccagtcatctgtgtgaaagggggcggcaaggtattggctacgatgaaggatgttgctgaactcgctcgcgtctcaattgccgtggtttctcgagtgctgaacgaagatcgttccttgtccgttcctgaatccactcgaaaacgggtcatagaagcagcaaatcagctaaattacaaagtaaaacggcggcaaaatagatctgctacgagtaagataaaaacaattgcaattgtcgatttccatccagaagagcaagagcgtgatgacccatatttttggcctatggtgcgtgggatcgagttggagtgtcaggaaaaggggttgatccatcccgttaagttttacgtaaaaacccccgctgaattcagtccaagtgagttgtcgaactttgacggggtgctcgtgatcggtgctgaggaatggtctggttgggaagatttccaccaccccaatgttgtatttctcgatcattgtccaaatgtggctcgttattcatctgtacttcttaatttttctagtgccgtaaaagatgtttttaaccacttttggaggttgggttatcgaacttttgcctacatcggtgggacccgcagattcggcatggatgagcgtgagtccacgttccgcacttgtgtcaagtcaacggtcggtgccgaaccccctgtgtaccacggagactggtcaactggcgggggttatgaggccatgaagcttatgctccaagaaggcgcgccgctcccaagagcgattttcgttgcaagcgatccgatggcgattggggtcatacgggcgctaactgagataggaaagcgggtgcctgaagacgtagctgtggtcgggttcgatgacatcgacatggcggcctatgtcaacccagcgctcaccacaatacgtgtgcagccagaagtcatggggaggataggagtgcggatgctaatgtgcccttatgatccaaacgtaccagttcaggttgtcatgccatatcagctggtcattcgagagagttgcggggcttgtggcagtctggccgccggagggagggacttcggcttatga

SEQ ID NO: 1565 - protein, 213 aa, Alicyclobacillus acidocaldarius
MLSGSAGGETRMPRPSQKDQILAAARRLFSEKGYHGTTIREIAVEAGVLSGSLYAHIESKEDLLFEIADEGAEAFLLAARAVESKWQHPVDRLREGLRAHIRVVADKQESAKVFFHEWRALSDDRRKVIQSKRDRYEAHWRKWIEEGMAQGAVRKADPKFVRLCLLSVANWVYQWYRPGGEFTPEDIAEHFWTLLFNGIGTGQPAACELLGEA

SEQ ID NO: 1566 - DNA, 642 bp, Alicyclobacillus acidocaldarius
ttgctttctggttctgcaggaggggagacgaggatgccgaggccgagtcagaaagaccaaattctcgccgcggcgaggaggctgttcagcgaaaagggatatcatggcacaaccatccgcgaaatcgcggtcgaggcaggagtactctcgggcagcctgtacgcgcatattgaatcgaaagaagacttactattcgaaatcgccgacgaaggggcggaggcgtttctgcttgccgctcgcgctgtcgaatccaagtggcaacatcccgtggatcgcttgcgcgagggactccgggcacacattcgcgttgtcgcggacaaacaggagtcggcaaaggtgttctttcacgagtggcgcgcgctctccgatgaccggcggaaggtgattcagtccaagcgggatcgctacgaagcgcactggcgcaaatggattgaggagggcatggcgcaaggcgccgtgcggaaagcggatccgaaattcgtgcgactgtgcctgctttcggttgcgaactgggtgtatcagtggtatcggccgggaggcgagttcacgccagaagatatcgcggaacacttctggacgctcttgttcaatggaatcggaacgggtcagcccgccgcatgcgaattgctgggcgaggcgtga

SEQ ID NO: 1567 - protein, 188 aa, Symbiobacterium thermophilum IAM 14863
MGRNRRREAMLQAAIGLFSDKGYHATTVREIAQAVGILPGSLYAHMASKEDLLYEAVVQASERFQEAVAPIAESPGHAGERLRQAMAAHIRVVAESPAAATVFLHEWRALSPQRRAMAVAHRRAYEELLARIIREGVESGVFRPVDEKFVRLLVLSAVNWTYQWYRADGPLSPEQVADQFYAIIAGGL

SEQ ID NO: 1568 - protein, 188 aa, Deinococcus geothermalis DSM 11300
PAKTRREQIYDVASRLFSERGYHATSMRDLAGELGMQGGSLYAHISGKEDLLIEIVNRAARQFDAALFTLRDDPRPADHKLREAMYRHIRVVADNMESATVFFHEWKHLSPAAYARVTAWRDTIDTFYRELVRQGIDEGLFRHDLDVKMTANLILSAVNWTYTWYRPGGTLTPRDVAEGYADMLLGGL

SEQ ID NO: 1569 - protein, 193 aa, Deinococcus radiodurans R1
ETTKPRREQIHDVASRLFSERGYHATSMRDLAGQLGMQGGSLYAHISGKEELLVEIVRGASQQFDEALFSLRDVNLPADEKLREAMFRHIQVVADNMDSATVFFHEWKHLSAEPYAQVVAWRDTIDIFYRDLVAQGVRDGTFRADLDVRAAANLILSAVNWTYTWYRPGGRLSPRDVAEQFADMLLSGLMAGE

SEQ ID NO: 1570 - protein, 182 aa, Thermus thermophilus HB27
RRSQILTIAGHLFSRKGYHATSMRELARHLNLQGGSLYAHIQSKEELLLEVVRQAAERFQKVLEELPSGDPVTRMKALVKGHLRVIAEELPRATVFFHEWKHLSPPLLEEAKALRRRYEEGVQAVVEEGVRAGVFRVENVRLATLFVLSALNWTYQWYRPDGPLSLEALAEAYAELVLKALG

SEQ ID NO: 1571 - protein, 182 aa, Thermus thermophilus HB8
RRSQILTIAGHLFSQRGYHATSMRELARHLNLQGGSLYAHIQSKEELLLEVVRQAAERFQKVLEELPSGDPVTRMKALVKGHLRVIAEELPRATVFFHEWKHLSPPLLEEAKALRRRYEEGVQAVVEEGVRAGVFRVENVRLATLFVLSALNWTYQWYRPDGPLSLEALAEAYAELVLKALG

SEQ ID NO: 1572 - protein, 213 aa, Artificial
  Substituion in SEQ ID NO 1565
MLSGSAGGETRMPRPSQKDQILAAARRLFSEKGYHGTTIREIAVEAGVLSGSLYAHIESKEDLLFEIADEGAEAFLLAARAVESKWQHPVDRLREGLRAHIRVVADKQESAKVFFHEWRALSDDRRKVIQSKRDRYEAHWRKWIEEGMAQGAVRKADPKFVRLCLLSVANWIYQWYRPGGEFTPEDIAEHFWTLLFNGIGTGQPAACELLGEA

SEQ ID NO: 1573 - protein, 213 aa, Artificial
  Substituion in SEQ ID NO 1565
MLSGSAGGETRMPRPSQKDQILAAARRLFSEKGYHGTTIREIAVEAGVLSGSLYAHIESKEDLLFEIADEGAEAFLLAARAVESKWQHPVDRLREGLRAHIRVVADKQESAKVFFHEWRALSDDRRKVIQSKRDRYEAHWKKWIEEGMAQGAVRKADPKFVRLCLLSVANWVYQWYRPGGEFTPEDIAEHFWTLLFNGIGTGQPAACELLGEA

SEQ ID NO: 1574 - protein, 213 aa, Artificial
  Substituion in SEQ ID NO 1565
MLSGSAGGETRMPRPSQKDQILAAARRLFSEKGYHGTTIREIAVEAGVLSGSLYAHIESKEDLLFEIADEGAEAFLLAARAVESKWQHPVDRLREGIRAHIRVVADKQESAKVFFHEWRALSDDRRKVIQSKRDRYEAHWRKWIEEGMAQGAVRKADPKFVRLCLLSVANWVYQWYRPGGEFTPEDIAEHFWTLLFNGIGTGQPAACELLGEA

SEQ ID NO: 1575 - protein, 213 aa, Artificial
  Substituion in SEQ ID NO 1565
MLSGSAGGETRMPRPSQKDQILAAARRLFSEKGYHGTTIREIAVEAGVLSGSLYAHIESKEDLLFEIADEGAEAFLLAARAVESKWQHPVDRLREGLRAHIRVVADKQESAKVFFHEWRALSDDRRKVIQSKRDRYEAHWRKWIEDGMAQGAVRKADPKFVRLCLLSVANWVYQWYRPGGEFTPEDIAEHFWTLLFNGIGTGQPAACELLGEA

SEQ ID NO: 1576 - protein, 213 aa, Artificial
  Substituion in SEQ ID NO 1565
MLSGSAGGETRMPRPSQKDQILAAAKRLFSEKGYHGTTIREIAVEAGVLSGSLYAHIESKEDLLFEIADEGAEAFLLAARAVESKWQHPVDRLREGLRAHIRVVADKQESAKVFFHEWRALSDDRRKVIQSKRDRYEAHWRKWIEEGMAQGAVRKADPKFVRLCLLSVANWVYQWYRPGGEFTPEDIAEHFWTLLFNGIGTGQPAACELLGEA

SEQ ID NO: 1577 - DNA, 642 bp, Artificial
  Substituion in SEQ ID NO 1566
ttgctttctggttctgcaggaggggagacgaggatgccgaggccgagtcagaaagaccaaattctcgccgcggcgaggaggctgttcagcgaaaagggatatcatggcacaaccatccgcgaaatcgcggtcgaggcaggagtactctcgggcagcctgtacgcgcatattgaatcgaaagaagacttactattcgaaatcgccgacgaaggggcggaggcgtttctgcttgccgctcgcgctgtcgaatccaagtggcaacatcccgtggatcgcttgcgcgagggactccgggcacacattcgcgttgtcgcggacaaacaggagtcggcaaaggtgttctttcacgagtggcgcgcgctctccgatgaccggcggaaggtgattcagtccaagcgggatcgctacgaagcgcactggcgcaaatggattgaggagggcatggcgcaaggcgccgtgcggaaagcggatccgaaattcgtgcgactgtgcctgctttcggttgcgaactggatttatcagtggtatcggccgggaggcgagttcacgccagaagatatcgcggaacacttctggacgctcttgttcaatggaatcggaacgggtcagcccgccgcatgcgaattgctgggcgaggcgtga

SEQ ID NO: 1578 - DNA, 642 bp, Artificial
  Substituion in SEQ ID NO 1566
ttgctttctggttctgcaggaggggagacgaggatgccgaggccgagtcagaaagaccaaattctcgccgcggcgaggaggctgttcagcgaaaagggatatcatggcacaaccatccgcgaaatcgcggtcgaggcaggagtactctcgggcagcctgtacgcgcatattgaatcgaaagaagacttactattcgaaatcgccgacgaaggggcggaggcgtttctgcttgccgctcgcgctgtcgaatccaagtggcaacatcccgtggatcgcttgcgcgagggactccgggcacacattcgcgttgtcgcggacaaacaggagtcggcaaaggtgttctttcacgagtggcgcgcgctctccgatgaccggcggaaggtgattcagtccaagcgggatcgctacgaagcgcactggaaaaaatggattgaggagggcatggcgcaaggcgccgtgcggaaagcggatccgaaattcgtgcgactgtgcctgctttcggttgcgaactgggtgtatcagtggtatcggccgggaggcgagttcacgccagaagatatcgcggaacacttctggacgctcttgttcaatggaatcggaacgggtcagcccgccgcatgcgaattgctgggcgaggcgtga

SEQ ID NO: 1579 - DNA, 642 bp, Artificial
  Substituion in SEQ ID NO 1566
ttgctttctggttctgcaggaggggagacgaggatgccgaggccgagtcagaaagaccaaattctcgccgcggcgaggaggctgttcagcgaaaagggatatcatggcacaaccatccgcgaaatcgcggtcgaggcaggagtactctcgggcagcctgtacgcgcatattgaatcgaaagaagacttactattcgaaatcgccgacgaaggggcggaggcgtttctgcttgccgctcgcgctgtcgaatccaagtggcaacatcccgtggatcgcttgcgcgagggaattcgggcacacattcgcgttgtcgcggacaaacaggagtcggcaaaggtgttctttcacgagtggcgcgcgctctccgatgaccggcggaaggtgattcagtccaagcgggatcgctacgaagcgcactggcgcaaatggattgaggagggcatggcgcaaggcgccgtgcggaaagcggatccgaaattcgtgcgactgtgcctgctttcggttgcgaactgggtgtatcagtggtatcggccgggaggcgagttcacgccagaagatatcgcggaacacttctggacgctcttgttcaatggaatcggaacgggtcagcccgccgcatgcgaattgctgggcgaggcgtga

SEQ ID NO: 1580 - DNA, 642 bp, Artificial
  Substituion in SEQ ID NO 1566
ttgctttctggttctgcaggaggggagacgaggatgccgaggccgagtcagaaagaccaaattctcgccgcggcgaggaggctgttcagcgaaaagggatatcatggcacaaccatccgcgaaatcgcggtcgaggcaggagtactctcgggcagcctgtacgcgcatattgaatcgaaagaagacttactattcgaaatcgccgacgaaggggcggaggcgtttctgcttgccgctcgcgctgtcgaatccaagtggcaacatcccgtggatcgcttgcgcgagggactccgggcacacattcgcgttgtcgcggacaaacaggagtcggcaaaggtgttctttcacgagtggcgcgcgctctccgatgaccggcggaaggtgattcagtccaagcgggatcgctacgaagcgcactggcgcaaatggattgaggatggcatggcgcaaggcgccgtgcggaaagcggatccgaaattcgtgcgactgtgcctgctttcggttgcgaactgggtgtatcagtggtatcggccgggaggcgagttcacgccagaagatatcgcggaacacttctggacgctcttgttcaatggaatcggaacgggtcagcccgccgcatgcgaattgctgggcgaggcgtga

SEQ ID NO: 1581 - DNA, 642 bp, Artificial
  Substituion in SEQ ID NO 1566
ttgctttctggttctgcaggaggggagacgaggatgccgaggccgagtcagaaagaccaaattctcgccgcggcgaaaaggctgttcagcgaaaagggatatcatggcacaaccatccgcgaaatcgcggtcgaggcaggagtactctcgggcagcctgtacgcgcatattgaatcgaaagaagacttactattcgaaatcgccgacgaaggggcggaggcgtttctgcttgccgctcgcgctgtcgaatccaagtggcaacatcccgtggatcgcttgcgcgagggactccgggcacacattcgcgttgtcgcggacaaacaggagtcggcaaaggtgttctttcacgagtggcgcgcgctctccgatgaccggcggaaggtgattcagtccaagcgggatcgctacgaagcgcactggcgcaaatggattgaggagggcatggcgcaaggcgccgtgcggaaagcggatccgaaattcgtgcgactgtgcctgctttcggttgcgaactgggtgtatcagtggtatcggccgggaggcgagttcacgccagaagatatcgcggaacacttctggacgctcttgttcaatggaatcggaacgggtcagcccgccgcatgcgaattgctgggcgaggcgtga

SEQ ID NO: 1582 - protein, 298 aa, Alicyclobacillus acidocaldarius
MDTELRQLEYFVAVAEELHFGRAAKRLGLTQPPLSQQIQKLEDEIGVTLFDRTNRRVQLTHAGRVLLEEARKVLAHVQTAVKAARDAAAGRVGRLSVAFVGSATYGWLPEVIRAYQERHPDVELVLREMSTPAQMEALTAGELDVGVLRLPAQHPDLHVRLVERDDCVAVVPSEHPLATRSSLFLVELAEEPFVLVSRAIWPGLYDGFITLARALGFEPRVRLEVTEVQTAVGLVAAGLGVSIVPSATERVHRRDVRYLHIDGQSPTVELGVAWRRRDTSPLVAAFLAMAESVRPGLS

SEQ ID NO: 1583 - DNA, 897 bp, Alicyclobacillus acidocaldarius
atggatacggaactgcgccagctcgaatacttcgtggcagtggccgaggaactccacttcggaagggcggccaagcgcctgggtctgacccagcccccgctcagtcagcagattcaaaagcttgaggacgaaattggcgtgaccctgttcgacaggacgaaccggcgcgtgcaactgacgcacgcgggccgcgtgctgctcgaagaagcgcggaaggtgctggcccacgtgcagacggcggtgaaagcggcccgagacgcggccgcgggccgggtgggaaggctgtccgtggcgttcgtgggatctgcgacgtacggttggctacccgaggtcatacgcgcctaccaggaacggcatcccgacgtcgaactcgtgctcagggagatgtccacgccggcgcagatggaggcgctgacggcgggcgagttggacgtgggggtgcttcgactgcccgcgcagcatcccgatcttcacgtccggctcgtcgagcgggacgactgcgtcgccgtggtgccgagcgaacacccgctggcgacgcgatcgtcgctcttcttggtggaactcgcggaggagccgtttgtgctggtgtcgcgcgccatttggccggggctttacgacggtttcatcacgctcgcgcgcgcactggggtttgaaccgcgggtgcggctcgaggtgacggaagtacagacggccgtggggctcgtggcggcggggctcggcgtcagcatcgtcccgagcgccacggagcgcgtgcatcggcgggatgtccgctatctgcacatcgatggccagtcacccacggtcgagctcggcgtggcgtggcgccgccgggacacgtctccgttggtggccgcgtttttggctatggccgagtcggttcgcccggggctgtcgtag

SEQ ID NO: 1584 - protein, 287 aa, Bacillus thuringiensis serovar israelensis ATCC 35646
ELRHLQYFVVVAEELHFGRAAARLQMTQPPLSQQIQQLEKEMGVTLFSRTKRKVELTEAGEMFLKEVKKAFEQIEKAVEVAQSAQRGEVGSLSIGFVGAAIYDILPSIVREYRKKFPRVSVALHELSTPDQVHALHDNRIDIGFLRPPIPTQLLELEPIQRLSCTLCLPKAHPLAEKDEIHIEDLRDEPFVFITRPVWPALYDTILSLCREVGFSPRIVQEATEYQTVMGLVAAGIGITVIPVSANKLYKTEVVYKELYDSNFVAEMSVAYKKMNSNPELLEFLKIA

SEQ ID NO: 1585 - protein, 287 aa, Bacillus cereus subsp. cytotoxis NVH 391-98
ELRHLQYFIVVAEELHFGRAAARLQMTQPPLSQQIQQLEQEMGVMLFERTKRKVELTEAGEMFLKEVKKAFDQIEKAVEVAQSAQRGEVGSLSIGFVGAAIYDILPSIVREYRKKFPRVSVALHELSTPEQVHALHENRIDVGFLRPPISTQLLELEPIQKLPCTLCLPKAHPLAEKEEIHIEDLRDESFVFITRPVWPALYDTILSLCRGVGFSPRIVQEATEYQTVMGLVAAGIGITVIPVSANKLYKTEVVYKDIYDSNFIAEMSVAYRKTNSSPELLEFLKIA

SEQ ID NO: 1586 - protein, 287 aa, Bacillus thuringiensis str. Al Hakam
ELRHLQYFVVVAEELHFGRAAARLQMTQPPLSQQIQQLEKEMGVMLFSRTKRKVELTEAGEMFLKEVKKAFEQIEKAVEIAQSAQRGEVGSLSIGFVGAAIYDILPSIVREYRKKFPRVSVALHELSTPDQVHALHDNRIDIGFLRPPIPTQLLELEPIQKLSCTLCLPKAHPLAEKDEIHIEDLRDEPFVFITRPVWPALYDTILSLCREVGFSPRIVQEATEYQTVMGLVAAGIGITVIPVSANKLYKTEVVYKELYDSNFVAEMSVAYKKMNSNPELLEFLKIA

SEQ ID NO: 1587 - protein, 287 aa, Bacillus anthracis str. Ames; identical to SEQ ID NO: 1586

SEQ ID NO: 1588 - protein, 287 aa, Bacillus cereus AH187
ELRHLQYFVVVAEELHFGRAAARLQMTQPPLSQQIQQLEKEMGVMLFSRTKRKVELTEAGEMFLKEVKKAFEQIEKAVEIAQSAQRGEVGSLSIGFVGAAIYDILPSIVREYRKKFPRVSVALHELSTPDQVHALHDNRIDIGFLRPPIPTQLLELEPIQKLSCTLCLPKAHPLAEKDEIHIEDLRDEPFVFITRPVWPALYDTILSLCRDVGFSPRIVQEATEYQTVMGLVAAGIGITVIPVSANKLYKTEVVYKELYDSNFVAEMSVAYKKMNSNPELLEFLKIA

SEQ ID NO: 1589 - protein, 298 aa, Artificial
  Substituion in SEQ ID NO 1582
MDTELRQLEYFVAVAEELHFGRAAKRLGLTQPPLSQQIQKLEDEIGVTLFDRTNRRVQLTHAGRVLLEEARKVLAHVQTAVKAARDAAAGRVGRLSVAFVGSATYGWLPEVIRAYQERHPDVELVLKEMSTPAQMEALTAGELDVGVLRLPAQHPDLHVRLVERDDCVAVVPSEHPLATRSSLFLVELAEEPFVLVSRAIWPGLYDGFITLARALGFEPRVRLEVTEVQTAVGLVAAGLGVSIVPSATERVHRRDVRYLHIDGQSPTVELGVAWRRRDTSPLVAAFLAMAESVRPGLS

SEQ ID NO: 1590 - protein, 298 aa, Artificial
  Substituion in SEQ ID NO 1582
MDTELRQLEYFVAVAEELHFGRAAKRLGLTQPPLSQQIQKLEDEIGVTLFDRTNRRVQLTHAGRVLLEEARKVLAHVQTAVKAARDAAAGRVGRLSVAFVGSATYGWLPEVIRAYQERHPDVELVLREMSTPAQMEALTAGELDVGVLRLPAQHPDLHVRLVERDDCVAVVPSEHPLATRSSLFLVELAEEPFVLISRAIWPGLYDGFITLARALGFEPRVRLEVTEVQTAVGLVAAGLGVSIVPSATERVHRRDVRYLHIDGQSPTVELGVAWRRRDTSPLVAAFLAMAESVRPGLS

SEQ ID NO: 1591 - protein, 298 aa, Artificial
  Substituion in SEQ ID NO 1582
MDTELRQLEYFVAVAEELHFGRAAKRLGLTQPPLSQQIQKLEDEIGVTLFDRTNRRVQLTHAGRVLLEEARKVLAHVQTAVKAARDAAAGRVGRLSVAFVGSATYGWLPEVIRAYQERHPDVELVLREMSTPAQMEALTAGELDVGVLRLPAQHPDLHVRLVERDECVAVVPSEHPLATRSSLFLVELAEEPFVLVSRAIWPGLYDGFITLARALGFEPRVRLEVTEVQTAVGLVAAGLGVSIVPSATERVHRRDVRYLHIDGQSPTVELGVAWRRRDTSPLVAAFLAMAESVRPGLS

SEQ ID NO: 1592 - protein, 298 aa, Artificial
  Substituion in SEQ ID NO 1582
MDTELRQLEYFVAVAEELHFGRAAKRLGLTQPPLSQQIQKLEDEIGVTLFDRTNRRVQLTHAGRVLLEEARKVLAHVQTAVKAARDAAAGRVGRLSVAFVGSATYGWLPEVIRAYQERHPDVELILREMSTPAQMEALTAGELDVGVLRLPAQHPDLHVRLVERDDCVAVVPSEHPLATRSSLFLVELAEEPFVLVSRAIWPGLYDGFITLARALGFEPRVRLEVTEVQTAVGLVAAGLGVSIVPSATERVHRRDVRYLHIDGQSPTVELGVAWRRRDTSPLVAAFLAMAESVRPGLS

SEQ ID NO: 1593 - protein, 298 aa, Artificial
  Substituion in SEQ ID NO 1582
MDTELRQLEYFVAVAEELHFGRAAKRLGLTQPPLSQQIQKLEDEIGVTLFDRTNRRVQLTHAGRVLLEEARKVLAHVQTAVKAARDAAAGRVGRLSVAFVGSATYGWLPEVIRAYQERHPDVELVLREMSTPAQMEALTAGELDVGVLRLPAQHPDLHVRLVERDDCVAVVPSDHPLATRSSLFLVELAEEPFVLVSRAIWPGLYDGFITLARALGFEPRVRLEVTEVQTAVGLVAAGLGVSIVPSATERVHRRDVRYLHIDGQSPTVELGVAWRRRDTSPLVAAFLAMAESVRPGLS

SEQ ID NO: 1594 - DNA, 897 bp, Artificial
  Substituion in SEQ ID NO 1583
atggatacggaactgcgccagctcgaatacttcgtggcagtggccgaggaactccacttcggaagggcggccaagcgcctgggtctgacccagcccccgctcagtcagcagattcaaaagcttgaggacgaaattggcgtgaccctgttcgacaggacgaaccggcgcgtgcaactgacgcacgcgggccgcgtgctgctcgaagaagcgcggaaggtgctggcccacgtgcagacggcggtgaaagcggcccgagacgcggccgcgggccgggtgggaaggctgtccgtggcgttcgtgggatctgcgacgtacggttggctacccgaggtcatacgcgcctaccaggaacggcatcccgacgtcgaactcgtgctcaaagagatgtccacgccggcgcagatggaggcgctgacggcgggcgagttggacgtgggggtgcttcgactgcccgcgcagcatcccgatcttcacgtccggctcgtcgagcgggacgactgcgtcgccgtggtgccgagcgaacacccgctggcgacgcgatcgtcgctcttcttggtggaactcgcggaggagccgtttgtgctggtgtcgcgcgccatttggccggggctttacgacggtttcatcacgctcgcgcgcgcactggggtttgaaccgcgggtgcggctcgaggtgacggaagtacagacggccgtggggctcgtggcggcggggctcggcgtcagcatcgtcccgagcgccacggagcgcgtgcatcggcgggatgtccgctatctgcacatcgatggccagtcacccacggtcgagctcggcgtggcgtggcgccgccgggacacgtctccgttggtggccgcgtttttggctatggccgagtcggttcgcccggggctgtcgtag

SEQ ID NO: 1595 - DNA, 897 bp, Artificial
  Substituion in SEQ ID NO 1583
atggatacggaactgcgccagctcgaatacttcgtggcagtggccgaggaactccacttcggaagggcggccaagcgcctgggtctgacccagcccccgctcagtcagcagattcaaaagcttgaggacgaaattggcgtgaccctgttcgacaggacgaaccggcgcgtgcaactgacgcacgcgggccgcgtgctgctcgaagaagcgcggaaggtgctggcccacgtgcagacggcggtgaaagcggcccgagacgcggccgcgggccgggtgggaaggctgtccgtggcgttcgtgggatctgcgacgtacggttggctacccgaggtcatacgcgcctaccaggaacggcatcccgacgtcgaactcgtgctcagggagatgtccacgccggcgcagatggaggcgctgacggcgggcgagttggacgtgggggtgcttcgactgcccgcgcagcatcccgatcttcacgtccggctcgtcgagcgggacgactgcgtcgccgtggtgccgagcgaacacccgctggcgacgcgatcgtcgctcttcttggtggaactcgcggaggagccgtttgtgctgatttcgcgcgccatttggccggggctttacgacggtttcatcacgctcgcgcgcgcactggggtttgaaccgcgggtgcggctcgaggtgacggaagtacagacggccgtggggctcgtggcggcggggctcggcgtcagcatcgtcccgagcgccacggagcgcgtgcatcggcgggatgtccgctatctgcacatcgatggccagtcacccacggtcgagctcggcgtggcgtggcgccgccgggacacgtctccgttggtggccgcgtttttggctatggccgagtcggttcgcccggggctgtcgtag

SEQ ID NO: 1596 - DNA, 897 bp, Artificial
  Substituion in SEQ ID NO 1583
atggatacggaactgcgccagctcgaatacttcgtggcagtggccgaggaactccacttcggaagggcggccaagcgcctgggtctgacccagcccccgctcagtcagcagattcaaaagcttgaggacgaaattggcgtgaccctgttcgacaggacgaaccggcgcgtgcaactgacgcacgcgggccgcgtgctgctcgaagaagcgcggaaggtgctggcccacgtgcagacggcggtgaaagcggcccgagacgcggccgcgggccgggtgggaaggctgtccgtggcgttcgtgggatctgcgacgtacggttggctacccgaggtcatacgcgcctaccaggaacggcatcccgacgtcgaactcgtgctcagggagatgtccacgccggcgcagatggaggcgctgacggcgggcgagttggacgtgggggtgcttcgactgcccgcgcagcatcccgatcttcacgtccggctcgtcgagcgggacgaatgcgtcgccgtggtgccgagcgaacacccgctggcgacgcgatcgtcgctcttcttggtggaactcgcggaggagccgtttgtgctggtgtcgcgcgccatttggccggggctttacgacggtttcatcacgctcgcgcgcgcactggggtttgaaccgcgggtgcggctcgaggtgacggaagtacagacggccgtggggctcgtggcggcggggctcggcgtcagcatcgtcccgagcgccacggagcgcgtgcatcggcgggatgtccgctatctgcacatcgatggccagtcacccacggtcgagctcggcgtggcgtggcgccgccgggacacgtctccgttggtggccgcgtttttggctatggccgagtcggttcgcccggggctgtcgtag

SEQ ID NO: 1597 - DNA, 897 bp, Artificial
  Substituion in SEQ ID NO 1583
atggatacggaactgcgccagctcgaatacttcgtggcagtggccgaggaactccacttcggaagggcggccaagcgcctgggtctgacccagcccccgctcagtcagcagattcaaaagcttgaggacgaaattggcgtgaccctgttcgacaggacgaaccggcgcgtgcaactgacgcacgcgggccgcgtgctgctcgaagaagcgcggaaggtgctggcccacgtgcagacggcggtgaaagcggcccgagacgcggccgcgggccgggtgggaaggctgtccgtggcgttcgtgggatctgcgacgtacggttggctacccgaggtcatacgcgcctaccaggaacggcatcccgacgtcgaactcattctcagggagatgtccacgccggcgcagatggaggcgctgacggcgggcgagttggacgtgggggtgcttcgactgcccgcgcagcatcccgatcttcacgtccggctcgtcgagcgggacgactgcgtcgccgtggtgccgagcgaacacccgctggcgacgcgatcgtcgctcttcttggtggaactcgcggaggagccgtttgtgctggtgtcgcgcgccatttggccggggctttacgacggtttcatcacgctcgcgcgcgcactggggtttgaaccgcgggtgcggctcgaggtgacggaagtacagacggccgtggggctcgtggcggcggggctcggcgtcagcatcgtcccgagcgccacggagcgcgtgcatcggcgggatgtccgctatctgcacatcgatggccagtcacccacggtcgagctcggcgtggcgtggcgccgccgggacacgtctccgttggtggccgcgtttttggctatggccgagtcggttcgcccggggctgtcgtag

SEQ ID NO: 1598 - DNA, 897 bp, Artificial
  Substituion in SEQ ID NO 1583
atggatacggaactgcgccagctcgaatacttcgtggcagtggccgaggaactccacttcggaagggcggccaagcgcctgggtctgacccagcccccgctcagtcagcagattcaaaagcttgaggacgaaattggcgtgaccctgttcgacaggacgaaccggcgcgtgcaactgacgcacgcgggccgcgtgctgctcgaagaagcgcggaaggtgctggcccacgtgcagacggcggtgaaagcggcccgagacgcggccgcgggccgggtgggaaggctgtccgtggcgttcgtgggatctgcgacgtacggttggctacccgaggtcatacgcgcctaccaggaacggcatcccgacgtcgaactcgtgctcagggagatgtccacgccggcgcagatggaggcgctgacggcgggcgagttggacgtgggggtgcttcgactgcccgcgcagcatcccgatcttcacgtccggctcgtcgagcgggacgactgcgtcgccgtggtgccgagcgatcacccgctggcgacgcgatcgtcgctcttcttggtggaactcgcggaggagccgtttgtgctggtgtcgcgcgccatttggccggggctttacgacggtttcatcacgctcgcgcgcgcactggggtttgaaccgcgggtgcggctcgaggtgacggaagtacagacggccgtggggctcgtggcggcggggctcggcgtcagcatcgtcccgagcgccacggagcgcgtgcatcggcgggatgtccgctatctgcacatcgatggccagtcacccacggtcgagctcggcgtggcgtggcgccgccgggacacgtctccgttggtggccgcgtttttggctatggccgagtcggttcgcccggggctgtcgtag

SEQ ID NO: 1599 - protein, 217 aa, Alicyclobacillus acidocaldarius
MYIPRSFELKDAQLIETVLREHSFAVLVTSVGEDIMATHVPLVYDPAEAALFGHLARANPQAKHLHEAQCLAVFQGPHAYVSPAWYGLADQVPTWNYIAVHVYGRARVIEDEEAVADLLQRLLLTYDPQSPLPADRDRPYYRNLMRGIVAFRIDIARIKAAAKLSQNKPLEVRARVVEALESQDDANSRAVAAWMRRLKLTHLGDDDGNESKPKGAS

SEQ ID NO: 1600 - DNA, 654 bp, Alicyclobacillus acidocaldarius
atgtatatcccgagatcctttgaactcaaggatgcgcagcttatcgaaaccgttctgcgcgagcacagctttgcggtactcgtgacctcggtcggcgaagacatcatggcgacccacgtccctctcgtctacgatccggccgaggcggcgctcttcggacacctggcgcgggccaatccccaggccaagcatcttcacgaggcacagtgcctggccgtctttcagggaccgcacgcctacgtctcacccgcctggtacggacttgctgatcaagtgccgacgtggaactacatcgccgtccacgtgtacggccgcgcgcgcgtgatcgaagatgaggaagccgtcgcggatcttttgcagcgccttctcctcacgtacgatccgcagtccccgctgcccgccgaccgcgatcgcccgtactatcgaaacctgatgcgcggcatcgtcgcctttcgcatcgacatcgcgcgcatcaaggcggcggcgaaactcagccagaacaagccgctcgaggttcgagcgcgcgtcgtggaagcgcttgagtcgcaggacgacgccaattcgcgcgctgtcgccgcttggatgcggcgcctgaagcttacccacctcggcgacgacgacgggaacgaatccaaaccgaagggagcctcctga

SEQ ID NO: 1601 - protein, 198 aa, Bacillus cereus G9241
MYIPKYFAIQDEEVKYEIIEQNSFAILFSQHNEESYATHLPLLLNRETLTLHGHFARPNDQWKDSGNQQVLAIFQGPHSYISPSWYETNNAVPTWNYVAVHVYGELEIVEDEQELIDSLQKLVYKYEDPKSTYSLNDVDPNYMTGLSKGIVGFKIKINKIEGKAKLSQNHSVERRKLVVEKLEKVGSEGSREIAELMR

SEQ ID NO: 1602 - protein, 202 aa, Bacillus halodurans C-125
MYIPKAFHVDDVNELITFIRNHSFGIMVSQTEEEPFATHLPFLLDEQKGENGVLISHLARANPHWQGLQDQKVLVVFQGPHAYISPTWYDEPRTVPTWNYVAVHVYGTFRQIQDKHKVKEWIEKTVNVYEQTMNPPWEAVFDEPFMEGLLNGIVAFEIEVERMEGNWKLNQNHPIERQERVVKKLKSINEPNAQKMAELMEK

SEQ ID NO: 1603 - protein, 199 aa, Bacillus anthracis str. Ames
MYIPKYFAIQDEKMKYEIMEQNSFATLFSQHNGEPYATHLPLLLNRETLTLHGHFARPNEQWKDIGTQQVLAIFQGPHSYISPSWYETKNAVPTWNYVAVHVYGELELVEDEQELIDSLQDLVDTYEDPQSTYSLNDVDPNYMEGLSKGIVGFKIKISKIEGKAKLSQNHSVARRKLVVEELEKVGSEGSRGIAELMRK

SEQ ID NO: 1604 - protein, 199 aa, Bacillus cereus AH820
MYIPKYFAIQDEKMKYEIMEQNSFATLFSQHNGEPYATHLPLLLNRETLTLHGHFARPNEQWKDIGTQQVLAIFQGPHSYISPSWYETKNAVPTWNYVAVHVYGELELVEDEQELIDSLQDLVDTYEDPQSTYSLNDVDPNYMEGLSKGIVGFKIKISKIEGKAKLSQNHSVARRKLVVEELEKVGSEGSRGIVELMRK

SEQ ID NO: 1605 - protein, 201 aa, Bacillus cereus AH187
MYIPKYFAIQDEEMKYEIMEQNSFATLFSQHNGEPYATHLPLLLNRETLTLHGHFARPNEQWKDIGNQQVLAIFQGPHSYISPSWYETNNAVPTWNYVAVHVYGELKFVEDEQELIDSLQELVHKYEDPESAYSLNDVDPNYMGGLSKGIVGFKVKINKIEGKAKLSQNHSVERRNLVVEKLEKVGSEGSKGIAELMKETK

SEQ ID NO: 1606 - protein, 217 aa, Artificial
  Substituion in SEQ ID NO 1599
MYIPRSFELKDAQLIETVLREHSFAVLVTSVGEDIMATHVPLVYDPAEAALFGHLARANPQAKHLHEAQCLAVFQGPHAYVSPAWYGLADQVPTWNYIAVHVYGRARVIEDEEAVADILQRLLLTYDPQSPLPADRDRPYYRNLMRGIVAFRIDIARIKAAAKLSQNKPLEVRARVVEALESQDDANSRAVAAWMRRLKLTHLGDDDGNESKPKGAS

SEQ ID NO: 1607 - protein, 217 aa, Artificial
  Substituion in SEQ ID NO 1599
MYIPRSFELKDAQLIETVLREHSFAVLVTSVGEDIMATHVPLIYDPAEAALFGHLARANPQAKHLHEAQCLAVFQGPHAYVSPAWYGLADQVPTWNYIAVHVYGRARVIEDEEAVADLLQRLLLTYDPQSPLPADRDRPYYRNLMRGIVAFRIDIARIKAAAKLSQNKPLEVRARVVEALESQDDANSRAVAAWMRRLKLTHLGDDDGNESKPKGAS

SEQ ID NO: 1608 - protein, 217 aa, Artificial
  Substituion in SEQ ID NO 1599
MYIPRSFELKDAQLIETVLREHSFAVLVTSVGEDIMATHVPLVYDPAEAALFGHLARANPQAKHLHEAQCLAVFQGPHAYVSPAWYGIADQVPTWNYIAVHVYGRARVIEDEEAVADLLQRLLLTYDPQSPLPADRDRPYYRNLMRGIVAFRIDIARIKAAAKLSQNKPLEVRARVVEALESQDDANSRAVAAWMRRLKLTHLGDDDGNESKPKGAS

SEQ ID NO: 1609 - protein, 217 aa, Artificial
  Substituion in SEQ ID NO 1599
MYIPRSFELKDAQLIETVLREHSFAVLVTSVGEDIMATHVPLVYDPAEAALFGHLARANPQAKHLHEAQCLAVFQGPHAYVSPAWYGLADQVPTWNYIAVHVYGRARVIEDEEAVADLLQRLLLTYDPQSPLPADRDRPYYRQLMRGIVAFRIDIARIKAAAKLSQNKPLEVRARVVEALESQDDANSRAVAAWMRRLKLTHLGDDDGNESKPKGAS

SEQ ID NO: 1610 - protein, 217 aa, Artificial
  Substituion in SEQ ID NO 1599
MYIPRSFELKDAQLIETVLREHSFAVLVTSVGEDIMATHVPLVYDPAEAALFGHLARANPQAKHLHEAQCLAVFQGPHAYVSPAWYGLADQVPTWNYIAVHVYGRARVIEDEEAVADLLQRLLLTYDPQSPLPADRDRPYYRNLMRGIVAFRIDIARIKAAAKLSQNKPLDVRARVVEALESQDDANSRAVAAWMRRLKLTHLGDDDGNESKPKGAS

SEQ ID NO: 1611 - DNA, 654 bp, Artificial
  Substituion in SEQ ID NO 1600
atgtatatcccgagatcctttgaactcaaggatgcgcagcttatcgaaaccgttctgcgcgagcacagctttgcggtactcgtgacctcggtcggcgaagacatcatggcgacccacgtccctctcgtctacgatccggccgaggcggcgctcttcggacacctggcgcgggccaatccccaggccaagcatcttcacgaggcacagtgcctggccgtctttcagggaccgcacgcctacgtctcacccgcctggtacggacttgctgatcaagtgccgacgtggaactacatcgccgtccacgtgtacggccgcgcgcgcgtgatcgaagatgaggaagccgtcgcggatattttgcagcgccttctcctcacgtacgatccgcagtccccgctgcccgccgaccgcgatcgcccgtactatcgaaacctgatgcgcggcatcgtcgcctttcgcatcgacatcgcgcgcatcaaggcggcggcgaaactcagccagaacaagccgctcgaggttcgagcgcgcgtcgtggaagcgcttgagtcgcaggacgacgccaattcgcgcgctgtcgccgcttggatgcggcgcctgaagcttacccacctcggcgacgacgacgggaacgaatccaaaccgaagggagcctcctga

SEQ ID NO: 1612 - DNA, 654 bp, Artificial
  Substituion in SEQ ID NO 1600
atgtatatcccgagatcctttgaactcaaggatgcgcagcttatcgaaaccgttctgcgcgagcacagctttgcggtactcgtgacctcggtcggcgaagacatcatggcgacccacgtccctctcatttacgatccggccgaggcggcgctcttcggacacctggcgcgggccaatccccaggccaagcatcttcacgaggcacagtgcctggccgtctttcagggaccgcacgcctacgtctcacccgcctggtacggacttgctgatcaagtgccgacgtggaactacatcgccgtccacgtgtacggccgcgcgcgcgtgatcgaagatgaggaagccgtcgcggatcttttgcagcgccttctcctcacgtacgatccgcagtccccgctgcccgccgaccgcgatcgcccgtactatcgaaacctgatgcgcggcatcgtcgcctttcgcatcgacatcgcgcgcatcaaggcggcggcgaaactcagccagaacaagccgctcgaggttcgagcgcgcgtcgtggaagcgcttgagtcgcaggacgacgccaattcgcgcgctgtcgccgcttggatgcggcgcctgaagcttacccacctcggcgacgacgacgggaacgaatccaaaccgaagggagcctcctga

SEQ ID NO: 1613 - DNA, 654 bp, Artificial
  Substituion in SEQ ID NO 1600
atgtatatcccgagatcctttgaactcaaggatgcgcagcttatcgaaaccgttctgcgcgagcacagctttgcggtactcgtgacctcggtcggcgaagacatcatggcgacccacgtccctctcgtctacgatccggccgaggcggcgctcttcggacacctggcgcgggccaatccccaggccaagcatcttcacgaggcacagtgcctggccgtctttcagggaccgcacgcctacgtctcacccgcctggtacggaattgctgatcaagtgccgacgtggaactacatcgccgtccacgtgtacggccgcgcgcgcgtgatcgaagatgaggaagccgtcgcggatcttttgcagcgccttctcctcacgtacgatccgcagtccccgctgcccgccgaccgcgatcgcccgtactatcgaaacctgatgcgcggcatcgtcgcctttcgcatcgacatcgcgcgcatcaaggcggcggcgaaactcagccagaacaagccgctcgaggttcgagcgcgcgtcgtggaagcgcttgagtcgcaggacgacgccaattcgcgcgctgtcgccgcttggatgcggcgcctgaagcttacccacctcggcgacgacgacgggaacgaatccaaaccgaagggagcctcctga

SEQ ID NO: 1614 - DNA, 654 bp, Artificial
  Substituion in SEQ ID NO 1600
atgtatatcccgagatcctttgaactcaaggatgcgcagcttatcgaaaccgttctgcgcgagcacagctttgcggtactcgtgacctcggtcggcgaagacatcatggcgacccacgtccctctcgtctacgatccggccgaggcggcgctcttcggacacctggcgcgggccaatccccaggccaagcatcttcacgaggcacagtgcctggccgtctttcagggaccgcacgcctacgtctcacccgcctggtacggacttgctgatcaagtgccgacgtggaactacatcgccgtccacgtgtacggccgcgcgcgcgtgatcgaagatgaggaagccgtcgcggatcttttgcagcgccttctcctcacgtacgatccgcagtccccgctgcccgccgaccgcgatcgcccgtactatcgacaactgatgcgcggcatcgtcgcctttcgcatcgacatcgcgcgcatcaaggcggcggcgaaactcagccagaacaagccgctcgaggttcgagcgcgcgtcgtggaagcgcttgagtcgcaggacgacgccaattcgcgcgctgtcgccgcttggatgcggcgcctgaagcttacccacctcggcgacgacgacgggaacgaatccaaaccgaagggagcctcctga

SEQ ID NO: 1615 - DNA, 654 bp, Artificial
  Substituion in SEQ ID NO 1600
atgtatatcccgagatcctttgaactcaaggatgcgcagcttatcgaaaccgttctgcgcgagcacagctttgcggtactcgtgacctcggtcggcgaagacatcatggcgacccacgtccctctcgtctacgatccggccgaggcggcgctcttcggacacctggcgcgggccaatccccaggccaagcatcttcacgaggcacagtgcctggccgtctttcagggaccgcacgcctacgtctcacccgcctggtacggacttgctgatcaagtgccgacgtggaactacatcgccgtccacgtgtacggccgcgcgcgcgtgatcgaagatgaggaagccgtcgcggatcttttgcagcgccttctcctcacgtacgatccgcagtccccgctgcccgccgaccgcgatcgcccgtactatcgaaacctgatgcgcggcatcgtcgcctttcgcatcgacatcgcgcgcatcaaggcggcggcgaaactcagccagaacaagccgctcgatgttcgagcgcgcgtcgtggaagcgcttgagtcgcaggacgacgccaattcgcgcgctgtcgccgcttggatgcggcgcctgaagcttacccacctcggcgacgacgacgggaacgaatccaaaccgaagggagcctcctga

SEQ ID NO: 1616 - protein, 370 aa, Alicyclobacillus acidocaldarius
MLAEHDRAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRLYLESQKLWSESDEAKLQDEVKARVEAAVEEALSIAPPDMEMMFDHVYAEEPWHLAAEREEYRRTREGVSV

SEQ ID NO: 1617 - DNA, 1113 bp, Alicyclobacillus acidocaldarius
atgttggccgaacacgatcgggcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 1618 - protein, 351 aa, Paenibacillus larvae subsp. larvae BRL-230010
EKEEMAMKHDKLHGLQEPYQVLKPDGELRHRIGGEVDEALMIKMYENMMHVRMFDRKAVNLQRQGRIGTYAPYEGQEAAQVGSAMALSPEDWLFPSYRDHAATITHGQSLSRVLLYWMGHMEGSVSPEGLKIMPPCVPIATQLVHAVGTSWAAKLKGEKQASIAYFGEGATSEGDFHEALNFAGVYQTATIFFCQNNGYAISVPFHAQSASRTIAQRAAAYDIVGVRVDGNDIFAVWLTVREAIKRGLAGGGPTLVEAVTFRYGAHTTSDDPRKYRDQERLASEWREQRDPVHRLRLFLQKRGLWNEKDEERMLERLTGLIEDAVSEAESYPKSRPADMFKHVFADVPWSI

SEQ ID NO: 1619 - protein, 337 aa, Bacillus sp. UTB2301
EHQFPKIQIVDENGNIVDSKYEDKLTPEFIKELYERLMFVRTFDRKAISLQRQGRLGTYAPFEGQEAAQVGSALALEKDDWLFPTYRDHAATITFGHKLSTVFLYWNGRVEGCVPPEGKKIFPPAVPIATQLPHATGAAMAEKYKGTKNAAIVYFGDGATSEGDFHEGLNFASVFKAPVVFFNQNNSFAISVPIHKQMNSKTIAQKSVAYGIPGIRLDGNDIFAVYFYTKEALDRARNGEGPTLIEAVTWRYGAHTTADDPTKYRNQEESLERREKYDPILRVERLMKNKGIWDEKWAASVEEKASQTIEEAVKEMEAFPAPDVNDLFDHVFEKPTW

SEQ ID NO: 1620 - protein, 311 aa, Bacillus halodurans C-125
VLSMYKQMINCREFDEKALKLQRQGRIGTYASFKGQEACQIGGALALRPTDWLFPTYRDHAAISTHGQPWHRIFLYWMGHMDGSLSPDDRNILPPAVPIATQMLHAVGTAWADKLKGNPHVSLVFFGDGATSEGDFHEALNFAGVYQTPTIFFCQNNGYAISVPFEKQSASKTIKQRSVAYDMRGERVDGNDIFAVYLTVKRAIEQARKGRGPTLIEAVTTRFGSHTTADDAKKYRDQEEIERTWKEMQDPLTRLKAYIQAKGWLSEEEEAQMKAKIRETIDEELSMAEQYPKPSISQMFEHVYENQPWYV

SEQ ID NO: 1621 - protein, 332 aa, Geobacillus thermodenitrificans NG80-2
VLNEEGTVVQPEYRERITKELTMVMYRHLIRTRTFDRKCVSLQRQGRIGTYVPYEGQEACQVGSALALNDEDWMFPTYRDHGAMMTFGRSLVNTLLYWKGRTEGCVPPEGKKIVPPSVPIATQLPHAAGAACAEKWKGTKNAVIVYFGDGATSEGDFHEGLNFASVFNAPVVFFNQNNQYAISVPITRQMRSKTIAQKALAYDIPGVRIDGNDVFAVYFQTAEALERARHGGGPTLIEAVTWRYGAHTTSDDPSRYRDQEESKKRRETTDPIKRVVRLMQREGWWNEQWANQVQEEVNAEIEQAVAEMERYPKANASDMFDYVFAEPTWTIA

SEQ ID NO: 1622 - protein, 329 aa, Bacillus sp. NRRL B-14911
MIDENGNEVSGTSGFDTELALEFYRQLVRIRVFDRKAVSLQRQGRIGTYAPFEGQEAAQIGSAMALEESDWMFPTYRDHGAALAFGHSMRNVLLFWNGRNEGCIPPEGKNIFPPGIPIATQIPHAAGAAYAEKRKGTKKAAIVYFGDGATSEGDFHEGLNFASIVKAPVVFFNQNNQYAISVPLSKQMNTKTIAQKSLAYDIPGVRVDGNDVFAVYRETKKALERAREGGGPTLIEAVTWRYGAHTTADDPAKYRDQQESSVLRGKIDPILRMERWLKNKDLYDENWAKRAESEAAAEIDLAIAEMEAYPPADPADIFDHVFAELIWPL

SEQ ID NO: 1623 - protein, 370 aa, Artificial
  Substituion in SEQ ID NO 1616
MLAEHDRAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLKLYLESQKLWSESDEAKLQDEVKARVEAAVEEALSIAPPDMEMMFDHVYAEEPWHLAAEREEYRRTREGVSV

SEQ ID NO: 1624 - protein, 370 aa, Artificial
  Substituion in SEQ ID NO 1616
MLAEHDRAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKDARSRALHGLGPTLIEAVTFRMGAHTTADDPTRYRDQKAVVEAWQKRDPIVRLRLYLESQKLWSESDEAKLQDEVKARVEAAVEEALSIAPPDMEMMFDHVYAEEPWHLAAEREEYRRTREGVSV

SEQ ID NO: 1625 - protein, 370 aa, Artificial
  Substituion in SEQ ID NO 1616
MLAEHDRAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGKHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRLYLESQKLWSESDEAKLQDEVKARVEAAVEEALSIAPPDMEMMFDHVYAEEPWHLAAEREEYRRTREGVSV

SEQ ID NO: 1626 - protein, 370 aa, Artificial
  Substituion in SEQ ID NO 1616
MLAEHDRAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRLYLESQKLWSESDEAKLQDEVKARVEAAVEEALSLAPPDMEMMFDHVYAEEPWHLAAEREEYRRTREGVSV

SEQ ID NO: 1627 - protein, 370 aa, Artificial
  Substituion in SEQ ID NO 1616
MLAEHDKAERLMEIAKAEGLYEEIHLLKEDGTLAGAVDDIPPEVMVAMYRHMVFARAFDRKAIALQRQGRIGTYAPFEGQEAAQVASAMALAPEDFVFPSYRDHAATMVLGQSPANVLLYWSGRVEGIRSPEGRHILPPSVPIATHVLHAVGAAWASRYRKESAVSIAYFGDGATSEGDFHEALNFAGVFHLPVLFFCQNNGYAISVPFSRQSASRTIAQRAIAYDIVGVRVDGNDAFAVYRAVKEARSRALHGLGPTLIEAVTFRMGAHTTADDPTRYRDQKAVVEAWQKRDPIVRLRLYLESQKLWSESDEAKLQDEVKARVEAAVEEALSIAPPDMEMMFDHVYAEEPWHLAAEREEYRRTREGVSV

SEQ ID NO: 1628 - DNA, 1113 bp, Artificial
  Substituion in SEQ ID NO 1617
atgttggccgaacacgatcgggcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgaaactgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 1629 - DNA, 1113 bp, Artificial
  Substituion in SEQ ID NO 1617
atgttggccgaacacgatcgggcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggatgccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 1630 - DNA, 1113 bp, Artificial
  Substituion in SEQ ID NO 1617
atgttggccgaacacgatcgggcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaaacatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 1631 - DNA, 1113 bp, Artificial
  Substituion in SEQ ID NO 1617
atgttggccgaacacgatcgggcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccttagcgccgcccgacatggagatgatgttcgatcacgtttacgcggaagagccctggcacctcgccgccgagcgcgaggagtaccgcaggacccgcgagggggtatccgtatga

SEQ ID NO: 1632 - DNA, 1113 bp, Artificial
  Substituion in SEQ ID NO 1617
atgttggccgaacacgataaagcagagcggctcatggaaatcgccaaggcggaagggctgtacgaggagattcacctcctgaaggaggacggcacgctggcgggtgcggtggacgacatcccgccggaggtcatggtggcgatgtaccgccacatggtgttcgcccgcgcgtttgaccggaaggccatcgcgcttcagcggcaggggcggattggcacttacgcgccgttcgagggccaggaggccgcgcaggtggcgagcgccatggcgctcgcgccggaggacttcgtgttcccgtcgtatcgcgatcacgccgccacgatggtgctcgggcagtcgcccgcgaacgtgcttctctactggtcggggcgcgtggagggcatccggagcccggagggcaggcatatcctcccacccagcgtgccgattgcgacgcacgtgttgcacgccgttggtgccgcctgggccagccggtatcgcaaggagagcgcggtcagtatcgcgtacttcggcgacggcgcgacgagcgaaggcgactttcacgaggcgctgaatttcgcaggcgtcttccacctgccggtccttttcttctgccaaaataacgggtacgccatcagcgtgccgttctctcgccagtccgcatctcgcaccatcgcgcagcgggcgattgcgtacgacatcgtgggcgtgcgcgtggacggcaacgacgcgttcgcggtgtaccgcgccgtgaaggaggccaggtcgcgcgcgctccacggcctcgggccgacgctcatcgaggcggtgaccttccgcatgggcgcccacaccacagcggacgatccgacgcgctaccgcgatcagaaggcggtcgtggaagcgtggcagaaacgggatccgattgtgcgcctgcgcctgtacctcgagtcgcaaaagctttggtcggaatccgacgaggcgaagctccaggatgaggtgaaggcgcgggtggaggcggctgtggaggaggcgctctccatcgcgccgcccgacatggagatgatgttcgatcacgtttacgcggaagagccctggcacctcgccgccgagcgcgaggagtaccgcaggacccgcgagggggtatccgtatga

SEQ ID NO: 1633 - protein, 327 aa, Alicyclobacillus acidocaldarius
MSRMLNLVQAINEALDLKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYLRAPIKRIAGFDVPVPFFALEDEYMPTEARIRAGIEETITF

SEQ ID NO: 1634 - DNA, 984 bp, Alicyclobacillus acidocaldarius
atgagcaggatgttgaacctggtccaagccatcaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 1635 - protein, 327 aa, Paenibacillus larvae subsp. larvae BRL-230010
MSRSLTILQAVTEALDQKLAHDHRVVLLGEDIGVNGGVFRATDGLFVKYGEERVLDTPLAESGIIGSAIGFALNGLLPVIEIQFLAFIYPGFEQLVSHAARMRYRTRGQFSVPIVIRTPYGTGIRGPELHSDSIEAFFVHTPGIKVAVPSNPYDAKGLLISAIEDPDPVIFLEPAQIYRAFKTKVPEDMYRVPLGKASIVQEGNDVTIISWGAMMRVALTAAQQMERENGWSCEVIDLRSLYPLDRDTIVASVQKTGRALIVHEAHKTAGVGAEIISLINEEALMYLRAPVKRITGFDVPVPQFSLENFYVPTVKRVKDGIADTIRF

SEQ ID NO: 1636 - protein, 326 aa, Bacillus halodurans C-125
SQQQTMLQAINQTLDDLLATNDDVMLLGEDIGINGGVFRATDGLYEKYGKDRVVDTPLAESGIIGSAIGLAMNGKRPIVEIQFLAFIYPGFEQLISHAARMRYRTRGQYNVPMVIRTPYGAGIRGPELHSESVEAFFAHTPGLKVVAPSNPYDAKGLLTAATSDPDPVIFLEDTKLYRAFKEDVPNTLYEIPLGQAKVVQEGEDVTVIAWGGMVREALQAAKEAEKAHGWSCEIIDLRTIAPIDRETIIESVKKTGRAIIIHEAHKTAGLGGEITALINEEALIYLKAPVKRIAGFDIPVPQFLSENQYLPTIERMFRGIEETVSF

SEQ ID NO: 1637 - protein, 322 aa, Bacillus sp. UTB2301
LTLVQAVTDGLRTMLKEKKEVIVLGEDVGKNGGVFRATDGLQEEFGEDRVIDTPLSEAGIVGVSIGMAINGMLPVAEIQFLGFIYPAYEQIMTHASRIRMRTMSKFHVPLVIRAPYGAGVRAPEIHSDSVETLFTHMPGIKVVCPSTPYDAKGLLIAAIEDPDPVLFMESMKLYRSSREDVPEGKYTVEIGKARKVRDGKDVSIFAWGAMVPVATKAAEEMEKKGVTCDVIDLRTLYPLDKDAIAESVQKTGRVVIVHEAHATGGVSNDVMAVINDTAFLYLKAPIERVTGFDVPVPFFTLEEHYLPNTGRVVKAIEKVIHF

SEQ ID NO: 1638 - protein, 323 aa, Geobacillus thermodenitrificans NG80-2
TKSLTLVQAVNDALRIMLKERDDVVLLGEDVGRNGGVFRATDGLLQEFGEERVIDTPLSEAGFTGAAIGMALNGFRPVVEIQFLGFIYPAYEQIMTHAARMRSRTRGHFTVPLVIRAPYGAGVRAPEIHSDSTEALFTHMPGVKVVCPSSPYDAKGLLIAAIEDPDPVLFLEPMRNYRAFREDVPEGKYTVDIGKGKKLREGEDVTVIAWGAMVPVAMKAAEAAAKKGIDADVIDLRTLYPLDKDMIAESVQKTGRTVIVQEAHATGGLANDILAVINDTSFFYQKAPAERVTGFDVPVPFFAHEDDYLPTPARVLHAIEKVM

SEQ ID NO: 1639 - protein, 325 aa, Oceanobacillus iheyensis HTE831
TKQLTLIQAITDGMRTMLHEREEVVVLGEDVGKNGGVFRATDGLQEEFGEKRVFDTPLSEAGIIGSSIGMAINGLLPVAEIQFSGFIYPAYEQIMTHATRMRYRTKGVFTVPLVIRAPYGAGVRAPEIHSDSMEALFTHMPGIKVVCPSSPYDAKGLLISAIEDPDPVLFLEPLKLYRAVRGEVPEEKYEIEIGKGKYLREGDDVTVIAWGAMVPVAMKAAEQAAEKGITCEVIDLRTLYPIDRAIIAESVQKTGRCVVVHEAPATGGLGNDIISIVNDTSFLYMKSPIERVTGADVHVPFWALEEHNIPTPARVMDAINQVINF

SEQ ID NO: 1640 - protein, 327 aa, Artificial
  Substituion in SEQ ID NO 1633
MSRMLNLVQAINEALDLKLADDPRVVLLGEDIGKNGGVFRATDGLLEKYGEERVIDTPLAESAIIGTSIGMAVNGLIPVPEIQFLAFIFPALDQLFSHVARMRYRSNGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYLRAPIKRIAGFDVPVPFFALEDEYMPTEARIRAGIEETITF

SEQ ID NO: 1641 - protein, 327 aa, Artificial
  Substituion in SEQ ID NO 1633
MSRMLNLVQAINEALDLKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIISLINEEALLYLRAPIKRIAGFDVPVPFFALEDEYMPTEARIRAGIEETITF

SEQ ID NO: 1642 - protein, 327 aa, Artificial
  Substituion in SEQ ID NO 1633
MSRMLNLVQAINEALDLKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIDDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYLRAPIKRIAGFDVPVPFFALEDEYMPTEARIRAGIEETITF

SEQ ID NO: 1643 - protein, 327 aa, Artificial
  Substituion in SEQ ID NO 1633
MSRMLNLVQALNEALDLKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYLRAPIKRIAGFDVPVPFFALEDEYMPTEARIRAGIEETITF

SEQ ID NO: 1644 - protein, 327 aa, Artificial
  Substituion in SEQ ID NO 1633
MSRMLNLVQAINEALDLKLADDPRVVLLGEDIGKNGGVFRATDGLLEKYGEERVIDTPLAESAIIGTSIGMAVNGLIPVPEIQFLAFIFPALDQLFSHVARMRYRSQGQFPVPMTIRTPYGAGIHGPELHAESVESFFAHTPGLKVVVPSGPYDAKGLLISAIEDPDPVVFLEPTKLYRAFREEVPEGLYRVPIGKAKRVREGEDVSVFAWGSMLHTALKVAEAIERERGWTCDVIDLRTLYPLDRDAIVESVQKTGRAVVVHEAHKTAGLGAEIVSLINEEALLYLRAPLKRIAGFDVPVPFFALEDEYMPTEARIRAGIEETITF

SEQ ID NO: 1645 - DNA, 984 bp, Artificial
  Substituion in SEQ ID NO 1634
atgagcaggatgttgaacctggtccaagccatcaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgaatgggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 1646 - DNA, 984 bp, Artificial
  Substituion in SEQ ID NO 1634
atgagcaggatgttgaacctggtccaagccatcaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattatttcgctgatcaacgaggaggcgcttctctaccttcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 1647 - DNA, 984 bp, Artificial
  Substituion in SEQ ID NO 1634
atgagcaggatgttgaacctggtccaagccatcaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgatgatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 1648 - DNA, 984 bp, Artificial
  Substituion in SEQ ID NO 1634
atgagcaggatgttgaacctggtccaagccttaaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccatcaagcggattgctgggttcgatgtgccggtgccgttcttcgcactggaggacgagtacatgccgaccgaagcgcgcattcgcgcggggattgaagagaccatcacgttctga

SEQ ID NO: 1649 - DNA, 984 bp, Artificial
  Substituion in SEQ ID NO 1634
atgagcaggatgttgaacctggtccaagccatcaacgaagcgctcgatctcaagctcgcggacgatccgcgcgtcgtgctcctcggcgaggacatcgggaaaaacggcggagtgtttcgcgcgaccgatggccttctcgagaagtacggcgaggagcgcgtgatcgacacgccgctcgcggagtcggcgatcatcggcacctccatcgggatggcggtcaacggcctcatcccggtgccggagattcagtttttggcgttcatcttccctgcgctggatcagctgttctcgcacgtagctcgcatgcgctaccggtcgcaggggcagtttccagtgccgatgaccatccgaacgccgtacggcgcgggcattcacggtccggaactccacgccgagagcgtggagagtttcttcgcgcacaccccggggctgaaggtggtcgtcccgagcggtccgtacgacgccaaagggctgctcatctcggccattgaagatcccgatccggtggtgttcttggagcccaccaagctgtaccgggcgttccgcgaagaggtgcccgaagggctgtaccgggtgcccatcggcaaggccaagcgggtgcgcgaaggcgaggacgtgtcggtgttcgcgtggggctcgatgctgcacacggcgctcaaggtggcggaggccatcgagcgcgagcggggctggacgtgcgacgtgatcgacctccgcacgctgtatccgctcgatcgcgacgccatcgtggaatcggtgcagaagaccgggcgcgcggtggtggtgcacgaggcgcacaagacggcggggcttggggccgagattgtgtcgctgatcaacgaggaggcgcttctctaccttcgagcgcccttaaagcggattgctgggttcgatgtgccggtgccgttcttcgcactggaggacgagtacatgccgaccgaagcgcgcattcgcgcggggattgaagagaccatcacgttctga

SEQ ID NO: 1650 - protein, 438 aa, Alicyclobacillus acidocaldarius
MEFKLADIGEGIHEGEILRWLVKEGDQVEQDAPLVEVQTDKVTAELPSPVAGVIERIMAREGQVVPVGTVLAVIREAGAKAAAAASGAPGAQASLQEKPAAQAHSEAQPGREAAAPQASGAAHRGGRRRALATPHVRALARKLGVDIDEIDGTGPVGRVTEEDVRRFAEGGREPAVEPARAHAEHAAEAQPTAALRVATPAASGEPVEQVPLRGLRRRIAEHMVQAKRIIPHATHIDEVEMDGIEALRERLRPYAEARGVKLTSLAFFVKAVAIALKEFPYVNASVDEAQENVLLRRYYHIGIAVDTEQGLIVPVVKHADEKSVFEIAREVSDLARRARENRLSLDEVTGSTFTISNAGALGGLYATPIINYPESAILGIHKMEPRPVVRNNEIVIRNIAHVSLSFDHRIIDGGMAIRFTNRVRELLEEPDRLWAELR

SEQ ID NO: 1651 - DNA, 1317 bp, Alicyclobacillus acidocaldarius
atggagtttaaactggcagacatcggcgagggcattcacgagggcgagattctgcgctggttggtaaaggaaggcgaccaggtggagcaggatgcgccgctcgtggaggtgcagacggacaaggtgacggcggagctgccgtctccagtggcgggcgtgatcgagcgcattatggcgcgcgaggggcaggtggtgcccgtgggcacggtgctcgcggtcatccgagaggctggagccaaagcggcggctgcggcgtctggtgcgcccggcgcgcaggcatccctgcaggagaagcccgcggcgcaggcacacagtgaagcgcagcctgggcgcgaggctgccgcaccccaggcgagcggagccgcgcatagagggggcaggcggcgggcgcttgccacgccgcacgtgcgcgccttggctcggaagctcggggtggacatcgacgagatcgacgggacgggcccggtcggccgggtaacagaggaggacgtgcgccgctttgcggagggcgggcgcgagcctgcggtggaaccggcccgggcacacgccgagcatgcggcggaagctcagccgacagccgcattgcgagtcgcaacgcccgcggcgtctggcgagcccgtggaacaggtgccgctgcgtgggctcaggcggcggatcgcggaacacatggtgcaggccaagcgcatcatcccgcacgcgacgcacatcgacgaggtggagatggatggcatcgaggcgctccgcgagcggctgcgtccgtacgccgaggcgcgcggcgtgaaactcacgtcgctcgcgttcttcgtcaaggcggtggccatcgcgctcaaggagttcccgtacgtcaacgcgtcggtggacgaggcgcaggagaatgtgcttctcaggcgctattatcacatcggcatcgcggtcgacacggagcaggggctcatcgtgcccgtggtgaagcacgcggatgagaagtcggtcttcgaaatcgcgcgcgaggtgtccgatctcgcccggcgggcgcgggagaaccgcctgtcgctcgacgaggtgacgggcagcacgttcaccatctcgaacgccggcgcgctcggcgggctgtacgcgacgcccatcatcaactatcccgagtcggcgattctcgggattcacaagatggagccgcgccccgtggtgcgcaacaacgagattgtcatccgcaacattgcccacgtgtccctctcgttcgatcaccgcatcatcgacggcggcatggccatccgcttcaccaaccgcgtgcgcgaactgttggaggagccggatcggctgtgggcggaacttcggtag

SEQ ID NO: 1652 - protein, 441 aa, Paenibacillus larvae subsp. larvae BRL-230010
MEFKLPDVGEGIHEGEIGKWLIKEGEQVNCDQPIVEVMTDKVNAELTAPAKGVVRRLMFAEGDKVEVGQVLFLLDVEEHETLGRTGEAEQAATASPPASPPAGESSFAPVHTPRRVRAAPYVRQLARQLKIDIEQVTVSGADGRISEEDLRRYADSRETAEPVVPALASEAAESDHNGSAGGSKLLYSPPEAKGNFVNATHMNSEAPSCAEERIPLRGVRLKIAERMVKAVTVIPHVTQVDELEADALQALRERLQSIAAERQLKLTYLPFFIKALIIALKEFPVFNASLDDERKEILLKRYYHIGIAVDTPDGLIVPVIRHADRKTVFQLAEEISQLTMQAWEGKLTLNQITGGTFTISNVGPIGSLLATPIINHPEAAILTLHKMEPRMVVRNREGVIRLMMNMALSFDHRIIDGADAIRFTNRMRQLLENPDLLWAEM

SEQ ID NO: 1653 - protein, 413 aa, Bacillus halodurans C-125
VEFRLPDVGEGMHEGEIISWFVQEGDHVKQDEPVVEVQTDKMNAELTAPVSGKIKRVYYKVGEVAEVGSLLFTIDENLSTFKSETHERTKRENSTEQTRPISNISLTSQQKAPVRKGLATPYVRQLAREMNINLEDVVGTGPGGRVLEQDLQNDTNLQKVKTVPSGVANVQESIERTGSSAEKRIPLKGIRKAIAEKMIKSVATIPHVTHVDEIEMDALKELREQLKHYSEQKGIKLTFLPFFIKAIVSALKEFEYFNASIDEETNEIVLKKDYHIGIATDTEKGLIVPVIQNADQKSLLELAGEITQLSTQARKGTLNVQQMTGSTFTISNVGPIGGLHATPIINYPEVAILALHKMEPRNVVREWESVIKLMMNMSLSFDHRLVDGATAVRFTNRMKELIENPNLLLMELR

SEQ ID NO: 1654 - protein, 445 aa, Symbiobacterium thermophilum IAM 14863
EFKLPDVGEGLHEAELLRWLVKEGDTVTEDQPIMEVQTDKATVEITSPVNGRVVKLLGQPGDILKVHSVVVIFDDGSPGALPTAGEVASGVAAAAPAGAQPQASLDVPAPAAQPAPAPAAPPAPAPAPAAGAGPADRPRRALATPATRRLARELGVDINQVPGTGPAGRVTSDDVRAFAARRTAPAPAQAPTQAPTEAAAPTPATPAPAAPAEADDERIPLRGIRKVIAERMVKSKYTAPHVTTVEEVDMTELMAFRAQAKELAARKGIKLSFMPFIIKAVVAALREFPYLNASIDDEAQEIVLHKRYHIGFALDTDAGLLVPVIKDADRKPVFAIAQEMNDLIARGREGKLAPDEMRGSTFTISNQGSIGGLFFTPVINYPEVAILGIGKTQPRPVVRDGEIVIRQMAHLALSFDHRLIDGGMATRFLNRLAELLSDPTLLMME

SEQ ID NO: 1655 - protein, 403 aa, Pyrobaculum arsenaticum DSM 13514
IEFKFPDLGEGLVEGEIVKWHVKEGDFVKEGDPLVDVMTEKANVTLPAPATGKVVKIFAKEGEIVKVGQVLCVIEEVAAQEASPKAPAAEASTSQKVVAMPAARRLARELGIDLSKVKGTGPGGVITVEDVRRAAEELARQEKAPPAPPPAAVQPPPAIAQPQAPAAAQLPQPVAEEERIPVRGIRRAVAEKMAKSASAIPHAYHFEEVDVTELVSLRERLRQEAERLGVKLTYLPFVAKAVAVALREFPMLNSSFDEERGEIVVKRRIHLGFAVDTEQGLMVVVVRDADKKSVLEIARELNALAERARAGKASVDEVRGSTFTITNIGAIGGVGGLPIINYPEAAIMALGKIRKIPRVVNGAVVPRDVMNVVVGFDHRVVDGAYVARFTNRVKELLEDVGKL

SEQ ID NO: 1656 - protein, 378 aa, Pyrobaculum aerophilum str. IM2
MEFKFPDLGEGLVEGEVIKWHVKEGDFVKEGDPLVDVMTEKATVTLPAPTTGRVVKILVREGEVVKVGQTLCVIEPAEGPAAGPQTEAPARPREVAAMPAARRLAKELGIDLSKVKGTGPGGVITVEDVKRYAEETAKATAPAPAPKAVEKAEEAEVVPVRGIRRAVAEKMSKAKRLIPHAYHLEEVDFTELIKLRERVKAEAEKRGIRLTLLPFIAKAVAMALREYPMLNSEYDEEKNAIVVKKEVNLGIGVDTEQGLVVVVVKNADKKGLLEMAKEINELAQKAREGKLELQDVRGSTFTISNIGAVGGLGGLSILNYPEAGILAVGQARKKPWAVGDRIEIRDIALLAVSFDHRVVDGAYVARFMNRVKELLENP

SEQ ID NO: 1657 - protein, 438 aa, Artificial
  Substituion in SEQ ID NO 1650
MEFKLADIGEGIHEGEILRWLVKEGDQVEQDAPLVEVQTDKVTAELPSPVAGVIERIMAREGQVVPVGTVLAVIREAGAKAAAAASGAPGAQASLQEKPAAQAHSEAQPGREAAAPQASGAAHRGGRRRALATPHVRALARKLGVDIDEIDGTGPVGRVTEEDVRRFAEGGREPAVEPARAHAEHAAEAQPTAALRVATPAASGEPVEQVPLRGLRRRIAEHMVQAKRIIPHATHIDEVEMDGIEALRERLRPYAEARGVKLTSLAFFVKAVAIALKEFPYVNASVDEAQENVLLRRYYHIGIAVDTEQGLIVPVVKHADEKSVFEIAREVSDLARRARENRLSLDEVTGSTFTISNAGALGGIYATPIINYPESAILGIHKMEPRPVVRNNEIVIRNIAHVSLSFDHRIIDGGMAIRFTNRVRELLEEPDRLWAELR

SEQ ID NO: 1658 - protein, 438 aa, Artificial
  Substituion in SEQ ID NO 1650
MEFKLADIGEGIHEGEILRWLVKEGDQVEQDAPLVEVQTDKVTAELPSPVAGVIERIMAREGQVVPVGTVLAVIREAGAKAAAAASGAPGAQASLQEKPAAQAHSEAQPGREAAAPQASGAAHRGGRRRALATPHVRALARKLGVDIDEIDGTGPVGRVTEEDVRRFAEGGREPAVEPARAHAEHAAEAQPTAALRVATPAASGEPVEQVPLRGLRRRIAEHMVQAKRIIPHATHIDEVEMDGIEALRERLRPYAEARGVKLTSLAFFVKAVAIALKEFPYVNASVDEAQENVLLRRYYHIGIAVDTEQGLIVPVVKHADEKSIFEIAREVSDLARRARENRLSLDEVTGSTFTISNAGALGGLYATPIINYPESAILGIHKMEPRPVVRNNEIVIRNIAHVSLSFDHRIIDGGMAIRFTNRVRELLEEPDRLWAELR

SEQ ID NO: 1659 - protein, 438 aa, Artificial
  Substituion in SEQ ID NO 1650
MEFKLADIGEGIHEGEILRWLVKEGDQVEQDAPLVEVQTDKVTAELPSPVAGVIERIMAREGQVVPVGTVLAVIREAGAKAAAAASGAPGAQASLQEKPAAQAHSEAQPGREAAAPQASGAAHRGGRRRALATPHIRALARKLGVDIDEIDGTGPVGRVTEEDVRRFAEGGREPAVEPARAHAEHAAEAQPTAALRVATPAASGEPVEQVPLRGLRRRIAEHMVQAKRIIPHATHIDEVEMDGIEALRERLRPYAEARGVKLTSLAFFVKAVAIALKEFPYVNASVDEAQENVLLRRYYHIGIAVDTEQGLIVPVVKHADEKSVFEIAREVSDLARRARENRLSLDEVTGSTFTISNAGALGGLYATPIINYPESAILGIHKMEPRPVVRNNEIVIRNIAHVSLSFDHRIIDGGMAIRFTNRVRELLEEPDRLWAELR

SEQ ID NO: 1660 - protein, 438 aa, Artificial
  Substituion in SEQ ID NO 1650
MEFKLADIGEGIHEGEILRWLVKEGDQVEQDAPLVEVQTDKVTAELPSPVAGVIERIMAREGQVVPVGTVLAVIREAGAKAAAAASGAPGAQASLQEKPAAQAHSEAQPGREAAAPQASGAAHRGGRRRALATPHVRALARKLGVDIDEIDGTGPVGRVTEEDVRRFAEGGREPAVEPARAHAEHAAEAQPTAALRVATPAASGEPVEQVPLRGLRRRIAEHMVQAKRIIPHATHIDEVEMDGIEALRERLKPYAEARGVKLTSLAFFVKAVAIALKEFPYVNASVDEAQENVLLRRYYHIGIAVDTEQGLIVPVVKHADEKSVFEIAREVSDLARRARENRLSLDEVTGSTFTISNAGALGGLYATPIINYPESAILGIHKMEPRPVVRNNEIVIRNIAHVSLSFDHRIIDGGMAIRFTNRVRELLEEPDRLWAELR

SEQ ID NO: 1661 - protein, 438 aa, Artificial
  Substituion in SEQ ID NO 1650
MEFKLADIGEGIHEGEILRWLVKEGDQVEQDAPLVEVQTDKVTAELPSPVAGVIERIMAREGQVVPVGTVLAVIREAGAKAAAAASGAPGAQASLQEKPAAQAHSEAQPGREAAAPQASGAAHRGGRRRALATPHVRALARKLGVDIDEIDGTGPVGRVTEEDVRRFAEGGREPAVEPARAHAEHAAEAQPTAALRVATPAASGEPVEQVPLRGLRRRIAEHMVQAKRIIPHATHIDEVEMDGLEALRERLRPYAEARGVKLTSLAFFVKAVAIALKEFPYVNASVDEAQENVLLRRYYHIGIAVDTEQGLIVPVVKHADEKSVFEIAREVSDLARRARENRLSLDEVTGSTFTISNAGALGGLYATPIINYPESAILGIHKMEPRPVVRNNEIVIRNIAHVSLSFDHRIIDGGMAIRFTNRVRELLEEPDRLWAELR

SEQ ID NO: 1662 - DNA, 1317 bp, Artificial
  Substituion in SEQ ID NO 1651
atggagtttaaactggcagacatcggcgagggcattcacgagggcgagattctgcgctggttggtaaaggaaggcgaccaggtggagcaggatgcgccgctcgtggaggtgcagacggacaaggtgacggcggagctgccgtctccagtggcgggcgtgatcgagcgcattatggcgcgcgaggggcaggtggtgcccgtgggcacggtgctcgcggtcatccgagaggctggagccaaagcggcggctgcggcgtctggtgcgcccggcgcgcaggcatccctgcaggagaagcccgcggcgcaggcacacagtgaagcgcagcctgggcgcgaggctgccgcaccccaggcgagcggagccgcgcatagagggggcaggcggcgggcgcttgccacgccgcacgtgcgcgccttggctcggaagctcggggtggacatcgacgagatcgacgggacgggcccggtcggccgggtaacagaggaggacgtgcgccgctttgcggagggcgggcgcgagcctgcggtggaaccggcccgggcacacgccgagcatgcggcggaagctcagccgacagccgcattgcgagtcgcaacgcccgcggcgtctggcgagcccgtggaacaggtgccgctgcgtgggctcaggcggcggatcgcggaacacatggtgcaggccaagcgcatcatcccgcacgcgacgcacatcgacgaggtggagatggatggcatcgaggcgctccgcgagcggctgcgtccgtacgccgaggcgcgcggcgtgaaactcacgtcgctcgcgttcttcgtcaaggcggtggccatcgcgctcaaggagttcccgtacgtcaacgcgtcggtggacgaggcgcaggagaatgtgcttctcaggcgctattatcacatcggcatcgcggtcgacacggagcaggggctcatcgtgcccgtggtgaagcacgcggatgagaagtcggtcttcgaaatcgcgcgcgaggtgtccgatctcgcccggcgggcgcgggagaaccgcctgtcgctcgacgaggtgacgggcagcacgttcaccatctcgaacgccggcgcgctcggcgggatttacgcgacgcccatcatcaactatcccgagtcggcgattctcgggattcacaagatggagccgcgccccgtggtgcgcaacaacgagattgtcatccgcaacattgcccacgtgtccctctcgttcgatcaccgcatcatcgacggcggcatggccatccgcttcaccaaccgcgtgcgcgaactgttggaggagccggatcggctgtgggcggaacttcggtag

SEQ ID NO: 1663 - DNA, 1317 bp, Artificial
  Substituion in SEQ ID NO 1651
atggagtttaaactggcagacatcggcgagggcattcacgagggcgagattctgcgctggttggtaaaggaaggcgaccaggtggagcaggatgcgccgctcgtggaggtgcagacggacaaggtgacggcggagctgccgtctccagtggcgggcgtgatcgagcgcattatggcgcgcgaggggcaggtggtgcccgtgggcacggtgctcgcggtcatccgagaggctggagccaaagcggcggctgcggcgtctggtgcgcccggcgcgcaggcatccctgcaggagaagcccgcggcgcaggcacacagtgaagcgcagcctgggcgcgaggctgccgcaccccaggcgagcggagccgcgcatagagggggcaggcggcgggcgcttgccacgccgcacgtgcgcgccttggctcggaagctcggggtggacatcgacgagatcgacgggacgggcccggtcggccgggtaacagaggaggacgtgcgccgctttgcggagggcgggcgcgagcctgcggtggaaccggcccgggcacacgccgagcatgcggcggaagctcagccgacagccgcattgcgagtcgcaacgcccgcggcgtctggcgagcccgtggaacaggtgccgctgcgtgggctcaggcggcggatcgcggaacacatggtgcaggccaagcgcatcatcccgcacgcgacgcacatcgacgaggtggagatggatggcatcgaggcgctccgcgagcggctgcgtccgtacgccgaggcgcgcggcgtgaaactcacgtcgctcgcgttcttcgtcaaggcggtggccatcgcgctcaaggagttcccgtacgtcaacgcgtcggtggacgaggcgcaggagaatgtgcttctcaggcgctattatcacatcggcatcgcggtcgacacggagcaggggctcatcgtgcccgtggtgaagcacgcggatgagaagtcgattttcgaaatcgcgcgcgaggtgtccgatctcgcccggcgggcgcgggagaaccgcctgtcgctcgacgaggtgacgggcagcacgttcaccatctcgaacgccggcgcgctcggcgggctgtacgcgacgcccatcatcaactatcccgagtcggcgattctcgggattcacaagatggagccgcgccccgtggtgcgcaacaacgagattgtcatccgcaacattgcccacgtgtccctctcgttcgatcaccgcatcatcgacggcggcatggccatccgcttcaccaaccgcgtgcgcgaactgttggaggagccggatcggctgtgggcggaacttcggtag

SEQ ID NO: 1664 - DNA, 1317 bp, Artificial
  Substituion in SEQ ID NO 1651
atggagtttaaactggcagacatcggcgagggcattcacgagggcgagattctgcgctggttggtaaaggaaggcgaccaggtggagcaggatgcgccgctcgtggaggtgcagacggacaaggtgacggcggagctgccgtctccagtggcgggcgtgatcgagcgcattatggcgcgcgaggggcaggtggtgcccgtgggcacggtgctcgcggtcatccgagaggctggagccaaagcggcggctgcggcgtctggtgcgcccggcgcgcaggcatccctgcaggagaagcccgcggcgcaggcacacagtgaagcgcagcctgggcgcgaggctgccgcaccccaggcgagcggagccgcgcatagagggggcaggcggcgggcgcttgccacgccgcacattcgcgccttggctcggaagctcggggtggacatcgacgagatcgacgggacgggcccggtcggccgggtaacagaggaggacgtgcgccgctttgcggagggcgggcgcgagcctgcggtggaaccggcccgggcacacgccgagcatgcggcggaagctcagccgacagccgcattgcgagtcgcaacgcccgcggcgtctggcgagcccgtggaacaggtgccgctgcgtgggctcaggcggcggatcgcggaacacatggtgcaggccaagcgcatcatcccgcacgcgacgcacatcgacgaggtggagatggatggcatcgaggcgctccgcgagcggctgcgtccgtacgccgaggcgcgcggcgtgaaactcacgtcgctcgcgttcttcgtcaaggcggtggccatcgcgctcaaggagttcccgtacgtcaacgcgtcggtggacgaggcgcaggagaatgtgcttctcaggcgctattatcacatcggcatcgcggtcgacacggagcaggggctcatcgtgcccgtggtgaagcacgcggatgagaagtcggtcttcgaaatcgcgcgcgaggtgtccgatctcgcccggcgggcgcgggagaaccgcctgtcgctcgacgaggtgacgggcagcacgttcaccatctcgaacgccggcgcgctcggcgggctgtacgcgacgcccatcatcaactatcccgagtcggcgattctcgggattcacaagatggagccgcgccccgtggtgcgcaacaacgagattgtcatccgcaacattgcccacgtgtccctctcgttcgatcaccgcatcatcgacggcggcatggccatccgcttcaccaaccgcgtgcgcgaactgttggaggagccggatcggctgtgggcggaacttcggtag

SEQ ID NO: 1665 - DNA, 1317 bp, Artificial
  Substituion in SEQ ID NO 1651
atggagtttaaactggcagacatcggcgagggcattcacgagggcgagattctgcgctggttggtaaaggaaggcgaccaggtggagcaggatgcgccgctcgtggaggtgcagacggacaaggtgacggcggagctgccgtctccagtggcgggcgtgatcgagcgcattatggcgcgcgaggggcaggtggtgcccgtgggcacggtgctcgcggtcatccgagaggctggagccaaagcggcggctgcggcgtctggtgcgcccggcgcgcaggcatccctgcaggagaagcccgcggcgcaggcacacagtgaagcgcagcctgggcgcgaggctgccgcaccccaggcgagcggagccgcgcatagagggggcaggcggcgggcgcttgccacgccgcacgtgcgcgccttggctcggaagctcggggtggacatcgacgagatcgacgggacgggcccggtcggccgggtaacagaggaggacgtgcgccgctttgcggagggcgggcgcgagcctgcggtggaaccggcccgggcacacgccgagcatgcggcggaagctcagccgacagccgcattgcgagtcgcaacgcccgcggcgtctggcgagcccgtggaacaggtgccgctgcgtgggctcaggcggcggatcgcggaacacatggtgcaggccaagcgcatcatcccgcacgcgacgcacatcgacgaggtggagatggatggcatcgaggcgctccgcgagcggctgaaaccgtacgccgaggcgcgcggcgtgaaactcacgtcgctcgcgttcttcgtcaaggcggtggccatcgcgctcaaggagttcccgtacgtcaacgcgtcggtggacgaggcgcaggagaatgtgcttctcaggcgctattatcacatcggcatcgcggtcgacacggagcaggggctcatcgtgcccgtggtgaagcacgcggatgagaagtcggtcttcgaaatcgcgcgcgaggtgtccgatctcgcccggcgggcgcgggagaaccgcctgtcgctcgacgaggtgacgggcagcacgttcaccatctcgaacgccggcgcgctcggcgggctgtacgcgacgcccatcatcaactatcccgagtcggcgattctcgggattcacaagatggagccgcgccccgtggtgcgcaacaacgagattgtcatccgcaacattgcccacgtgtccctctcgttcgatcaccgcatcatcgacggcggcatggccatccgcttcaccaaccgcgtgcgcgaactgttggaggagccggatcggctgtgggcggaacttcggtag

SEQ ID NO: 1666 - DNA, 1317 bp, Artificial
  Substituion in SEQ ID NO 1651
atggagtttaaactggcagacatcggcgagggcattcacgagggcgagattctgcgctggttggtaaaggaaggcgaccaggtggagcaggatgcgccgctcgtggaggtgcagacggacaaggtgacggcggagctgccgtctccagtggcgggcgtgatcgagcgcattatggcgcgcgaggggcaggtggtgcccgtgggcacggtgctcgcggtcatccgagaggctggagccaaagcggcggctgcggcgtctggtgcgcccggcgcgcaggcatccctgcaggagaagcccgcggcgcaggcacacagtgaagcgcagcctgggcgcgaggctgccgcaccccaggcgagcggagccgcgcatagagggggcaggcggcgggcgcttgccacgccgcacgtgcgcgccttggctcggaagctcggggtggacatcgacgagatcgacgggacgggcccggtcggccgggtaacagaggaggacgtgcgccgctttgcggagggcgggcgcgagcctgcggtggaaccggcccgggcacacgccgagcatgcggcggaagctcagccgacagccgcattgcgagtcgcaacgcccgcggcgtctggcgagcccgtggaacaggtgccgctgcgtgggctcaggcggcggatcgcggaacacatggtgcaggccaagcgcatcatcccgcacgcgacgcacatcgacgaggtggagatggatggcttagaggcgctccgcgagcggctgcgtccgtacgccgaggcgcgcggcgtgaaactcacgtcgctcgcgttcttcgtcaaggcggtggccatcgcgctcaaggagttcccgtacgtcaacgcgtcggtggacgaggcgcaggagaatgtgcttctcaggcgctattatcacatcggcatcgcggtcgacacggagcaggggctcatcgtgcccgtggtgaagcacgcggatgagaagtcggtcttcgaaatcgcgcgcgaggtgtccgatctcgcccggcgggcgcgggagaaccgcctgtcgctcgacgaggtgacgggcagcacgttcaccatctcgaacgccggcgcgctcggcgggctgtacgcgacgcccatcatcaactatcccgagtcggcgattctcgggattcacaagatggagccgcgccccgtggtgcgcaacaacgagattgtcatccgcaacattgcccacgtgtccctctcgttcgatcaccgcatcatcgacggcggcatggccatccgcttcaccaaccgcgtgcgcgaactgttggaggagccggatcggctgtgggcggaacttcggtag

SEQ ID NO: 1667 - protein, 119 aa, Alicyclobacillus acidocaldarius
MSSGHRGDSPCSAVSTLQVLSGKWKWLILYHLFQHPSLRFSELMRRIPGITQRVLTKQLRELEEEGIVERTVYPEVPPRVEYAITPYGQSLRPILDLMHAWGLEHLRRKAERALQEPKL

SEQ ID NO: 1668 - DNA, 360 bp, Alicyclobacillus acidocaldarius
atgtcgtccggccatcgcggagattcgccctgttcggctgtctccacgcttcaagtcctgagtggcaaatggaagtggctcatcctgtaccacctgtttcaacatccttcgctgagattttccgaactcatgcgccgaattcccggcatcacgcagcgcgttctcaccaagcagttgcgcgaactggaggaagagggcatcgtcgagcggacggtgtaccctgaggttccccctcgcgtggagtacgccatcacgccgtatggccaatcgctgcggcccatccttgatctcatgcatgcgtggggcctcgagcacttgcgccgcaaggcggagcgagccctccaagagcccaagctgtga

SEQ ID NO: 1669 - protein, 105 aa, Oceanobacillus iheyensis HTE831
CSVEDALGILVGKWKPIILLHLMEKGTVRFSDLKRSIPGITQKMLTKQLRELENEEIINRVVYPEVPPRVEYSISEYGRTLEDLLHAMHEWGQAHTIRKQQKLQE

SEQ ID NO: 1670 - protein, 96 aa, Agrobacterium tumefaciens str. C58
CPVESALSFLDGKWKGVILYHLINEGTLRFNELRRHIPSVTQRMLTKQLRELEEAGLISRTVFPVVPPRVDYALTPLGETMRPVISALKSWGDAHV

SEQ ID NO: 1671 - protein, 95 aa, Bacillus clausii KSM-K16
CEVDTALEILVGKWKHKILFQLMTHDVMRFNELKRAIPGITQKMLTSQLRELESHDIVERKVYPQIPPKVEYSISEYGKSLQPVLDAMHEWGKNH

SEQ ID NO: 1672 - protein, 100 aa, Marinomonas sp. MED121
CPVERALEIIGGKWKGAILYHLLDSSNQGGSIRFNELRRIMPNITQRMLTKQLRELAETSLISRTVYPEVPPRVEYAMTDYGKTLAPVIDSLRAWGISHL

SEQ ID NO: 1673 - protein, 97 aa, Bradyrhizobium japonicum USDA 110
CSVEATLDLIDGKWKGVILYHLQDGTQRFGELRRRMPGITQRMLTKQLRALEEDKLVIRKVYAEVPPRVEYCLSELGESLRPVIDILKAWGESHQQR

SEQ ID NO: 1674 - protein, 119 aa, Artificial
  Substituion in SEQ ID NO 1667
MSSGHRGDSPCSAVSTLQVLSGKWKWLILYHLFQHPSLRFSELMRRIPGITQRVLTKQLRELEEEGIVERTVYPEVPPRVEYAITPYGQSIRPILDLMHAWGLEHLRRKAERALQEPKL

SEQ ID NO: 1675 - protein, 119 aa, Artificial
  Substituion in SEQ ID NO 1667
MSSGHRGDSPCSAVSTLQVLSGKWKWLILYHLFQHPSLRFSELMRRIPGITQRILTKQLRELEEEGIVERTVYPEVPPRVEYAITPYGQSLRPILDLMHAWGLEHLRRKAERALQEPKL

SEQ ID NO: 1676 - protein, 119 aa, Artificial
  Substituion in SEQ ID NO 1667
MSSGHKGDSPCSAVSTLQVLSGKWKWLILYHLFQHPSLRFSELMRRIPGITQRVLTKQLRELEEEGIVERTVYPEVPPRVEYAITPYGQSLRPILDLMHAWGLEHLRRKAERALQEPKL

SEQ ID NO: 1677 - protein, 119 aa, Artificial
  Substituion in SEQ ID NO 1667
MSSGHRGDSPCSAVSTLQVLSGKWKWLILYHLFQHPSLRFSELMRRLPGITQRVLTKQLRELEEEGIVERTVYPEVPPRVEYAITPYGQSLRPILDLMHAWGLEHLRRKAERALQEPKL

SEQ ID NO: 1678 - protein, 119 aa, Artificial
  Substituion in SEQ ID NO 1667
MSSGHRGDSPCSAVSTLQVLSGKWKWLILYHLFQHPSLRFSELMRRIPGITQRVLTKQLRELEEEGIVERTVYPEVPPRVEYAITPYGQSLRPILDLMHAWGLEHIRRKAERALQEPKL

SEQ ID NO: 1679 - DNA, 360 bp, Artificial
  Substituion in SEQ ID NO 1668
atgtcgtccggccatcgcggagattcgccctgttcggctgtctccacgcttcaagtcctgagtggcaaatggaagtggctcatcctgtaccacctgtttcaacatccttcgctgagattttccgaactcatgcgccgaattcccggcatcacgcagcgcgttctcaccaagcagttgcgcgaactggaggaagagggcatcgtcgagcggacggtgtaccctgaggttccccctcgcgtggagtacgccatcacgccgtatggccaatcgattcggcccatccttgatctcatgcatgcgtggggcctcgagcacttgcgccgcaaggcggagcgagccctccaagagcccaagctgtga

SEQ ID NO: 1680 - DNA, 360 bp, Artificial
  Substituion in SEQ ID NO 1668
atgtcgtccggccatcgcggagattcgccctgttcggctgtctccacgcttcaagtcctgagtggcaaatggaagtggctcatcctgtaccacctgtttcaacatccttcgctgagattttccgaactcatgcgccgaattcccggcatcacgcagcgcattctcaccaagcagttgcgcgaactggaggaagagggcatcgtcgagcggacggtgtaccctgaggttccccctcgcgtggagtacgccatcacgccgtatggccaatcgctgcggcccatccttgatctcatgcatgcgtggggcctcgagcacttgcgccgcaaggcggagcgagccctccaagagcccaagctgtga

SEQ ID NO: 1681 - DNA, 360 bp, Artificial
  Substituion in SEQ ID NO 1668
atgtcgtccggccataaaggagattcgccctgttcggctgtctccacgcttcaagtcctgagtggcaaatggaagtggctcatcctgtaccacctgtttcaacatccttcgctgagattttccgaactcatgcgccgaattcccggcatcacgcagcgcgttctcaccaagcagttgcgcgaactggaggaagagggcatcgtcgagcggacggtgtaccctgaggttccccctcgcgtggagtacgccatcacgccgtatggccaatcgctgcggcccatccttgatctcatgcatgcgtggggcctcgagcacttgcgccgcaaggcggagcgagccctccaagagcccaagctgtga

SEQ ID NO: 1682 - DNA, 360 bp, Artificial
  Substituion in SEQ ID NO 1668
atgtcgtccggccatcgcggagattcgccctgttcggctgtctccacgcttcaagtcctgagtggcaaatggaagtggctcatcctgtaccacctgtttcaacatccttcgctgagattttccgaactcatgcgccgattacccggcatcacgcagcgcgttctcaccaagcagttgcgcgaactggaggaagagggcatcgtcgagcggacggtgtaccctgaggttccccctcgcgtggagtacgccatcacgccgtatggccaatcgctgcggcccatccttgatctcatgcatgcgtggggcctcgagcacttgcgccgcaaggcggagcgagccctccaagagcccaagctgtga

SEQ ID NO: 1683 - DNA, 360 bp, Artificial
  Substituion in SEQ ID NO 1668
atgtcgtccggccatcgcggagattcgccctgttcggctgtctccacgcttcaagtcctgagtggcaaatggaagtggctcatcctgtaccacctgtttcaacatccttcgctgagattttccgaactcatgcgccgaattcccggcatcacgcagcgcgttctcaccaagcagttgcgcgaactggaggaagagggcatcgtcgagcggacggtgtaccctgaggttccccctcgcgtggagtacgccatcacgccgtatggccaatcgctgcggcccatccttgatctcatgcatgcgtggggcctcgagcacattcgccgcaaggcggagcgagccctccaagagcccaagctgtga

SEQ ID NO: 1684 - protein, 461 aa, Alicyclobacillus acidocaldarius
MSFGAETGGFGAFLSRTSAKKDKNDGIYDSPARRDSFIMFREKPFSFLVGREGRANVSVRMPKKTNVSSSLHAIREVRTSWPSVTWDVLQQHPVELDFREVERALDGVRDRQAWLVVVVRSSRVVPIYPFLAQIQSAGFDCVHLLSCDAAAYVMTLAAHHPERAMEGFESALARLAADRTLVGVSSACDEREVVRWWQALMEATAASHWNVFESSAYSQGRRELVPLHEEDRTRLITRAVTQLGDRGYEGIASVVEDLFAQLAERPTKLEDVAELCAQFIMAAVGQRQADGRDRMLQVPISTRQWLRFVAEECPKWWDWRDKLKQALMVVLGREEAVRTAHSAQIGQVIEIIERHYDSDLDVATLASQVFLSPSYLSKRFKSETGMTIREFIVQTRLNKAKDLLLRDFHLKAYEVGAHVGYPDPTYFNKLFKRQVGLTPKAFRDRAMRQARGFKQEDSRSS

SEQ ID NO: 1685 - DNA, 1386 bp, Alicyclobacillus acidocaldarius
ttgtcttttggcgccgaaacaggaggtttcggcgccttcctttcgcgaacaagtgccaagaaagacaagaacgatggaatttacgactcccctgcgcgcagggattcttttataatgtttcgagagaaaccgttttcattcctcgtggggcgcgaggggagggctaacgtgagcgtgcgcatgccgaaaaagacaaatgtttcatcctcgctgcacgccatccgggaagttcgcaccagttggccgtctgtcacctgggacgtgctgcagcaacaccccgtggaactcgatttccgagaagtggaaagggcgctcgacggcgtgcgggatcgccaagcgtggctggtggtcgtcgtccgcagttcgcgcgtggtgcccatttacccgttcctagcgcagattcagtcggcgggctttgactgtgtgcacctgctgtcttgtgacgcggccgcctacgtcatgacgctcgccgctcatcacccggagcgggccatggagggtttcgagtccgcactcgcgagattggccgcggatcggacgctcgtcggcgtgagttccgcgtgcgacgagcgggaggtggtgcgctggtggcaggcgctgatggaggccaccgccgcgtcgcactggaacgtgtttgaatcgtccgcctactcgcagggaaggcgcgagctggtgccgctccacgaagaggacagaactcggttgatcacgcgggccgtcacccagctcggcgatcgcggctatgagggcatcgcgtcggtcgtggaggatttgttcgcgcagttggcggagcggccgacgaagctcgaagacgtggcggaactctgcgctcagttcatcatggcggccgtcggccagcgccaggcggatgggcgggatcggatgctccaagttcccatctcgacgcgccaatggcttcgttttgtggccgaggaatgcccgaaatggtgggattggcgcgacaagctgaaacaggcgctgatggtggtgctcgggcgcgaagaggcggtgcgcaccgcgcacagcgcgcagatcggtcaggtcatcgagatcatcgagcggcactatgactcggatctcgatgtggcgacgctcgcgagtcaggtgtttctgagccccagctacctctccaagcgattcaagagcgagacggggatgaccattcgggagttcatcgtgcagacgcgcctgaacaaggcgaaggatctactgctgcgcgactttcacctcaaggcgtacgaggtgggcgcgcacgtcggctatccggacccgacgtatttcaacaaactgttcaaacggcaggtggggctcacgccaaaggcgtttcgcgatcgcgccatgcggcaagcccggggcttcaagcaggaggattcgcggtcttcctga

SEQ ID NO: 1686 - protein, 190 aa, Physcomitrella patens subsp. patens
VLECVRQCFERLKEQRAGTGTIVRVCSQLEDMACREVQEYREIRGKEARARLETQLRACMSFSDMEDCFVEAFRSALEKVYGLRSEMGGKAVEIVKRWIAEHYSEHAELNTLAAMVYLTPSYLSKLFKQETGLTLTEYITDVRLKNAKRLLRTEPNMKVHQIGAEVGYADPAYFNKLFKKVVGVTPNEYK

SEQ ID NO: 1687 - protein, 119 aa, Physcomitrella patens subsp. patens
ALRLIEARDDEKKEHTNQVVSRLNRYVEEHLDSDLSLTTLSDLVHLNPYYMSRLYKQMTGVNLPDYITDERIKKAKELVVESHLKMHEICKKVGFESPAYFTRIFKKKTGSTPQEFREK

SEQ ID NO: 1688 - protein, 102 aa, Clostridium cellulolyticum H10
INQVRKTIEERFKEQISISTLARDVYLTPTYLCVLFKQVTGTTINDYLTLTRLEKAKKLLSDPYIKLYDVCYEVGYLSPSYFSRLFKKYTGISPSEYRNVAI

SEQ ID NO: 1689 - protein, 243 aa, Eubacterium ventriosum ATCC 27560
KAASEAITALSLNFYSASHIIAFSRDYIANRNIFPVDISVRLHEYETAILQLNFKAAKDVVSTLFSNLQSNFTDEASVKNICTQIYLISYRLVMSTYNLPMDEKYVKMLTESSDIFQLKSIVSDMINDLQIQLTQSVKKYSSFIEESLNYIKEHLEDDLSLEQIAQHIHINESYFSRTFKKECGNSVISYINNLRINKAKELLATSNLKTFEISEAVGIHDPAYFSVLFKKNTGMSPKAYRDQ

SEQ ID NO: 1690 - protein, 103 aa, Thermoanaerobacter sp. X514
IDEAIKLIQENYSDLNISLNSIAEKLYITPNYLSTLFKSEMGVTFSDYLTACRIEKAKELLKDVKVKIYEVAEAVGYTDQHYFSKVFKNITGFTPKEYREKIL

SEQ ID NO: 1691 - protein, 461 aa, Artificial
  Substituion in SEQ ID NO 1684
MSFGAETGGFGAFLSRTSAKKDKNDGIYDSPARRESFIMFREKPFSFLVGREGRANVSVRMPKKTNVSSSLHAIREVRTSWPSVTWDVLQQHPVELDFREVERALDGVRDRQAWLVVVVRSSRVVPIYPFLAQIQSAGFDCVHLLSCDAAAYVMTLAAHHPERAMEGFESALARLAADRTLVGVSSACDEREVVRWWQALMEATAASHWNVFESSAYSQGRRELVPLHEEDRTRLITRAVTQLGDRGYEGIASVVEDLFAQLAERPTKLEDVAELCAQFIMAAVGQRQADGRDRMLQVPISTRQWLRFVAEECPKWWDWRDKLKQALMVVLGREEAVRTAHSAQIGQVIEIIERHYDSDLDVATLASQVFLSPSYLSKRFKSETGMTIREFIVQTRLNKAKDLLLRDFHLKAYEVGAHVGYPDPTYFNKLFKRQVGLTPKAFRDRAMRQARGFKQEDSRSS

SEQ ID NO: 1692 - protein, 461 aa, Artificial
  Substituion in SEQ ID NO 1684
MSFGAETGGFGAFLSRTSAKKDKNDGIYDSPARRDSFIMFREKPFSFLVGREGRANVSVRMPKKTNVSSSLHAIREVRTSWPSVTWDVLQQHPVELDFREVERALDGVRDRQAWLVVVVRSSRVVPIYPFLAQIQSAGFDCVHLLSCDAAAYVMTLAAHHPERAMEGFESALARLAADRTLVGVSSACDEREVVRWWQALMEATAASHWNVFESSAYSQGRRELVPLHEEDRTRLITRAVTQLGDRGYEGIASVVEDLFAQLAERPTKLEDVAELCAQFIMAAVGQRQADGRDRMLQVPISTRQWLRFVAEECPRWWDWRDKLKQALMVVLGREEAVRTAHSAQIGQVIEIIERHYDSDLDVATLASQVFLSPSYLSKRFKSETGMTIREFIVQTRLNKAKDLLLRDFHLKAYEVGAHVGYPDPTYFNKLFKRQVGLTPKAFRDRAMRQARGFKQEDSRSS

SEQ ID NO: 1693 - protein, 461 aa, Artificial
  Substituion in SEQ ID NO 1684
MSFGAETGGFGAFLSRTSAKKDKNDGIYDSPARRDSFIMFREKPFSFLVGREGRANVSVRMPKKTNVSSSLHAIREVRTSWPSVTWDVLQQHPVELDFREVERALDGVRDRQAWLVVVVRSSRVVPIYPFLAQIQSAGFDCVHLLSCDAAAYVMTLAAHHPERAMEGFESALARLAADRTLVGVSSACDEREVVRWWQALMEATAASHWNVFESSAYSQGRRELVPLHEEDRTRLITRAVTQLGDRGYEGIASVVEDLFAQLAERPTKLEDVAELCAQFIMAAVGQRQADGRDRMLQVPISTRQWLRFVAEECPKWWDWRDKLKQALMVVLGREEAVRTAHSAQIGQVIEIIERHYDSDLDVATLASQVFLSPSYLSKRFKSETGMTIREFIVQTRLNKAKDLLLRDFHLKAYEVGAHVGYPDPTYFNKLFKRQVGLTPKAFRDRAMRQARGFRQEDSRSS

SEQ ID NO: 1694 - protein, 461 aa, Artificial
  Substituion in SEQ ID NO 1684
MSFGAETGGFGAFLSRTSAKKDKNDGIYDSPARRDSFIMFREKPFSFLVGREGRANVSVRMPKKTNVSSSLHAIREVRTSWPSVTWDVLQQHPVELDFREVERALDGVRDRQAWLVVVVRSSRVVPIYPFLAQIQSAGFDCVHLLSCDAAAYVMTLAAHHPERAMEGFESALARLAADRTLIGVSSACDEREVVRWWQALMEATAASHWNVFESSAYSQGRRELVPLHEEDRTRLITRAVTQLGDRGYEGIASVVEDLFAQLAERPTKLEDVAELCAQFIMAAVGQRQADGRDRMLQVPISTRQWLRFVAEECPKWWDWRDKLKQALMVVLGREEAVRTAHSAQIGQVIEIIERHYDSDLDVATLASQVFLSPSYLSKRFKSETGMTIREFIVQTRLNKAKDLLLRDFHLKAYEVGAHVGYPDPTYFNKLFKRQVGLTPKAFRDRAMRQARGFKQEDSRSS

SEQ ID NO: 1695 - protein, 461 aa, Artificial
  Substituion in SEQ ID NO 1684
MSFGAETGGFGAFLSRTSAKKDKNDGIYDSPARRDSFIMFREKPFSFLVGREGRANVSVRMPKKTNVSSSLHAIREVRTSWPSVTWDVLQQHPVELDFREVERALDGVRDRQAWLVVVVRSSRVVPIYPFLAQIQSAGFDCVHLLSCDAAAYVMTLAAHHPERAMEGFESALARLAADRTLVGVSSACDEREVVRWWQALMEATAASHWNVFESSAYSQGRRELVPLHEEDRTRLITRAVTQLGDRGYEGIASVVEDLFAQLADRPTKLEDVAELCAQFIMAAVGQRQADGRDRMLQVPISTRQWLRFVAEECPKWWDWRDKLKQALMVVLGREEAVRTAHSAQIGQVIEIIERHYDSDLDVATLASQVFLSPSYLSKRFKSETGMTIREFIVQTRLNKAKDLLLRDFHLKAYEVGAHVGYPDPTYFNKLFKRQVGLTPKAFRDRAMRQARGFKQEDSRSS

SEQ ID NO: 1696 - DNA, 1386 bp, Artificial
  Substituion in SEQ ID NO 1685
ttgtcttttggcgccgaaacaggaggtttcggcgccttcctttcgcgaacaagtgccaagaaagacaagaacgatggaatttacgactcccctgcgcgcagggaatcttttataatgtttcgagagaaaccgttttcattcctcgtggggcgcgaggggagggctaacgtgagcgtgcgcatgccgaaaaagacaaatgtttcatcctcgctgcacgccatccgggaagttcgcaccagttggccgtctgtcacctgggacgtgctgcagcaacaccccgtggaactcgatttccgagaagtggaaagggcgctcgacggcgtgcgggatcgccaagcgtggctggtggtcgtcgtccgcagttcgcgcgtggtgcccatttacccgttcctagcgcagattcagtcggcgggctttgactgtgtgcacctgctgtcttgtgacgcggccgcctacgtcatgacgctcgccgctcatcacccggagcgggccatggagggtttcgagtccgcactcgcgagattggccgcggatcggacgctcgtcggcgtgagttccgcgtgcgacgagcgggaggtggtgcgctggtggcaggcgctgatggaggccaccgccgcgtcgcactggaacgtgtttgaatcgtccgcctactcgcagggaaggcgcgagctggtgccgctccacgaagaggacagaactcggttgatcacgcgggccgtcacccagctcggcgatcgcggctatgagggcatcgcgtcggtcgtggaggatttgttcgcgcagttggcggagcggccgacgaagctcgaagacgtggcggaactctgcgctcagttcatcatggcggccgtcggccagcgccaggcggatgggcgggatcggatgctccaagttcccatctcgacgcgccaatggcttcgttttgtggccgaggaatgcccgaaatggtgggattggcgcgacaagctgaaacaggcgctgatggtggtgctcgggcgcgaagaggcggtgcgcaccgcgcacagcgcgcagatcggtcaggtcatcgagatcatcgagcggcactatgactcggatctcgatgtggcgacgctcgcgagtcaggtgtttctgagccccagctacctctccaagcgattcaagagcgagacggggatgaccattcgggagttcatcgtgcagacgcgcctgaacaaggcgaaggatctactgctgcgcgactttcacctcaaggcgtacgaggtgggcgcgcacgtcggctatccggacccgacgtatttcaacaaactgttcaaacggcaggtggggctcacgccaaaggcgtttcgcgatcgcgccatgcggcaagcccggggcttcaagcaggaggattcgcggtcttcctga

SEQ ID NO: 1697 - DNA, 1386 bp, Artificial
  Substituion in SEQ ID NO 1685
ttgtcttttggcgccgaaacaggaggtttcggcgccttcctttcgcgaacaagtgccaagaaagacaagaacgatggaatttacgactcccctgcgcgcagggattcttttataatgtttcgagagaaaccgttttcattcctcgtggggcgcgaggggagggctaacgtgagcgtgcgcatgccgaaaaagacaaatgtttcatcctcgctgcacgccatccgggaagttcgcaccagttggccgtctgtcacctgggacgtgctgcagcaacaccccgtggaactcgatttccgagaagtggaaagggcgctcgacggcgtgcgggatcgccaagcgtggctggtggtcgtcgtccgcagttcgcgcgtggtgcccatttacccgttcctagcgcagattcagtcggcgggctttgactgtgtgcacctgctgtcttgtgacgcggccgcctacgtcatgacgctcgccgctcatcacccggagcgggccatggagggtttcgagtccgcactcgcgagattggccgcggatcggacgctcgtcggcgtgagttccgcgtgcgacgagcgggaggtggtgcgctggtggcaggcgctgatggaggccaccgccgcgtcgcactggaacgtgtttgaatcgtccgcctactcgcagggaaggcgcgagctggtgccgctccacgaagaggacagaactcggttgatcacgcgggccgtcacccagctcggcgatcgcggctatgagggcatcgcgtcggtcgtggaggatttgttcgcgcagttggcggagcggccgacgaagctcgaagacgtggcggaactctgcgctcagttcatcatggcggccgtcggccagcgccaggcggatgggcgggatcggatgctccaagttcccatctcgacgcgccaatggcttcgttttgtggccgaggaatgcccgcgttggtgggattggcgcgacaagctgaaacaggcgctgatggtggtgctcgggcgcgaagaggcggtgcgcaccgcgcacagcgcgcagatcggtcaggtcatcgagatcatcgagcggcactatgactcggatctcgatgtggcgacgctcgcgagtcaggtgtttctgagccccagctacctctccaagcgattcaagagcgagacggggatgaccattcgggagttcatcgtgcagacgcgcctgaacaaggcgaaggatctactgctgcgcgactttcacctcaaggcgtacgaggtgggcgcgcacgtcggctatccggacccgacgtatttcaacaaactgttcaaacggcaggtggggctcacgccaaaggcgtttcgcgatcgcgccatgcggcaagcccggggcttcaagcaggaggattcgcggtcttcctga

SEQ ID NO: 1698 - DNA, 1386 bp, Artificial
  Substituion in SEQ ID NO 1685
ttgtcttttggcgccgaaacaggaggtttcggcgccttcctttcgcgaacaagtgccaagaaagacaagaacgatggaatttacgactcccctgcgcgcagggattcttttataatgtttcgagagaaaccgttttcattcctcgtggggcgcgaggggagggctaacgtgagcgtgcgcatgccgaaaaagacaaatgtttcatcctcgctgcacgccatccgggaagttcgcaccagttggccgtctgtcacctgggacgtgctgcagcaacaccccgtggaactcgatttccgagaagtggaaagggcgctcgacggcgtgcgggatcgccaagcgtggctggtggtcgtcgtccgcagttcgcgcgtggtgcccatttacccgttcctagcgcagattcagtcggcgggctttgactgtgtgcacctgctgtcttgtgacgcggccgcctacgtcatgacgctcgccgctcatcacccggagcgggccatggagggtttcgagtccgcactcgcgagattggccgcggatcggacgctcgtcggcgtgagttccgcgtgcgacgagcgggaggtggtgcgctggtggcaggcgctgatggaggccaccgccgcgtcgcactggaacgtgtttgaatcgtccgcctactcgcagggaaggcgcgagctggtgccgctccacgaagaggacagaactcggttgatcacgcgggccgtcacccagctcggcgatcgcggctatgagggcatcgcgtcggtcgtggaggatttgttcgcgcagttggcggagcggccgacgaagctcgaagacgtggcggaactctgcgctcagttcatcatggcggccgtcggccagcgccaggcggatgggcgggatcggatgctccaagttcccatctcgacgcgccaatggcttcgttttgtggccgaggaatgcccgaaatggtgggattggcgcgacaagctgaaacaggcgctgatggtggtgctcgggcgcgaagaggcggtgcgcaccgcgcacagcgcgcagatcggtcaggtcatcgagatcatcgagcggcactatgactcggatctcgatgtggcgacgctcgcgagtcaggtgtttctgagccccagctacctctccaagcgattcaagagcgagacggggatgaccattcgggagttcatcgtgcagacgcgcctgaacaaggcgaaggatctactgctgcgcgactttcacctcaaggcgtacgaggtgggcgcgcacgtcggctatccggacccgacgtatttcaacaaactgttcaaacggcaggtggggctcacgccaaaggcgtttcgcgatcgcgccatgcggcaagcccggggcttccgtcaggaggattcgcggtcttcctga

SEQ ID NO: 1699 - DNA, 1386 bp, Artificial
  Substituion in SEQ ID NO 1685
ttgtcttttggcgccgaaacaggaggtttcggcgccttcctttcgcgaacaagtgccaagaaagacaagaacgatggaatttacgactcccctgcgcgcagggattcttttataatgtttcgagagaaaccgttttcattcctcgtggggcgcgaggggagggctaacgtgagcgtgcgcatgccgaaaaagacaaatgtttcatcctcgctgcacgccatccgggaagttcgcaccagttggccgtctgtcacctgggacgtgctgcagcaacaccccgtggaactcgatttccgagaagtggaaagggcgctcgacggcgtgcgggatcgccaagcgtggctggtggtcgtcgtccgcagttcgcgcgtggtgcccatttacccgttcctagcgcagattcagtcggcgggctttgactgtgtgcacctgctgtcttgtgacgcggccgcctacgtcatgacgctcgccgctcatcacccggagcgggccatggagggtttcgagtccgcactcgcgagattggccgcggatcggacgctcattggcgtgagttccgcgtgcgacgagcgggaggtggtgcgctggtggcaggcgctgatggaggccaccgccgcgtcgcactggaacgtgtttgaatcgtccgcctactcgcagggaaggcgcgagctggtgccgctccacgaagaggacagaactcggttgatcacgcgggccgtcacccagctcggcgatcgcggctatgagggcatcgcgtcggtcgtggaggatttgttcgcgcagttggcggagcggccgacgaagctcgaagacgtggcggaactctgcgctcagttcatcatggcggccgtcggccagcgccaggcggatgggcgggatcggatgctccaagttcccatctcgacgcgccaatggcttcgttttgtggccgaggaatgcccgaaatggtgggattggcgcgacaagctgaaacaggcgctgatggtggtgctcgggcgcgaagaggcggtgcgcaccgcgcacagcgcgcagatcggtcaggtcatcgagatcatcgagcggcactatgactcggatctcgatgtggcgacgctcgcgagtcaggtgtttctgagccccagctacctctccaagcgattcaagagcgagacggggatgaccattcgggagttcatcgtgcagacgcgcctgaacaaggcgaaggatctactgctgcgcgactttcacctcaaggcgtacgaggtgggcgcgcacgtcggctatccggacccgacgtatttcaacaaactgttcaaacggcaggtggggctcacgccaaaggcgtttcgcgatcgcgccatgcggcaagcccggggcttcaagcaggaggattcgcggtcttcctga

SEQ ID NO: 1700 - DNA, 1386 bp, Artificial
  Substituion in SEQ ID NO 1685
ttgtcttttggcgccgaaacaggaggtttcggcgccttcctttcgcgaacaagtgccaagaaagacaagaacgatggaatttacgactcccctgcgcgcagggattcttttataatgtttcgagagaaaccgttttcattcctcgtggggcgcgaggggagggctaacgtgagcgtgcgcatgccgaaaaagacaaatgtttcatcctcgctgcacgccatccgggaagttcgcaccagttggccgtctgtcacctgggacgtgctgcagcaacaccccgtggaactcgatttccgagaagtggaaagggcgctcgacggcgtgcgggatcgccaagcgtggctggtggtcgtcgtccgcagttcgcgcgtggtgcccatttacccgttcctagcgcagattcagtcggcgggctttgactgtgtgcacctgctgtcttgtgacgcggccgcctacgtcatgacgctcgccgctcatcacccggagcgggccatggagggtttcgagtccgcactcgcgagattggccgcggatcggacgctcgtcggcgtgagttccgcgtgcgacgagcgggaggtggtgcgctggtggcaggcgctgatggaggccaccgccgcgtcgcactggaacgtgtttgaatcgtccgcctactcgcagggaaggcgcgagctggtgccgctccacgaagaggacagaactcggttgatcacgcgggccgtcacccagctcggcgatcgcggctatgagggcatcgcgtcggtcgtggaggatttgttcgcgcagttggcggatcggccgacgaagctcgaagacgtggcggaactctgcgctcagttcatcatggcggccgtcggccagcgccaggcggatgggcgggatcggatgctccaagttcccatctcgacgcgccaatggcttcgttttgtggccgaggaatgcccgaaatggtgggattggcgcgacaagctgaaacaggcgctgatggtggtgctcgggcgcgaagaggcggtgcgcaccgcgcacagcgcgcagatcggtcaggtcatcgagatcatcgagcggcactatgactcggatctcgatgtggcgacgctcgcgagtcaggtgtttctgagccccagctacctctccaagcgattcaagagcgagacggggatgaccattcgggagttcatcgtgcagacgcgcctgaacaaggcgaaggatctactgctgcgcgactttcacctcaaggcgtacgaggtgggcgcgcacgtcggctatccggacccgacgtatttcaacaaactgttcaaacggcaggtggggctcacgccaaaggcgtttcgcgatcgcgccatgcggcaagcccggggcttcaagcaggaggattcgcggtcttcctga

SEQ ID NO: 1701 - protein, 358 aa, Alicyclobacillus acidocaldarius
MDDVQVYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEEAARHVYAEVPEALALHLAKRGKEAR

SEQ ID NO: 1702 - DNA, 1077 bp, Alicyclobacillus acidocaldarius
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgaggtcccggaggcactcgcgcttcatctcgccaaacgcggaaaggaggcgcgctga

SEQ ID NO: 1703 - protein, 331 aa, Geobacillus thermodenitrificans NG80-2
QILDENGNGDEAKIAAFSDEWLLDAYRAMRRARVVDERLLRMQRQGRIGTYAPFSGQEAAQIGSVLALQKDDWIFPSYREVAVCLTHGMPLEQFFHYVRGRLSGKRMPEELNIFPTQIIIAAQTLHAVGCAWATKLKGESHVSVAYFGDGATSEGDFHEAMNFAAVYNVPVIFFCQNNQYAISVPYAKQTASRTIAQKALAYGMKGVLVDGNDVLAVYETMKQAVEAARRGEGPMLIEALTYRLGPHTTADDPTKYRHPEEVETWRRKDPLHRLRVLLERRGLWTDAKEEEFVAKVNEEVTAAYEAAVASESGSIADVFDYVYSEAPKLLA

SEQ ID NO: 1704 - protein, 342 aa, Geobacillus kaustophilus HTA426
FDPDKLPVEIVRILDENGNGDEEKLAAFSDEWLLRAYREMRRARVIDERLLRMQRQGRIGTYAPFSGQEAAQIGSALALHKDDWIFPSYREVAVCLMHGMPLEQFFHYVQGRLSGKRMPEGVNIFPTQIIIAAQTLHAVGCAWASKLKGEPHVSVAYFGDGATSEGDFHEAMNFAAVYNVPVIFFCQNNQYAISVPYRKQTASRTIAQKALAYGMKGVLVDGNDVLAVYETMKQAVEAARRGEGPMLIEALTYRLGPHTTADDPTKYRRPEEVETWRAKDPLRRLRLLLERRGLWTEAQEDALVAQVNDEVTAAYEAAIASKSGSIVDAFDCVYSEAPKLLA

SEQ ID NO: 1705 - protein, 329 aa, Exiguobacterium sibiricum 255-15
RILDDAGQVTDTSKTDLLTKDLSLALFTHMNRIRTFDRKAINLQRQGRLGTYAPFEGQEAAQVGSAYALQDKDWVFPTYRDHGATLTFGADMVRTFLYWNGRVEGCVATDELHIFPPAVPIATQIPHAVGAAWAEKRKGSTQVAVAYFGDGATSEGDFHEGMNFASVFQAPVILFNQNNGYAISVPIQKQMHSETIAQKALAYGMPSVRIDGNDVFAVYFTMQKALERARSGGGPTLIEAVTWRFGAHTTADDPSKYRDQERSRDRVDPLERLEAFMKEQGFYDEQEIETIRSRHQEEVEAAVKTMESFPPPDVNDLFDHTFATLPDDL

SEQ ID NO: 1706 - protein, 335 aa, Paenibacillus larvae subsp. larvae BRL-230010
GLQEPYQVLKPDGELRHRIGGEVDEALMIKMYENMMHVRMFDRKAVNLQRQGRIGTYAPYEGQEAAQVGSAMALSPEDWLFPSYRDHAATITHGQSLSRVLLYWMGHMEGSVSPEGLKIMPPCVPIATQLVHAVGTSWAAKLKGEKQASIAYFGEGATSEGDFHEALNFAGVYQTATIFFCQNNGYAISVPFHAQSASRTIAQRAAAYDIVGVRVDGNDIFAVWLTVREAIKRGLAGGGPTLVEAVTFRYGAHTTSDDPRKYRDQERLASEWREQRDPVHRLRLFLQKRGLWNEKDEERMLERLTGLIEDAVSEAESYPKSRPADMFKHVFADVP

SEQ ID NO: 1707 - protein, 329 aa, Bacillus halodurans C-125
QVLTPKGECQYEGSEFLDKTFVLSMYKQMINCREFDEKALKLQRQGRIGTYASFKGQEACQIGGALALRPTDWLFPTYRDHAAISTHGQPWHRIFLYWMGHMDGSLSPDDRNILPPAVPIATQMLHAVGTAWADKLKGNPHVSLVFFGDGATSEGDFHEALNFAGVYQTPTIFFCQNNGYAISVPFEKQSASKTIKQRSVAYDMRGERVDGNDIFAVYLTVKRAIEQARKGRGPTLIEAVTTRFGSHTTADDAKKYRDQEEIERTWKEMQDPLTRLKAYIQAKGWLSEEEEAQMKAKIRETIDEELSMAEQYPKPSISQMFEHVYENQP

SEQ ID NO: 1708 - protein, 358 aa, Artificial
  Substituion in SEQ ID NO 1701
MDDVQVYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEEAARHVYAEVPEALALHLARRGKEAR

SEQ ID NO: 1709 - protein, 358 aa, Artificial
  Substituion in SEQ ID NO 1701
MDDVQVYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACDEEAEARVRQAVADMEAYPHKSLEEAARHVYAEVPEALALHLAKRGKEAR

SEQ ID NO: 1710 - protein, 358 aa, Artificial
  Substituion in SEQ ID NO 1701
MDDVQVYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGKMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEEAARHVYAEVPEALALHLAKRGKEAR

SEQ ID NO: 1711 - protein, 358 aa, Artificial
  Substituion in SEQ ID NO 1701
MDDVQVYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEDAARHVYAEVPEALALHLAKRGKEAR

SEQ ID NO: 1712 - protein, 358 aa, Artificial
  Substituion in SEQ ID NO 1701
MDDVQVYRFTGDTKPDQVLNEAGEMVGELPENAADLALEWYPFMIFCRKFDERAQLLQRQGRLGTYAPFRGQEAAQIASFAVLRPSDWVFPTYRELAGMMYHGLEPVHALLKSRGHPDAGRMPEEIHMAPPQIAIAAQILHAVGAGWACKLQEKDDIAVAYFGDGATSEGDFHEGMNFASVMRLPVVFFCQNNQYAISVPVHRQMASPTIAQKAIAYGMEGLRVDGNDAFAVYQAMCYAVERARRGDGPTLIEAVTYRLGPHTTADDPGRYRDAVDVERWAAAKDPLVRLRLWLTRQGLWDDERQAACEEEAEARVRQAVADMEAYPHKSLEEAARHVYAEIPEALALHLAKRGKEAR

SEQ ID NO: 1713 - DNA, 1077 bp, Artificial
  Substituion in SEQ ID NO 1702
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgaggtcccggaggcactcgcgcttcatctcgcccgtcgcggaaaggaggcgcgctga

SEQ ID NO: 1714 - DNA, 1077 bp, Artificial
  Substituion in SEQ ID NO 1702
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgatgaggaggccgaagcgcgcgtgcgccaggcggtggccgacatggaagcgtacccgcataagtccctcgaggaggccgcgcgccacgtgtacgccgaggtcccggaggcactcgcgcttcatctcgccaaacgcggaaaggaggcgcgctga

SEQ ID NO: 1715 - DNA, 1077 bp, Artificial
  Substituion in SEQ ID NO 1702
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggcaaaatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgaggtcccggaggcactcgcgcttcatctcgccaaacgcggaaaggaggcgcgctga

SEQ ID NO: 1716 - DNA, 1077 bp, Artificial
  Substituion in SEQ ID NO 1702
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggatgccgcgcgccacgtgtacgccgaggtcccggaggcactcgcgcttcatctcgccaaacgcggaaaggaggcgcgctga

SEQ ID NO: 1717 - DNA, 1077 bp, Artificial
  Substituion in SEQ ID NO 1702
gtggatgacgtgcaggtttaccggttcacgggcgacacaaaaccggatcaggtgctgaatgaggcgggcgagatggtgggcgagttgcccgagaacgcggccgatctcgccctcgagtggtaccctttcatgatcttctgccgaaaattcgacgagcgcgcgcaactcctgcagcggcaggggcggctcggaacctacgcgccgtttcgcggccaggaggcggcgcagatcgccagttttgccgtgcttcgtccgagcgattgggtgtttcccacgtaccgcgagctcgccggcatgatgtaccacgggctggaacctgtgcacgccctgctcaagagccgcggacatccggacgcaggccgcatgccggaagagatccacatggcgcctcctcagatcgccatcgcggcgcagattttacacgcggtgggcgcgggctgggcgtgcaagttgcaggagaaggacgacatcgccgtggcgtatttcggtgacggtgcgacgtccgagggagattttcacgagggcatgaacttcgcttccgtcatgcgcctgcccgtcgtgttcttctgccagaacaaccagtacgccatcagcgtgcccgtgcatcggcagatggcgtcgccgaccatcgcgcaaaaggccatcgcgtacggcatggagggcctcagggtcgacgggaacgacgccttcgccgtgtatcaggcgatgtgctacgccgtcgagcgggcgcgccgtggggacggcccgacgctcatcgaggcggtcacgtatcgcctgggtccgcacacgaccgcggacgatcccggaaggtatcgggacgccgtggatgtggagcgatgggcggcggccaaagacccgctcgtgaggctcaggctctggcttacgcgacagggactctgggacgatgagcggcaagccgcgtgtgaagaggaggccgaagcgcgcgtgcgccaggcggtggccgacatggaagcgtacccgcataagtccctcgaggaggccgcgcgccacgtgtacgccgagattccggaggcactcgcgcttcatctcgccaaacgcggaaaggaggcgcgctga

SEQ ID NO: 1718 - protein, 325 aa, Alicyclobacillus acidocaldarius
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIERVMED

SEQ ID NO: 1719 - DNA, 978 bp, Alicyclobacillus acidocaldarius
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggaagattga

SEQ ID NO: 1720 - protein, 323 aa, Geobacillus kaustophilus HTA426
MAELTMIEAINEAMRQEMERDPRIIVLGEDVGENGGVFRATDGLLAQFGEGRVFDTPLAESGIIGTSIGLAINGMRPIAEIQFLGFVYQAMDQLAAQAARIRFRSAGRFSCPIVVRSPYGGGVRTPELHSDALEALFTHSPGLKVVMPSNPYDAKGLLISAIRDEDPVLFLEPMKLYRAFRMEVPEEPYTIPLGQARVVKEGDDVTIIAWGATVPLAAKVAAEMQAKGVNAEVIDLRCLQPLDIDTIITSVEKTGRVMIVHEAVKTGGFGAEVAALISERALFSLSAPIVRIAGYDTPYPVPSVEDDWLPNAERIAEGIETLL

SEQ ID NO: 1721 - protein, 323 aa, Geobacillus thermodenitrificans NG80-2
MAELTMIEAINEAMRQEMERNSRVIVLGEDVGENGGVFRATDGLLEQFGSGRVFDTPLAESGIIGTSIGLAINGMRPIAEIQFLGFVYQAMDQLAAQAARIRFRSGGRFSCPIVVRSPYGGGVRTPELHSDALEALFTHSPGLKVVMPSNPYDAKGLLISAIRDDDPVLFFEPMKLYRAFRMEVPEEPYTIPLGQARIVKEGDDVTILTWGATVPLVAKLADEMRMRGVDAEVIDLRCLQPLDIDTIIASVEKTGRVMIVHEAVKTSGFGAEVAALISERALFSLSAPIVRIAGYDTPYPVPSVEDDWLPNPARIVEGIETLM

SEQ ID NO: 1722 - protein, 320 aa, Exiguobacterium sibiricum 255-15
TLVQAVTDALRTKLTDDETTLVLGEDVGKNGGVFRATDGLQEEFGEDRIIDTPLSEAGIVGTSIGLAVNGFKPIVEIQFLGFIYPAYEQIMTHVSRIRMRTMGRYGVPMVIRAPYGAGIRAPEIHSDSTEALFTSMPGLKVVCPSTPYDAKGLLIAAIEDPDPVLFLESMRSYRAFKEPVPSEAYTIEIGKANCITEGQDVTLIAWGAMVQVAQKAATEAATRGISCEVIDLRTLYPLDRETISASVQKTGRAVIIHEAQATGGLGNDLLALINDTSFLYLRAPVARVTGFDVPVPLFALEDHYIPTPTRVLEAIQRTVD

SEQ ID NO: 1723 - protein, 323 aa, Geobacillus thermodenitrificans NG80-2
MAQMTMVQAITDALRIELKNDPNVLIFGEDVGVNGGVFRATEGLQAEFGEERVFDTPLAESGIGGLAVGLALQGFRPVPEIQFFGFVYEVMDSISGQMARIRYRTGGRYHMPITVRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVM

SEQ ID NO: 1724 - protein, 323 aa, Bacillus cereus ATCC 14579
MAQMTMIQAITDALRVEMKNDPNVLVFGEDVGVNGGVFRATEGLQAEFGEDRVMDTPLAESGIGGLAVGLALEGFRPVPEIQFFGFVYEVMDSISGQLARMRYRSGGRWTAPVTVRSPFGGGVHTPELHADSLEGLVAQQPGLKVVIPSTPYDAKGLLISAIRDNDPVIYLEHMKLYRSFRQEVPEGDYTIDLGKADIKREGTDVSVIAYGAMVHAALKAAEELEKEGISLEVVDLRTVQPLDIETIIASVEKTGRVVVVQEAQKQAGIAANVVAEINDRAILNLEAPVVRVAAADTVFPFSQAESVWLPNHKDIVEAVNKVM

SEQ ID NO: 1725 - protein, 325 aa, Artificial
  Substituion in SEQ ID NO 1718
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVKTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIERVMED

SEQ ID NO: 1726 - protein, 325 aa, Artificial
  Substituion in SEQ ID NO 1718
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDITLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIERVMED

SEQ ID NO: 1727 - protein, 325 aa, Artificial
  Substituion in SEQ ID NO 1718
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEEAWLPSVTRVVEAIERVMED

SEQ ID NO: 1728 - protein, 325 aa, Artificial
  Substituion in SEQ ID NO 1718
MPKWTMIEAIRDALAIALRDDPRVLVFGEDVGKNGGVFRATDGLQAEFGEARVADTPLAEKAIVGTAVGLAMAGMKPIAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFREEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIERVMED

SEQ ID NO: 1729 - protein, 325 aa, Artificial
  Substituion in SEQ ID NO 1718
MPKWTMIEAIRDALAIALRDDPRVLVFGEDVGKNGGVFRATDGLQAEFGEARVADTPLAEKAIVGTAVGLAMAGMKPVAEIQFLGFAYEAMDQIAAQLARIRFRTQGRFTAPAVIRAPYGGGVRTPELHSDSLEALFAHTPGLVVVTPSRPYDAKGLLLSAIRSPDPVVFLEPIRLYRAFRDEVPEGDYQVPLGRAAVRREGSDVTLVAWGPTVPVAESAAAQVASRGISCEVLDLRTLAPLDRSALKASVEKTGRAVIVHEAVRYAGLGAEIAASIMDLAFYHLRAPIERVAGLDTPYPPPALEDAWLPSVTRVVEAIERVMED

SEQ ID NO: 1730 - DNA, 978 bp, Artificial
  Substituion in SEQ ID NO 1719
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgaaaacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggaagattga

SEQ ID NO: 1731 - DNA, 978 bp, Artificial
  Substituion in SEQ ID NO 1719
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacattacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggaagattga

SEQ ID NO: 1732 - DNA, 978 bp, Artificial
  Substituion in SEQ ID NO 1719
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggaagcctggctcccgagcgtgacgcgcgtcgtcgaggccatcgagcgcgtcatggaagattga

SEQ ID NO: 1733 - DNA, 978 bp, Artificial
  Substituion in SEQ ID NO 1719
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccattgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggaagaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggaagattga

SEQ ID NO: 1734 - DNA, 978 bp, Artificial
  Substituion in SEQ ID NO 1719
atgcccaagtggacgatgatcgaggccattcgggatgcgctggccatcgcccttcgcgacgatccgcgcgttctcgtcttcggcgaggacgtagggaaaaacggcggtgtcttccgcgccacggacgggctgcaggccgaattcggcgaagcgcgcgtcgccgacacgccgctcgcggagaaggccatcgtcggaacggccgtgggcctcgccatggcgggcatgaagcccgtcgccgagatccagtttctcggctttgcctacgaggcgatggatcagatcgccgcgcagctcgcgcgcatccgcttccgcacgcagggacggttcacggcccccgcggtcattcgtgccccatacggaggtggcgtgcgcacgccggagctgcactcggacagcctggaggcgctctttgcccacacgccggggctcgtcgtcgtgacgcctagccgtccgtacgacgccaaggggcttttgctcagcgccatccgttcgcccgatcccgtcgtcttcctggaacccatcaggctctatcgcgccttccgggatgaggtgcctgagggagactaccaggtgccgctcggccgggcggccgtccgccgcgagggctcggacgtcacgctcgtcgcctgggggcccaccgtgccggtggcggaatcggcggcagcccaggtggcatcccgggggatttcgtgcgaggttctggatctgcgcacgctcgcgccgctcgaccgatccgccctcaaagcgtccgtggagaagacgggccgcgccgtcatcgtccacgaggcggtgcggtatgccgggctcggcgccgagatcgccgcctccatcatggacctggcgttttaccacctgcgggcgcccatcgagcgggtggccgggctcgacacgccctacccgccgcccgcgctcgaggacgcctggctcccgagcgtgacgcgcgtcgtcgaggccatcgagcgcgtcatggaagattga

SEQ ID NO: 1735 - protein, 179 aa, Alicyclobacillus acidocaldarius
MKKFDTSGIDQDDLISIGTVGLIKAVDTYQPSKGTKFATYAARCIQNEILMQLRAQRKSRKDVSLYSPIGTDKEGNEITIGDILFSESDSTEDEVSRRMELNTMRQLLDVLDERERKVIELRFGLADGREWTQNEVADSLDISRSYVSRLEKRALLKMFHQSHVAKERKQAIRNARLQP

SEQ ID NO: 1736 - DNA, 540 bp, Alicyclobacillus acidocaldarius
atgaagaagtttgatacgtccgggatcgatcaggatgacctgatttccatcggcacggtcggcttgattaaagctgtggacacgtatcagccgtccaaagggaccaaattcgcgacctacgccgcgcgatgcatccaaaacgagatcctgatgcaactgcgcgcccagcgcaagtcgcgcaaggacgtatccctgtacagccccatcggtacggataaggaggggaacgagatcaccatcggcgacatcctgttttccgagagcgactccacggaggacgaggtgtctcgccgaatggaactcaacacgatgcgtcaattgctcgacgtcctcgacgagcgtgagcgcaaagtcattgagctgagattcggcctcgccgacgggcgcgagtggacccagaacgaggtggccgactcgctcgacatctcccgctcctacgtgtcccggttggaaaaacgggcgctgctcaagatgtttcaccagtcgcacgtcgccaaggagcgcaagcaggccatccgcaacgctcgccttcaaccgtaa

SEQ ID NO: 1737 - protein, 170 aa, Geobacillus kaustophilus HTA426
VKKFENTGEEVEDLISIGTIGLIKAIESYSPGKGTKLATYAARCIENEILMHLRSLKKTRKDVSLHEPIGQDKEGNEISLLDILKAEGEDIADEIHLNMELEQVKQYISVLDEREKEVIINRFGLGRQREKTQREIAKELGISRSYVSRIEKRALMKMFHEFYRQEKEKR

SEQ ID NO: 1738 - protein, 170 aa, Geobacillus thermodenitrificans NG80-2
VKKFENTGEEVEDLISIGTIGLIKAIESYSPNKGTKLATYAARCIENEILMHLRSLKKTRKDVSLHEPIGQDKEGNEISLLDILKSEGQDIVDEIQLNMELEQVKKYISVLDEREKEVIVNRFGLGRQREKTQREIAKELGISRSYVSRIEKRALMKMFHEFYRQEKEKR

SEQ ID NO: 1739 - protein, 171 aa, Bacillus thuringiensis
VKKFENTGEDAEDLISIGTIGLIKAIESYSAGKGTKLATYAARCIENEILMHLRVLKKTKKDVSLHDPIGQDKEGNEISLIDILKSESEDVIDMIQLSMELEKIKEYIDILDEREKEVIVKRFGLGLDKEKTQREIAKALGISRSYVSRIEKRALMKMFHEFVRAEKEKKA

SEQ ID NO: 1740 - protein, 171 aa, Bacillus thuringiensis str. Al Hakam; identical to SEQ ID NO: 1739

SEQ ID NO: 1741 - protein, 171 aa, Bacillus cereus ATCC 10987; identical to SEQ ID NO: 1739

SEQ ID NO: 1742 - protein, 179 aa, Artificial
  Substituion in SEQ ID NO 1735
MKKFDTSGIDQDDLISIGTVGLIKAVDTYQPSKGTKFATYAARCIQNEILMQLRAQRKSRKDVSLYSPIGTDKEGNEITIGDILFSESDSTEDDVSRRMELNTMRQLLDVLDERERKVIELRFGLADGREWTQNEVADSLDISRSYVSRLEKRALLKMFHQSHVAKERKQAIRNARLQP

SEQ ID NO: 1743 - protein, 179 aa, Artificial
  Substituion in SEQ ID NO 1735
MKKFDTSGIDQDDLISIGTVGLIKAVDTYQPSKGTKFATYAARCIQNEILMQLRANRKSRKDVSLYSPIGTDKEGNEITIGDILFSESDSTEDEVSRRMELNTMRQLLDVLDERERKVIELRFGLADGREWTQNEVADSLDISRSYVSRLEKRALLKMFHQSHVAKERKQAIRNARLQP

SEQ ID NO: 1744 - protein, 179 aa, Artificial
  Substituion in SEQ ID NO 1735
MKKFDTSGIDQDDLISIGTVGLIKAVDTYQPSKGTKFATYAARCIQNEILMQLRAQRKSRKDVSLYSPIGTDKEGNEITIGDILFSESDSTEDEVSRRMELNTMRQLLDVLDERERKVIELRFGLADGREWTQNEVADSLDISRSYVSRLEKRALLKMFHQSHVAKERKQAIRQARLQP

SEQ ID NO: 1745 - protein, 179 aa, Artificial
  Substituion in SEQ ID NO 1735
MKKFDTSGIDQDDLISIGTVGLIKAVDTYQPSKGTKFATYAARCIQNEILMQLRAQRKSRKDVSLYSPIGTDKEGNEITIGDILFSESDSTEDEVSRRMELNTMRQLLDVLDERERKVIELRFGLADGREWTQNEVADSLDISRSYVSRLEKRALIKMFHQSHVAKERKQAIRNARLQP

SEQ ID NO: 1746 - protein, 179 aa, Artificial
  Substituion in SEQ ID NO 1735
MKKFDTSGIDQDDLISIGTVGLIKAVDTYQPSKGTKFATYAARCIQNEILMQLRAQRKSRKDVSLYSPIGTDKEGNEITLGDILFSESDSTEDEVSRRMELNTMRQLLDVLDERERKVIELRFGLADGREWTQNEVADSLDISRSYVSRLEKRALLKMFHQSHVAKERKQAIRNARLQP

SEQ ID NO: 1747 - DNA, 540 bp, Artificial
  Substituion in SEQ ID NO 1736
atgaagaagtttgatacgtccgggatcgatcaggatgacctgatttccatcggcacggtcggcttgattaaagctgtggacacgtatcagccgtccaaagggaccaaattcgcgacctacgccgcgcgatgcatccaaaacgagatcctgatgcaactgcgcgcccagcgcaagtcgcgcaaggacgtatccctgtacagccccatcggtacggataaggaggggaacgagatcaccatcggcgacatcctgttttccgagagcgactccacggaggacgatgtgtctcgccgaatggaactcaacacgatgcgtcaattgctcgacgtcctcgacgagcgtgagcgcaaagtcattgagctgagattcggcctcgccgacgggcgcgagtggacccagaacgaggtggccgactcgctcgacatctcccgctcctacgtgtcccggttggaaaaacgggcgctgctcaagatgtttcaccagtcgcacgtcgccaaggagcgcaagcaggccatccgcaacgctcgccttcaaccgtaa

SEQ ID NO: 1748 - DNA, 540 bp, Artificial
  Substituion in SEQ ID NO 1736
atgaagaagtttgatacgtccgggatcgatcaggatgacctgatttccatcggcacggtcggcttgattaaagctgtggacacgtatcagccgtccaaagggaccaaattcgcgacctacgccgcgcgatgcatccaaaacgagatcctgatgcaactgcgcgccaatcgcaagtcgcgcaaggacgtatccctgtacagccccatcggtacggataaggaggggaacgagatcaccatcggcgacatcctgttttccgagagcgactccacggaggacgaggtgtctcgccgaatggaactcaacacgatgcgtcaattgctcgacgtcctcgacgagcgtgagcgcaaagtcattgagctgagattcggcctcgccgacgggcgcgagtggacccagaacgaggtggccgactcgctcgacatctcccgctcctacgtgtcccggttggaaaaacgggcgctgctcaagatgtttcaccagtcgcacgtcgccaaggagcgcaagcaggccatccgcaacgctcgccttcaaccgtaa

SEQ ID NO: 1749 - DNA, 540 bp, Artificial
  Substituion in SEQ ID NO 1736
atgaagaagtttgatacgtccgggatcgatcaggatgacctgatttccatcggcacggtcggcttgattaaagctgtggacacgtatcagccgtccaaagggaccaaattcgcgacctacgccgcgcgatgcatccaaaacgagatcctgatgcaactgcgcgcccagcgcaagtcgcgcaaggacgtatccctgtacagccccatcggtacggataaggaggggaacgagatcaccatcggcgacatcctgttttccgagagcgactccacggaggacgaggtgtctcgccgaatggaactcaacacgatgcgtcaattgctcgacgtcctcgacgagcgtgagcgcaaagtcattgagctgagattcggcctcgccgacgggcgcgagtggacccagaacgaggtggccgactcgctcgacatctcccgctcctacgtgtcccggttggaaaaacgggcgctgctcaagatgtttcaccagtcgcacgtcgccaaggagcgcaagcaggccatccgccaagctcgccttcaaccgtaa

SEQ ID NO: 1750 - DNA, 540 bp, Artificial
  Substituion in SEQ ID NO 1736
atgaagaagtttgatacgtccgggatcgatcaggatgacctgatttccatcggcacggtcggcttgattaaagctgtggacacgtatcagccgtccaaagggaccaaattcgcgacctacgccgcgcgatgcatccaaaacgagatcctgatgcaactgcgcgcccagcgcaagtcgcgcaaggacgtatccctgtacagccccatcggtacggataaggaggggaacgagatcaccatcggcgacatcctgttttccgagagcgactccacggaggacgaggtgtctcgccgaatggaactcaacacgatgcgtcaattgctcgacgtcctcgacgagcgtgagcgcaaagtcattgagctgagattcggcctcgccgacgggcgcgagtggacccagaacgaggtggccgactcgctcgacatctcccgctcctacgtgtcccggttggaaaaacgggcgctgattaagatgtttcaccagtcgcacgtcgccaaggagcgcaagcaggccatccgcaacgctcgccttcaaccgtaa

SEQ ID NO: 1751 - DNA, 540 bp, Artificial
  Substituion in SEQ ID NO 1736
atgaagaagtttgatacgtccgggatcgatcaggatgacctgatttccatcggcacggtcggcttgattaaagctgtggacacgtatcagccgtccaaagggaccaaattcgcgacctacgccgcgcgatgcatccaaaacgagatcctgatgcaactgcgcgcccagcgcaagtcgcgcaaggacgtatccctgtacagccccatcggtacggataaggaggggaacgagatcaccttaggcgacatcctgttttccgagagcgactccacggaggacgaggtgtctcgccgaatggaactcaacacgatgcgtcaattgctcgacgtcctcgacgagcgtgagcgcaaagtcattgagctgagattcggcctcgccgacgggcgcgagtggacccagaacgaggtggccgactcgctcgacatctcccgctcctacgtgtcccggttggaaaaacgggcgctgctcaagatgtttcaccagtcgcacgtcgccaaggagcgcaagcaggccatccgcaacgctcgccttcaaccgtaa

SEQ ID NO: 1752 - protein, 185 aa, Alicyclobacillus acidocaldarius
MRHARRNETPAEDAALLAEWMELYGGDVIRLAYSYVHNFHKAEDIAQDVFLRAWQHYGEFQGQSSIKTWLLSITANRARDVLRSGAERREFADEGEAFAREIEPCDPADLVADKLARDAVWRAIRVLPETYREVMELYYGNDLTTHEVAEILGIRDQTVRTRLHRGRQMLERALAEQGGMGVDHA

SEQ ID NO: 1753 - DNA, 558 bp, Alicyclobacillus acidocaldarius
atgaggcacgcgcgtcgcaacgaaacgccggcggaggacgcggcgctgctcgccgaatggatggagttatatggcggcgacgtgatccggctggcgtactcgtatgtccacaactttcataaggctgaagacatcgcccaggatgtgttcctgcgcgcgtggcagcactatggggaatttcagggccagtcgtccatcaagacgtggcttttgtccatcacggccaaccgcgcgcgagacgtcctgcgatccggcgcggaacggcgcgagttcgccgacgagggcgaggccttcgcgcgagaaatcgaaccgtgcgatccggccgatttggtcgcggacaagttggcccgcgatgccgtgtggcgagccatccgggtgctgccggaaacgtatcgcgaggtgatggaactgtattacggaaacgatctcacgacgcatgaagtcgcagagatcctcgggattcgcgatcagacggtaaggacgcgcctgcaccgggggcggcagatgctcgagcgggcgctcgccgagcaaggagggatgggcgttgaccacgcgtga

SEQ ID NO: 1754 - protein, 183 aa, Symbiobacterium thermophilum IAM 14863
MSQSDRAALPSDRTAAIDHLMREYGTKVLHLAYSYLKDRHLAEDVAQEVFIKAYRNWENFRGESSAYTWLYRITVNLCRDKARSAWWRRLLPTDDPRAAGTPVEPDTAGDDPEEAVVLSDQRERLLDYVMQLSDAYREVIILYYYHDLTTVEIAEVTGQNENTVKTRLFRARAMLKQMLQKGG

SEQ ID NO: 1755 - protein, 175 aa, Symbiobacterium thermophilum IAM 14863
ETEARPAEAAVEAWIQQHGEAVLRLAYASLLNRAQAEDVFQEVFIRAYRHADRLRDPDRVRPWLLQVTMNACRDLRRSWWWRRTREGSGLEGLAEAGEGPAADPAAAAVRADVSQAVARAVRALPDGFRETVVLHYFEGLDAAEIARITGVRVGTVHSRLHRARQLLRRQLEAWG

SEQ ID NO: 1756 - protein, 158 aa, Clostridium kluyveri DSM 555
LERLMNCYGNDILRTAYIYLKDIHLAEDVFQDVFIKVYNNFDKFNGKSSEKTWILTITINTCRDMLRSCWIKKVLRFDDTEYGIFNSTDDLNDTEDTVIKNIEYEDILKKVMDLPKKYKEVILLYYYQELSTSEISKILKIPEGTVRSRLYRARGILK

SEQ ID NO: 1757 - protein, 160 aa, Bacillus halodurans C-125
LIAWMEEYGTAILRVVYSYVKDKQIAEDLTQEVFVRAFQSYHTYQTRSSAKAWLYRIAINRSKDFLKSWHAKHVYPSEVAEEIETTEQTPEYEVLLKSDEERLAAAVFSLPLSYREVIYFYYYEELSVKEVASFTGLNENTVKTRLRKGRLLLKNLLEKE

SEQ ID NO: 1758 - protein, 165 aa, Roseiflexus sp. RS-1
DHDAFAQLMGRYAGSVFNLAYRMLGNAQEAEDASQEIFLRAYTNLARFDQERRFSTWLLSIGSNYCIDRLRRRRFAWLTLDDVVLSVPTSAKGPERSAVEREERDAVQRALLSLPPTYREVAVLRYWNDLSYEEITQVTGLPESTIKTRLHRARRMLAEALRAEG

SEQ ID NO: 1759 - protein, 185 aa, Artificial
  Substituion in SEQ ID NO 1752
MRHARRNETPAEDAALLAEWMELYGGDVIRLAYSYVHNFHKAEDIAQDVFLRAWQHYGEFQGQSSIKTWLLSITANRARDVLRSGAERREFADEGEAFAREIEPCDPADLVADKLARDAVWRAIRVLPDTYREVMELYYGNDLTTHEVAEILGIRDQTVRTRLHRGRQMLERALAEQGGMGVDHA

SEQ ID NO: 1760 - protein, 185 aa, Artificial
  Substituion in SEQ ID NO 1752
MRHARRNETPAEDAALLAEWMELYGGDVIRLAYSYVHNFHKAEDIAQDVFLRAWQHYGDFQGQSSIKTWLLSITANRARDVLRSGAERREFADEGEAFAREIEPCDPADLVADKLARDAVWRAIRVLPETYREVMELYYGNDLTTHEVAEILGIRDQTVRTRLHRGRQMLERALAEQGGMGVDHA

SEQ ID NO: 1761 - protein, 185 aa, Artificial
  Substituion in SEQ ID NO 1752
MRHARRNETPAEDAALLAEWMELYGGDVIRLAYSYVHNFHKAEDIAQDVFLKAWQHYGEFQGQSSIKTWLLSITANRARDVLRSGAERREFADEGEAFAREIEPCDPADLVADKLARDAVWRAIRVLPETYREVMELYYGNDLTTHEVAEILGIRDQTVRTRLHRGRQMLERALAEQGGMGVDHA

SEQ ID NO: 1762 - protein, 185 aa, Artificial
  Substituion in SEQ ID NO 1752
MRHARRNETPAEDAALLAEWMELYGGDVIRLAYSYVHNFHKAEDIAQDVFLRAWQHYGEFQGQSSIKTWLLSITANRARDVLRSGAERREFADEGEAFAREIEPCDPADLVADKLARDAVWRAIRVLPETYREVMELYYGQDLTTHEVAEILGIRDQTVRTRLHRGRQMLERALAEQGGMGVDHA

SEQ ID NO: 1763 - protein, 185 aa, Artificial
  Substituion in SEQ ID NO 1752
MRHARRNETPAEDAALLAEWMELYGGDVIRLAYSYVHNFHKAEDIAQDVFLRAWQHYGEFQGQSSIKTWLLSITANRARDVLRSGAERREFADEGEAFAREIEPCDPADLVADKLARDAVWRAIRVLPETYREVMELYYGNDLTTHEVAEILGIRDQTVRTRLHRGRQMLERALAEQGGMGVEHA

SEQ ID NO: 1764 - DNA, 558 bp, Artificial
  Substituion in SEQ ID NO 1753
atgaggcacgcgcgtcgcaacgaaacgccggcggaggacgcggcgctgctcgccgaatggatggagttatatggcggcgacgtgatccggctggcgtactcgtatgtccacaactttcataaggctgaagacatcgcccaggatgtgttcctgcgcgcgtggcagcactatggggaatttcagggccagtcgtccatcaagacgtggcttttgtccatcacggccaaccgcgcgcgagacgtcctgcgatccggcgcggaacggcgcgagttcgccgacgagggcgaggccttcgcgcgagaaatcgaaccgtgcgatccggccgatttggtcgcggacaagttggcccgcgatgccgtgtggcgagccatccgggtgctgccggatacgtatcgcgaggtgatggaactgtattacggaaacgatctcacgacgcatgaagtcgcagagatcctcgggattcgcgatcagacggtaaggacgcgcctgcaccgggggcggcagatgctcgagcgggcgctcgccgagcaaggagggatgggcgttgaccacgcgtga

SEQ ID NO: 1765 - DNA, 558 bp, Artificial
  Substituion in SEQ ID NO 1753
atgaggcacgcgcgtcgcaacgaaacgccggcggaggacgcggcgctgctcgccgaatggatggagttatatggcggcgacgtgatccggctggcgtactcgtatgtccacaactttcataaggctgaagacatcgcccaggatgtgttcctgcgcgcgtggcagcactatggggattttcagggccagtcgtccatcaagacgtggcttttgtccatcacggccaaccgcgcgcgagacgtcctgcgatccggcgcggaacggcgcgagttcgccgacgagggcgaggccttcgcgcgagaaatcgaaccgtgcgatccggccgatttggtcgcggacaagttggcccgcgatgccgtgtggcgagccatccgggtgctgccggaaacgtatcgcgaggtgatggaactgtattacggaaacgatctcacgacgcatgaagtcgcagagatcctcgggattcgcgatcagacggtaaggacgcgcctgcaccgggggcggcagatgctcgagcgggcgctcgccgagcaaggagggatgggcgttgaccacgcgtga

SEQ ID NO: 1766 - DNA, 558 bp, Artificial
  Substituion in SEQ ID NO 1753
atgaggcacgcgcgtcgcaacgaaacgccggcggaggacgcggcgctgctcgccgaatggatggagttatatggcggcgacgtgatccggctggcgtactcgtatgtccacaactttcataaggctgaagacatcgcccaggatgtgttcctgaaagcgtggcagcactatggggaatttcagggccagtcgtccatcaagacgtggcttttgtccatcacggccaaccgcgcgcgagacgtcctgcgatccggcgcggaacggcgcgagttcgccgacgagggcgaggccttcgcgcgagaaatcgaaccgtgcgatccggccgatttggtcgcggacaagttggcccgcgatgccgtgtggcgagccatccgggtgctgccggaaacgtatcgcgaggtgatggaactgtattacggaaacgatctcacgacgcatgaagtcgcagagatcctcgggattcgcgatcagacggtaaggacgcgcctgcaccgggggcggcagatgctcgagcgggcgctcgccgagcaaggagggatgggcgttgaccacgcgtga

SEQ ID NO: 1767 - DNA, 558 bp, Artificial
  Substituion in SEQ ID NO 1753
atgaggcacgcgcgtcgcaacgaaacgccggcggaggacgcggcgctgctcgccgaatggatggagttatatggcggcgacgtgatccggctggcgtactcgtatgtccacaactttcataaggctgaagacatcgcccaggatgtgttcctgcgcgcgtggcagcactatggggaatttcagggccagtcgtccatcaagacgtggcttttgtccatcacggccaaccgcgcgcgagacgtcctgcgatccggcgcggaacggcgcgagttcgccgacgagggcgaggccttcgcgcgagaaatcgaaccgtgcgatccggccgatttggtcgcggacaagttggcccgcgatgccgtgtggcgagccatccgggtgctgccggaaacgtatcgcgaggtgatggaactgtattacggacaagatctcacgacgcatgaagtcgcagagatcctcgggattcgcgatcagacggtaaggacgcgcctgcaccgggggcggcagatgctcgagcgggcgctcgccgagcaaggagggatgggcgttgaccacgcgtga

SEQ ID NO: 1768 - DNA, 558 bp, Artificial
  Substituion in SEQ ID NO 1753
atgaggcacgcgcgtcgcaacgaaacgccggcggaggacgcggcgctgctcgccgaatggatggagttatatggcggcgacgtgatccggctggcgtactcgtatgtccacaactttcataaggctgaagacatcgcccaggatgtgttcctgcgcgcgtggcagcactatggggaatttcagggccagtcgtccatcaagacgtggcttttgtccatcacggccaaccgcgcgcgagacgtcctgcgatccggcgcggaacggcgcgagttcgccgacgagggcgaggccttcgcgcgagaaatcgaaccgtgcgatccggccgatttggtcgcggacaagttggcccgcgatgccgtgtggcgagccatccgggtgctgccggaaacgtatcgcgaggtgatggaactgtattacggaaacgatctcacgacgcatgaagtcgcagagatcctcgggattcgcgatcagacggtaaggacgcgcctgcaccgggggcggcagatgctcgagcgggcgctcgccgagcaaggagggatgggcgttgaacacgcgtga

SEQ ID NO: 1769 - protein, 129 aa, Alicyclobacillus acidocaldarius
QIPDEILRKPGRLTPEEFDIMKMHTIYGRDMMNSPVHPFLHIGSTVAEQHHERYDGSGYPYGLKGEEIYLPAAIVAVVDSYDAMTSQRPYQRPKSKHEAIEEIRALRGKLYDPRVVDAFLKVVDTFEDT

SEQ ID NO: 1770 - DNA, 390 bp, Alicyclobacillus acidocaldarius
caaatacctgacgaaattcttaggaaacctggtagactcactcctgaagaatttgatattatgaagatgcatacaatttacgggcgcgatatgatgaactccccagtgcacccgttcctgcatataggtagtaccgttgctgagcagcatcatgaacgatatgacggaagcggttatccatacggactaaaaggggaggaaatatacctgcctgccgcgatcgtcgcagtcgtagatagttatgatgccatgacgtcgcaacggccttatcaaagacctaagtcgaaacacgaagccattgaggagattcgcgctcttaggggtaagttgtacgacccgcgcgtcgttgacgcgtttctcaaggtcgtagatacatttgaggacacgtga

SEQ ID NO: 1771 - protein, 127 aa, Thermotoga petrophila RKU-1
IPDRILLKPGILTPEEFEIMKQHTTIGFKILSRSNSPILQLGAEIALTHHERWDGSGYPRGLKGREIPISGLIVAVADSFDAMVSKRPYKNPKPLEEAFREIESLSGKLYSPEVVEAFLKLEKEITD

SEQ ID NO: 1772 - protein, 121 aa, Thermotoga sp. RQ7
IPDRILLKPGILTPEEFEIMKQHTTIGFRILSRSSSPILQLGAEIALTHHERWNGSGYPKGLKGKEIPLSGLIVAVADSFDAMVSRRPYKKPKTLEEAFQEIEELSGKLYSPEVVKAFLKL

SEQ ID NO: 1773 - protein, 127 aa, Thermotoga sp. RQ2
IPDRILLKPGILTPEEFEIMKQHTTIGFRILSRSNSPILQLGAEIALTHHERWNGAGYPRGLKGREIPISGLIVAVADSFDAMVSKRPYKNPKPLEEAFREIESLSGKLYSPEVVEAFLKLEKEITD

SEQ ID NO: 1774 - protein, 127 aa, Thermotoga maritima MSB8
IPDRILLKPGILTPEEFEIMKQHTTIGFRILSRSNSPILQLGAEIALTHHERWDGSGYPRGLKEREIPISGLIVAVADSFDAMVSRRPYKNPKPLEEAFREIESLSGKLYSPEVVEAFLKLEKEITD

SEQ ID NO: 1775 - protein, 124 aa, Bacillus selenitireducens MLS10
QVPEEILLKPSKLTEEEWAIMKLHTSYGAEMLRETCISHFLLAAEVVEQHHERYDGSGYPRGLKKEEISLEAAIVGLVDSYDAITSERVYQHARSHESALNELRGLRGIKYQPDVVDAFTDVIE

SEQ ID NO: 1776 - protein, 129 aa, Artificial
  Substituion in SEQ ID NO 1769
QIPDEILRKPGRLTPEEFDIMKMHTIYGRDMMNSPVHPFIHIGSTVAEQHHERYDGSGYPYGLKGEEIYLPAAIVAVVDSYDAMTSQRPYQRPKSKHEAIEEIRALRGKLYDPRVVDAFLKVVDTFEDT

SEQ ID NO: 1777 - protein, 129 aa, Artificial
  Substituion in SEQ ID NO 1769
QIPDEILRKPGRLTPEEFDIMKMHTIYGRDMMNSPVHPFLHIGSTVAEQHHERYDGSGYPYGLKGEEIYLPAAIVAVVDSYDAMTSQRPYQKPKSKHEAIEEIRALRGKLYDPRVVDAFLKVVDTFEDT

SEQ ID NO: 1778 - protein, 129 aa, Artificial
  Substituion in SEQ ID NO 1769
QIPDEILRKPGRLTPEEFDIMKMHTIYGRDMMNSPVHPFLHIGSTVAEQHHERYDGSGYPYGLKGEEIYLPAAIVAVVDSYDAMTSQRPYQRPKSKHEAIEEIRALRGKLYDPRVVDAFLKVVDTFEET

SEQ ID NO: 1779 - protein, 129 aa, Artificial
  Substituion in SEQ ID NO 1769
QIPDEILRKPGRLTPEEFDIMKMHTIYGREMMNSPVHPFLHIGSTVAEQHHERYDGSGYPYGLKGEEIYLPAAIVAVVDSYDAMTSQRPYQRPKSKHEAIEEIRALRGKLYDPRVVDAFLKVVDTFEDT

SEQ ID NO: 1780 - protein, 129 aa, Artificial
  Substituion in SEQ ID NO 1769
QIPDEILRKPGRLTPEEFDIMKMHTIYGRDMMNSPVHPFLHIGSTIAEQHHERYDGSGYPYGLKGEEIYLPAAIVAVVDSYDAMTSQRPYQRPKSKHEAIEEIRALRGKLYDPRVVDAFLKVVDTFEDT

SEQ ID NO: 1781 - DNA, 390 bp, Artificial
  Substituion in SEQ ID NO 1770
caaatacctgacgaaattcttaggaaacctggtagactcactcctgaagaatttgatattatgaagatgcatacaatttacgggcgcgatatgatgaactccccagtgcacccgttcattcatataggtagtaccgttgctgagcagcatcatgaacgatatgacggaagcggttatccatacggactaaaaggggaggaaatatacctgcctgccgcgatcgtcgcagtcgtagatagttatgatgccatgacgtcgcaacggccttatcaaagacctaagtcgaaacacgaagccattgaggagattcgcgctcttaggggtaagttgtacgacccgcgcgtcgttgacgcgtttctcaaggtcgtagatacatttgaggacacgtga

SEQ ID NO: 1782 - DNA, 390 bp, Artificial
  Substituion in SEQ ID NO 1770
caaatacctgacgaaattcttaggaaacctggtagactcactcctgaagaatttgatattatgaagatgcatacaatttacgggcgcgatatgatgaactccccagtgcacccgttcctgcatataggtagtaccgttgctgagcagcatcatgaacgatatgacggaagcggttatccatacggactaaaaggggaggaaatatacctgcctgccgcgatcgtcgcagtcgtagatagttatgatgccatgacgtcgcaacggccttatcaaaaacctaagtcgaaacacgaagccattgaggagattcgcgctcttaggggtaagttgtacgacccgcgcgtcgttgacgcgtttctcaaggtcgtagatacatttgaggacacgtga

SEQ ID NO: 1783 - DNA, 390 bp, Artificial
  Substituion in SEQ ID NO 1770
caaatacctgacgaaattcttaggaaacctggtagactcactcctgaagaatttgatattatgaagatgcatacaatttacgggcgcgatatgatgaactccccagtgcacccgttcctgcatataggtagtaccgttgctgagcagcatcatgaacgatatgacggaagcggttatccatacggactaaaaggggaggaaatatacctgcctgccgcgatcgtcgcagtcgtagatagttatgatgccatgacgtcgcaacggccttatcaaagacctaagtcgaaacacgaagccattgaggagattcgcgctcttaggggtaagttgtacgacccgcgcgtcgttgacgcgtttctcaaggtcgtagatacatttgaggaaacgtga

SEQ ID NO: 1784 - DNA, 390 bp, Artificial
  Substituion in SEQ ID NO 1770
caaatacctgacgaaattcttaggaaacctggtagactcactcctgaagaatttgatattatgaagatgcatacaatttacgggcgcgaaatgatgaactccccagtgcacccgttcctgcatataggtagtaccgttgctgagcagcatcatgaacgatatgacggaagcggttatccatacggactaaaaggggaggaaatatacctgcctgccgcgatcgtcgcagtcgtagatagttatgatgccatgacgtcgcaacggccttatcaaagacctaagtcgaaacacgaagccattgaggagattcgcgctcttaggggtaagttgtacgacccgcgcgtcgttgacgcgtttctcaaggtcgtagatacatttgaggacacgtga

SEQ ID NO: 1785 - DNA, 390 bp, Artificial
  Substituion in SEQ ID NO 1770
caaatacctgacgaaattcttaggaaacctggtagactcactcctgaagaatttgatattatgaagatgcatacaatttacgggcgcgatatgatgaactccccagtgcacccgttcctgcatataggtagtaccattgctgagcagcatcatgaacgatatgacggaagcggttatccatacggactaaaaggggaggaaatatacctgcctgccgcgatcgtcgcagtcgtagatagttatgatgccatgacgtcgcaacggccttatcaaagacctaagtcgaaacacgaagccattgaggagattcgcgctcttaggggtaagttgtacgacccgcgcgtcgttgacgcgtttctcaaggtcgtagatacatttgaggacacgtga

SEQ ID NO: 1786 - protein, 275 aa, Alicyclobacillus acidocaldarius
MIKRREVRTVYPKERQRVLLELLAQHGFASYRQLAERLGVSEITVRRDMKALEAQGLVETAFGGGQVARAARELPYTDKRILQIPEKIAIAKAALRQIESGMTIAIAAGTTTWVLAQHIAGFQNLTFLTNSVNVATELSKNGYRDIFLTGGQFRTPSDALVGPVAEHMIRQFRADILFVGASGLHVDHGLSTPNVLEAAVNRAMMERAARVVVLADHTKWGVESLMSFAKLSEIDALITDRWPGEAEAAALAECDVDLIVADAPNAESSKRGDAQ

SEQ ID NO: 1787 - DNA, 828 bp, Alicyclobacillus acidocaldarius
ttgatcaagcggcgcgaggtgagaacggtgtatccgaaggaacggcagcgcgtgctcttggagctgctcgcccagcacggcttcgcgtcttaccgccaattggcggaacggctcggcgtgtccgagatcacggttcgccgggacatgaaagcgctcgaggcgcagggcctcgtcgagaccgcgtttggcggcggtcaggtggcgcgcgcggcccgtgaactcccgtacaccgacaagcgcattctccagatcccggagaaaatcgccatcgccaaggccgcgcttcggcagattgaatccggcatgaccatcgccatcgccgcgggcaccaccacgtgggtcctcgcgcaacacatcgcaggttttcagaatctgacgtttctcaccaattccgtgaatgtcgccacggagttgagcaagaacggctaccgagacatcttcctcacaggcggccagtttcgaacgccgagcgacgccctcgtgggccccgtggccgagcacatgatccgccaattccgcgcggacatcctgtttgttggcgcgagcggcctgcacgtcgatcacggcctgtcgacgcccaacgtgctcgaagccgcggtcaaccgggcgatgatggaacgcgccgcgcgcgtcgtggtgctcgccgaccacaccaagtggggtgtggagtcgctcatgagcttcgcgaagctcagcgagatcgacgcgctcatcacggaccgatggccgggcgaggcggaggcggccgccctcgcggaatgcgacgtggatctcatcgtcgccgatgcgccaaacgccgaatcctccaaacgaggtgatgcccaatga

SEQ ID NO: 1788 - protein, 255 aa, Saccharopolyspora erythraea NRRL 2338
RQRQEVILNEVRRTGAVQVSALVLQLGVSDMTIRRDLDALARRGLVEKVYGGATSMVGRSTDEPGFEAKSVRQLAEKEAIAMLAAEQVRPGTAIGLSAGTTTWTLARHLDDVADLTVVTNSIRVADALQQRGRTDRTVVLTGGVRTPSDALVGPVAVQSLRSLHLDLVFLGVHGIAARAGFTTPNLNESETNRALAEAANRLVVVADHSKWSTVGISTIVDLHEVDLLISDDGLPQEARQVLSENVPELVLAEVP

SEQ ID NO: 1789 - protein, 256 aa, Kineococcus radiotolerans SRS30216
QRQEVILDAVRTHGGVRVADLVERLGVSEMTVRRDIGELSRRGLVARVHGGAASVARSSEEPGFAAKAGLRPDAKRAIARAAADLVPDGASVALSAGTTTAEVARELRDVSDLTVVTNSPRVADLLHDPADHSRTVVLSGGTRTPSDALVGPVARAGLRGLHVDLLFLGVHGLDAAAGLSTPNLSEADTNRALMDCAARVVVVADASKWGVVGLTSFADLGSVDVLVTDAALDPSARPVISDLVGELVVAGTPQEE

SEQ ID NO: 1790 - protein, 264 aa, Streptomyces coelicolor A3(2)
EQRRALILDEVRRRGGVRVNELTRKLGVSDMTVRRDLDALSRQGVLEKVHGGAVPVAEASTHEPGFEAKSGLEPTAKEDIARAAAELVAPGAAIALSGGTTTYALAHRLVDVPDLTVVTNSVRVADVFHVAQRTSGARQGGATVVLTGGVRTPSDSLVGPVADQAIATLHFDALFLGVHGISAEAGLSTPNLAEAETNRRLVQSARRVVVVADHTKWGVVGLSSFAALEQVDTLVTDSGLSADARAEVAEHLGLVVAGEPEPEA

SEQ ID NO: 1791 - protein, 268 aa, Streptomyces avermitilis MA-4680
ENQNLLAEQRRALILDEVRRRGGVRVNELTRKLGVSDMTVRRDLDALARQGVLEKVHGGAVPVVEASTHEPGFEAKSGLELTAKEDIARAAAELVAPGTAIALSGGTTTYALAHQLVDVPDLTVVTNSVRVADVFHAAQRTSGQRQGAATVVLTGGVRTPSDSLVGPVADQAIVALHFDVLFLGVHGISVEAGLSTPNLAEAETNRRLVQSARRVVVVADHTKWGTVGLSSFASLDQVDTLVTDAGLPAGARAEVSEHLRRLVVAGEP

SEQ ID NO: 1792 - protein, 255 aa, Janibacter sp. HTCC2649
QRRAAILSMVQDSGAVRVSDLVEHLGVSDMTVRRDIERLDTDGLLERVHGGALALLPRATDEPGFTAKSSLMTAAKHAIALAAARLVDPGATIGISAGTTTYEFARAIRNIPHLTVVTNSVPVAQLLHESGGNHVVVLTGGVRTPSDALVGPVAVAALQGLHVDRLFLGAHGIDRNAGLTTPNLVEAETNRALVRASRSVCVLADHSKVGIVGLSTFMALHEVDTLITDPGTPARVRALLEDSVDHLVLAEVASA

SEQ ID NO: 1793 - protein, 275 aa, Artificial
  Substituion in SEQ ID NO 1786
MIKRREVRTVYPKERQRVLLELLAQHGFASYRQLAERLGVSEITVRRDMKALEAQGLVETAFGGGQVARAARELPYTDKRILQIPEKIAIAKAALRQIESGMTIAIAAGTTTWVLAQHIAGFQNLTFLTNSVNVATELSKNGYRDIFLTGGQFRTPSDALVGPVAEHMIRQFRADILFVGASGLHVDHGLSTPNVLEAAVNRAMMERAARVVVLADHTKWGVESIMSFAKLSEIDALITDRWPGEAEAAALAECDVDLIVADAPNAESSKRGDAQ

SEQ ID NO: 1794 - protein, 275 aa, Artificial
  Substituion in SEQ ID NO 1786
MIKRREVRTVYPKERQRVLLELLAQHGFASYRQLAERLGVSEITVRRDMKALEAQGLVETAFGGGQVARAARELPYTDKRILQIPEKIAIAKAALRQIESGMTIAIAAGTTTWVLAQHIAGFQNLTFLTNSVNVATELSKNGYRDIFLTGGQFRTPSDALVGPVAEHMIRQFRADILFVGASGLHVDHGLSTPNVLEAAVNRAMMERAARVVVLADHTKWGVESLMSFAKLSEIDALITDRWPGEAEAAALAECDVDLIVADAPNAESSKRGEAQ

SEQ ID NO: 1795 - protein, 275 aa, Artificial
  Substituion in SEQ ID NO 1786
MIKRREVRTVYPKERQRVLLELLAQHGFASYRQLAERLGVSEITVRRDMKALEAQGLVETAFGGGQVARAARELPYTDKRILQIPEKIAIAKAALRQIESGMTIAIAAGTTTWVLAQHIAGFQNLTFLTNSVNVATELSKNGYREIFLTGGQFRTPSDALVGPVAEHMIRQFRADILFVGASGLHVDHGLSTPNVLEAAVNRAMMERAARVVVLADHTKWGVESLMSFAKLSEIDALITDRWPGEAEAAALAECDVDLIVADAPNAESSKRGDAQ

SEQ ID NO: 1796 - protein, 275 aa, Artificial
  Substituion in SEQ ID NO 1786
MIKRREVRTVYPKERQRVLLELLAQHGFASYRQLAERLGVSEITVRRDMKALEAQGLIETAFGGGQVARAARELPYTDKRILQIPEKIAIAKAALRQIESGMTIAIAAGTTTWVLAQHIAGFQNLTFLTNSVNVATELSKNGYRDIFLTGGQFRTPSDALVGPVAEHMIRQFRADILFVGASGLHVDHGLSTPNVLEAAVNRAMMERAARVVVLADHTKWGVESLMSFAKLSEIDALITDRWPGEAEAAALAECDVDLIVADAPNAESSKRGDAQ

SEQ ID NO: 1797 - protein, 275 aa, Artificial
  Substituion in SEQ ID NO 1786
MIKRREVRTVYPKERQRVLLELLAQHGFASYRQLAERLGVSEITVRRDMKALEAQGLVETAFGGGQVARAARELPYTDKRILQIPEKIAIAKAALRQIESGMTIAIAAGTTTWVLAQHIAGFQNLTFLTNSVNVATELSKNGYRDIFLTGGQFRTPSDALVGPVAEHMIRQFRADILFVGASGLHVDHGLSTPNVLEAAVNRAMMERAARVVVIADHTKWGVESLMSFAKLSEIDALITDRWPGEAEAAALAECDVDLIVADAPNAESSKRGDAQ

SEQ ID NO: 1798 - DNA, 828 bp, Artificial
  Substituion in SEQ ID NO 1787
ttgatcaagcggcgcgaggtgagaacggtgtatccgaaggaacggcagcgcgtgctcttggagctgctcgcccagcacggcttcgcgtcttaccgccaattggcggaacggctcggcgtgtccgagatcacggttcgccgggacatgaaagcgctcgaggcgcagggcctcgtcgagaccgcgtttggcggcggtcaggtggcgcgcgcggcccgtgaactcccgtacaccgacaagcgcattctccagatcccggagaaaatcgccatcgccaaggccgcgcttcggcagattgaatccggcatgaccatcgccatcgccgcgggcaccaccacgtgggtcctcgcgcaacacatcgcaggttttcagaatctgacgtttctcaccaattccgtgaatgtcgccacggagttgagcaagaacggctaccgagacatcttcctcacaggcggccagtttcgaacgccgagcgacgccctcgtgggccccgtggccgagcacatgatccgccaattccgcgcggacatcctgtttgttggcgcgagcggcctgcacgtcgatcacggcctgtcgacgcccaacgtgctcgaagccgcggtcaaccgggcgatgatggaacgcgccgcgcgcgtcgtggtgctcgccgaccacaccaagtggggtgtggagtcgattatgagcttcgcgaagctcagcgagatcgacgcgctcatcacggaccgatggccgggcgaggcggaggcggccgccctcgcggaatgcgacgtggatctcatcgtcgccgatgcgccaaacgccgaatcctccaaacgaggtgatgcccaatga

SEQ ID NO: 1799 - DNA, 828 bp, Artificial
  Substituion in SEQ ID NO 1787
ttgatcaagcggcgcgaggtgagaacggtgtatccgaaggaacggcagcgcgtgctcttggagctgctcgcccagcacggcttcgcgtcttaccgccaattggcggaacggctcggcgtgtccgagatcacggttcgccgggacatgaaagcgctcgaggcgcagggcctcgtcgagaccgcgtttggcggcggtcaggtggcgcgcgcggcccgtgaactcccgtacaccgacaagcgcattctccagatcccggagaaaatcgccatcgccaaggccgcgcttcggcagattgaatccggcatgaccatcgccatcgccgcgggcaccaccacgtgggtcctcgcgcaacacatcgcaggttttcagaatctgacgtttctcaccaattccgtgaatgtcgccacggagttgagcaagaacggctaccgagacatcttcctcacaggcggccagtttcgaacgccgagcgacgccctcgtgggccccgtggccgagcacatgatccgccaattccgcgcggacatcctgtttgttggcgcgagcggcctgcacgtcgatcacggcctgtcgacgcccaacgtgctcgaagccgcggtcaaccgggcgatgatggaacgcgccgcgcgcgtcgtggtgctcgccgaccacaccaagtggggtgtggagtcgctcatgagcttcgcgaagctcagcgagatcgacgcgctcatcacggaccgatggccgggcgaggcggaggcggccgccctcgcggaatgcgacgtggatctcatcgtcgccgatgcgccaaacgccgaatcctccaaacgaggtgaagcccaatga

SEQ ID NO: 1800 - DNA, 828 bp, Artificial
  Substituion in SEQ ID NO 1787
ttgatcaagcggcgcgaggtgagaacggtgtatccgaaggaacggcagcgcgtgctcttggagctgctcgcccagcacggcttcgcgtcttaccgccaattggcggaacggctcggcgtgtccgagatcacggttcgccgggacatgaaagcgctcgaggcgcagggcctcgtcgagaccgcgtttggcggcggtcaggtggcgcgcgcggcccgtgaactcccgtacaccgacaagcgcattctccagatcccggagaaaatcgccatcgccaaggccgcgcttcggcagattgaatccggcatgaccatcgccatcgccgcgggcaccaccacgtgggtcctcgcgcaacacatcgcaggttttcagaatctgacgtttctcaccaattccgtgaatgtcgccacggagttgagcaagaacggctaccgagaaatcttcctcacaggcggccagtttcgaacgccgagcgacgccctcgtgggccccgtggccgagcacatgatccgccaattccgcgcggacatcctgtttgttggcgcgagcggcctgcacgtcgatcacggcctgtcgacgcccaacgtgctcgaagccgcggtcaaccgggcgatgatggaacgcgccgcgcgcgtcgtggtgctcgccgaccacaccaagtggggtgtggagtcgctcatgagcttcgcgaagctcagcgagatcgacgcgctcatcacggaccgatggccgggcgaggcggaggcggccgccctcgcggaatgcgacgtggatctcatcgtcgccgatgcgccaaacgccgaatcctccaaacgaggtgatgcccaatga

SEQ ID NO: 1801 - DNA, 828 bp, Artificial
  Substituion in SEQ ID NO 1787
ttgatcaagcggcgcgaggtgagaacggtgtatccgaaggaacggcagcgcgtgctcttggagctgctcgcccagcacggcttcgcgtcttaccgccaattggcggaacggctcggcgtgtccgagatcacggttcgccgggacatgaaagcgctcgaggcgcagggcctcattgagaccgcgtttggcggcggtcaggtggcgcgcgcggcccgtgaactcccgtacaccgacaagcgcattctccagatcccggagaaaatcgccatcgccaaggccgcgcttcggcagattgaatccggcatgaccatcgccatcgccgcgggcaccaccacgtgggtcctcgcgcaacacatcgcaggttttcagaatctgacgtttctcaccaattccgtgaatgtcgccacggagttgagcaagaacggctaccgagacatcttcctcacaggcggccagtttcgaacgccgagcgacgccctcgtgggccccgtggccgagcacatgatccgccaattccgcgcggacatcctgtttgttggcgcgagcggcctgcacgtcgatcacggcctgtcgacgcccaacgtgctcgaagccgcggtcaaccgggcgatgatggaacgcgccgcgcgcgtcgtggtgctcgccgaccacaccaagtggggtgtggagtcgctcatgagcttcgcgaagctcagcgagatcgacgcgctcatcacggaccgatggccgggcgaggcggaggcggccgccctcgcggaatgcgacgtggatctcatcgtcgccgatgcgccaaacgccgaatcctccaaacgaggtgatgcccaatga

SEQ ID NO: 1802 - DNA, 828 bp, Artificial
  Substituion in SEQ ID NO 1787
ttgatcaagcggcgcgaggtgagaacggtgtatccgaaggaacggcagcgcgtgctcttggagctgctcgcccagcacggcttcgcgtcttaccgccaattggcggaacggctcggcgtgtccgagatcacggttcgccgggacatgaaagcgctcgaggcgcagggcctcgtcgagaccgcgtttggcggcggtcaggtggcgcgcgcggcccgtgaactcccgtacaccgacaagcgcattctccagatcccggagaaaatcgccatcgccaaggccgcgcttcggcagattgaatccggcatgaccatcgccatcgccgcgggcaccaccacgtgggtcctcgcgcaacacatcgcaggttttcagaatctgacgtttctcaccaattccgtgaatgtcgccacggagttgagcaagaacggctaccgagacatcttcctcacaggcggccagtttcgaacgccgagcgacgccctcgtgggccccgtggccgagcacatgatccgccaattccgcgcggacatcctgtttgttggcgcgagcggcctgcacgtcgatcacggcctgtcgacgcccaacgtgctcgaagccgcggtcaaccgggcgatgatggaacgcgccgcgcgcgtcgtggtgattgccgaccacaccaagtggggtgtggagtcgctcatgagcttcgcgaagctcagcgagatcgacgcgctcatcacggaccgatggccgggcgaggcggaggcggccgccctcgcggaatgcgacgtggatctcatcgtcgccgatgcgccaaacgccgaatcctccaaacgaggtgatgcccaatga

SEQ ID NO: 1803 - protein, 156 aa, Alicyclobacillus acidocaldarius
MKRRLSVQSKEQRLMRIREIVSQNEIETQEDLVRALEEAGFPVTQATISRDIKELQLVKVVGSNGKYKYALPTAVNKVSVDALQRRLAEVFISHARANNLIVIKVAPGNAHAIGALMDALDPPGLLGTICGDDTMLLVCQDEEAAVRLLNETLNIG

SEQ ID NO: 1804 - DNA, 471 bp, Alicyclobacillus acidocaldarius
atgaaaaggagactgtctgtgcaaagcaaggagcagcgcttgatgcgcattcgcgagattgtgagccagaacgagattgagacgcaggaggatttggtgcgcgcgctcgaggaggcgggattccccgtcacgcaggccaccatctcgcgcgatatcaaggagctacagctcgtgaaggtggtgggctcgaacggcaagtacaagtacgccctgcccaccgcggtgaacaaggtctcggtggacgcgctgcagcggcggctggccgaggtgttcatttcgcacgcgcgcgccaacaacctcattgtcatcaaagtggcgcctgggaacgcgcacgccatcggcgcgctgatggacgcgctggatccgcccgggttgctcggcaccatctgcggagacgacacgatgctgctcgtgtgccaggacgaggaggccgccgtccgcctgctgaacgagacgctgaacatcgggtga

SEQ ID NO: 1805 - protein, 147 aa, Bacillus Stearothermophilus
NKGQRHIKIREIIMSNDIETQDELVDRLREAGFNVTQATVSRDIKEMQLVKVPMANGRYKYSLPSDQRFNPLQKLKRALVDVFIKLDGTGNLLVLRTLPGNAHAIGVLLDNLDWDEIVGTICGDDTCLIICRTPKDAKKVSNQLLSM

SEQ ID NO: 1806 - protein, 147 aa, Geobacillus stearothermophilus; identical to SEQ ID NO: 1805

SEQ ID NO: 1807 - protein, 147 aa, Exiguobacterium sibiricum 255-15
TKGQRLIKIREIITQSEIETQDELVEELRNAGYKVTQATVSRDIKELHLVKVPLNDGRYKYSLPADQRFNPLGKLRRLLGDSFISIDSAQNLIVMHVLPGNANALGVLLDHLNWPELLGTVCGDDTILMITRNEEAATEVTERILGM

SEQ ID NO: 1808 - protein, 147 aa, Bacillus halodurans C-125
NKGQRHIKIREIIANNDVETQDELVEQLKAAGYNVTQATVSRDIKELHLVKVPMMDGRYKYSLPADQRFNPLQKLKRGLVDSFVSIDRTDNLIVMKTLPGNAHAIGALIDNLDWTEIMGTICGDDTILIICKDKQDGPVVTERFLNM

SEQ ID NO: 1809 - protein, 147 aa, Geobacillus thermodenitrificans NG80-2
NKGQRHIKIREIIMNSDIETQDELVDRLKEAGFNVTQATVSRDIKEMQLVKVPMANGRYKYSLPSDQRFNPLQKLKRALVDVFIKLDGTGNLLVLRTLPGNAHAIGVLLDNLDWGEIVGTICGDDTCLIICRTPKDAKKVSNQLLSM

SEQ ID NO: 1810 - protein, 156 aa, Artificial
  Substituion in SEQ ID NO 1803
MKRRLSVQSKEQRLMRIREIVSQNEIETQEDLVRALEEAGFPVTQATISRDIKELQLVKVVGSNGKYKYALPTAVNKVSVDALQRRLAEVFISHARANNLIVIKVAPGNAHAIGALMDALDPPGLLGTICGDDTMLLVCQDEDAAVRLLNETLNIG

SEQ ID NO: 1811 - protein, 156 aa, Artificial
  Substituion in SEQ ID NO 1803
MKRRLSVQSKEQRLMRIREIVSQNEIETQEDLVRALEEAGFPVTQATISRDIKELQLVKVVGSNGKYKYALPTAVNKVSVDALNRRLAEVFISHARANNLIVIKVAPGNAHAIGALMDALDPPGLLGTICGDDTMLLVCQDEEAAVRLLNETLNIG

SEQ ID NO: 1812 - protein, 156 aa, Artificial
  Substituion in SEQ ID NO 1803
MKRRLSVQSKEQRLMRIREIVSQNEIETQEDLVRALEEAGFPVTQATISRDIKELQLVKVVGSNGKYKYALPTAVNKVSVDALQRRLAEVFISHARANNLIVIKVAPGNAHAIGALMDALDPPGLLGTICGDDTMLLVCQDEEAAVRLLNETLQIG

SEQ ID NO: 1813 - protein, 156 aa, Artificial
  Substituion in SEQ ID NO 1803
MKRRLSVQSKEQRLMRIREIVSQNEIETQEDLVRALEEAGFPVTQATISRDIKELQLVKVVGSNGKYKYALPTAVNKVSVDALQRRLAEVFISHARANNLIVIKVAPGNAHAIGALMDALEPPGLLGTICGDDTMLLVCQDEEAAVRLLNETLNIG

SEQ ID NO: 1814 - protein, 156 aa, Artificial
  Substituion in SEQ ID NO 1803
MKRRLSVQSKEQRLMRIREIVSQNEIETQEDLVRALEEAGFPVTQATISRDIKELQLVKVVGSNGKYKYALPTAVNRVSVDALQRRLAEVFISHARANNLIVIKVAPGNAHAIGALMDALDPPGLLGTICGDDTMLLVCQDEEAAVRLLNETLNIG

SEQ ID NO: 1815 - DNA, 471 bp, Artificial
  Substituion in SEQ ID NO 1804
atgaaaaggagactgtctgtgcaaagcaaggagcagcgcttgatgcgcattcgcgagattgtgagccagaacgagattgagacgcaggaggatttggtgcgcgcgctcgaggaggcgggattccccgtcacgcaggccaccatctcgcgcgatatcaaggagctacagctcgtgaaggtggtgggctcgaacggcaagtacaagtacgccctgcccaccgcggtgaacaaggtctcggtggacgcgctgcagcggcggctggccgaggtgttcatttcgcacgcgcgcgccaacaacctcattgtcatcaaagtggcgcctgggaacgcgcacgccatcggcgcgctgatggacgcgctggatccgcccgggttgctcggcaccatctgcggagacgacacgatgctgctcgtgtgccaggacgaggatgccgccgtccgcctgctgaacgagacgctgaacatcgggtga

SEQ ID NO: 1816 - DNA, 471 bp, Artificial
  Substituion in SEQ ID NO 1804
atgaaaaggagactgtctgtgcaaagcaaggagcagcgcttgatgcgcattcgcgagattgtgagccagaacgagattgagacgcaggaggatttggtgcgcgcgctcgaggaggcgggattccccgtcacgcaggccaccatctcgcgcgatatcaaggagctacagctcgtgaaggtggtgggctcgaacggcaagtacaagtacgccctgcccaccgcggtgaacaaggtctcggtggacgcgctgaatcggcggctggccgaggtgttcatttcgcacgcgcgcgccaacaacctcattgtcatcaaagtggcgcctgggaacgcgcacgccatcggcgcgctgatggacgcgctggatccgcccgggttgctcggcaccatctgcggagacgacacgatgctgctcgtgtgccaggacgaggaggccgccgtccgcctgctgaacgagacgctgaacatcgggtga

SEQ ID NO: 1817 - DNA, 471 bp, Artificial
  Substituion in SEQ ID NO 1804
atgaaaaggagactgtctgtgcaaagcaaggagcagcgcttgatgcgcattcgcgagattgtgagccagaacgagattgagacgcaggaggatttggtgcgcgcgctcgaggaggcgggattccccgtcacgcaggccaccatctcgcgcgatatcaaggagctacagctcgtgaaggtggtgggctcgaacggcaagtacaagtacgccctgcccaccgcggtgaacaaggtctcggtggacgcgctgcagcggcggctggccgaggtgttcatttcgcacgcgcgcgccaacaacctcattgtcatcaaagtggcgcctgggaacgcgcacgccatcggcgcgctgatggacgcgctggatccgcccgggttgctcggcaccatctgcggagacgacacgatgctgctcgtgtgccaggacgaggaggccgccgtccgcctgctgaacgagacgctgcaaatcgggtga

SEQ ID NO: 1818 - DNA, 471 bp, Artificial
  Substituion in SEQ ID NO 1804
atgaaaaggagactgtctgtgcaaagcaaggagcagcgcttgatgcgcattcgcgagattgtgagccagaacgagattgagacgcaggaggatttggtgcgcgcgctcgaggaggcgggattccccgtcacgcaggccaccatctcgcgcgatatcaaggagctacagctcgtgaaggtggtgggctcgaacggcaagtacaagtacgccctgcccaccgcggtgaacaaggtctcggtggacgcgctgcagcggcggctggccgaggtgttcatttcgcacgcgcgcgccaacaacctcattgtcatcaaagtggcgcctgggaacgcgcacgccatcggcgcgctgatggacgcgctggaaccgcccgggttgctcggcaccatctgcggagacgacacgatgctgctcgtgtgccaggacgaggaggccgccgtccgcctgctgaacgagacgctgaacatcgggtga

SEQ ID NO: 1819 - DNA, 471 bp, Artificial
  Substituion in SEQ ID NO 1804
atgaaaaggagactgtctgtgcaaagcaaggagcagcgcttgatgcgcattcgcgagattgtgagccagaacgagattgagacgcaggaggatttggtgcgcgcgctcgaggaggcgggattccccgtcacgcaggccaccatctcgcgcgatatcaaggagctacagctcgtgaaggtggtgggctcgaacggcaagtacaagtacgccctgcccaccgcggtgaaccgtgtctcggtggacgcgctgcagcggcggctggccgaggtgttcatttcgcacgcgcgcgccaacaacctcattgtcatcaaagtggcgcctgggaacgcgcacgccatcggcgcgctgatggacgcgctggatccgcccgggttgctcggcaccatctgcggagacgacacgatgctgctcgtgtgccaggacgaggaggccgccgtccgcctgctgaacgagacgctgaacatcgggtga

SEQ ID NO: 1820 - protein, 293 aa, Alicyclobacillus acidocaldarius
MRGRSRRPRGLAVREGTKRRRMPGEGQGDEIVSLLEQVQELGQLLHRSNEQVEFQEVAEFLSRLMQSNVYIVGRKGKILGYGVAEHELTEEWLNIMTREQRFPGDFNKHLLRIEQTIANLTDEQKKPLYVFSPEENESFRSKHLMITPIIGARERQGTLLFARSQRPFNEDDQILAEYAATVVALEIVHSRQQQKEEESRQRALAHLAVESLSFSELQAAKYLLDAVRNSPEGIVVSSQIADQHGVTRSVIVNSIRKLESAGTIESRSLGMKGTHLRILNPYVEEEINRQFER

SEQ ID NO: 1821 - DNA, 882 bp, Alicyclobacillus acidocaldarius
gtgcgtgggagatcccgccgccctcgtggcctggcggtcagggaaggtacaaaacgccggcggatgccgggggaaggacaaggtgacgagattgtgagtttgttggaacaggtacaagaacttgggcaactgttgcaccgctcgaacgagcaggtggaatttcaagaagtcgcggaatttttgagccgcctcatgcagtcgaacgtgtacatcgtggggcgcaagggcaagatcctcggctatggcgtcgcggagcacgagctgaccgaggagtggctgaacatcatgacgcgggaacagcggttcccgggcgacttcaacaaacacctgctgcgcatcgagcagaccattgcaaatctgacggacgagcagaagaagccgctctacgtgttctcccctgaggagaacgagtcgttccgctccaagcacctgatgatcacgcccatcatcggggcgcgcgagcgccagggcacgcttctgttcgcgaggtcccagcggccgttcaacgaggacgaccagatcctggccgagtacgcggcgacggtcgtcgcgctcgagattgtgcactcccggcaacagcagaaggaagaggagagccggcagcgggcgctcgcccatctggcggtggaatcgctcagcttctccgagctgcaggccgccaagtacctgctggacgcggttcgcaactcgccagagggcattgtggtgagcagccagattgcggatcagcacggcgtgacgcgctcggtgattgtcaacagcattcggaagctggagagcgcgggcaccatcgaaagccgctcgctcggcatgaagggcacgcacctccgcatcctgaatccttacgtggaagaggagatcaaccgccaattcgagcgatga

SEQ ID NO: 1822 - protein, 229 aa, Bacillus sp. NRRL B-14911
AGKPVNFKEMAETLSEVIEANIFVVSRRGKLLGFAVNQQIENERMKKMLEDRQFPEEYTKSLFNIQETSSNLDVESDYTAFPVENKELFKNGLTTIVPIIGGGERLGTLILARLQEQFHDDDLILGEYGATVVGMEILREKAEEIEEEARSKAVVQMAISSLSYSELEAIEHIFEELNGKEGLLVASKIADRVGITRSVIVNALRKLESAGVIESRSLGMKGTYIKVLN

SEQ ID NO: 1823 - protein, 236 aa, Clostridium botulinum F str. Langeland
EPVDFEDICDLLSDVLACNVYIISRKGKILGSKFYSGFECEEVREVVLKENRFPDFYNNKLLNVNETLSNSPNHDKCVFDNLKDCSINNKLSTIVPINGNRERLGTLLLARFDKEFTDEDLILAEYSATIIGLEILRSKQDQIEEEARKKAVVQLAIGTLSYSELEAVEHIFNELDGTEGLLVASKIADKVGITRSVIVNALRKFESAGVIESRSLGMKGTHIRILNDKLLEELKK

SEQ ID NO: 1824 - protein, 236 aa, Clostridium beijerinckii NCIMB 8052
EPVAFQDICTLLSEVLECNVYIISKKGKVLGYTFGKDFECEAMKKKVIEDKKFPEDYNKTLLEVNETLSNLPNEGRCVFQEIGKCKKVDKLSTIVPIIGSRERLGTLILARFGNPFTDEDLVIVEYSATIVGMEMLRAMQDEITEDTRKKAVVQLAIGTLSYSELEAVEHIFDELNGNEGLLVASKIADKVGITRSVIVNALRKFESAGVIESRSLGMKGTYIRILNEKLIDELKK

SEQ ID NO: 1825 - protein, 239 aa, Desulfitobacterium hafniense Y51
AGHSVDFDEMANVLSESIQSNCYIVGRRGKILGYSFMQNFGCNTMEDIVVHTERFPESYNEGLLKVTETRSNTTQVANGCVFNEKERCHFNNKITTILPILGGGERVGTLVLAKFDQDFSEADLILAEYGATVVGMEILRIKAERAEEEARKKAAVQIAVGTLSYSELEAVEHIFAELGGGDGLLVASKIADRVGITRSVIVNALRKFESAGVIESKSLGMKGTYIRVLNDYLLEELDK

SEQ ID NO: 1826 - protein, 236 aa, Clostridium botulinum A str. ATCC 3502
EPVDFEDICDLLSDVLACNVYIISRKGKILGSKFYSGFECDEVREVVLKENRFPDFYNNKLLNVNETLSNSPNHDKCVFDNLKDCSINNKLSTIVPINGNRERLGTLLLARFDKEFTDEDLVLAEYSATIIGLEILRSKQDQIEEEARKKAVVQLAIGTLSYSELEAVEHIFNELDGTEGLLVASKIADKVGITRSVIVNALRKFESAGVIESRSLGMKGTHIRILNDKLLEELKK

SEQ ID NO: 1827 - protein, 293 aa, Artificial
  Substituion in SEQ ID NO 1820
MRGRSRRPRGLAVREGTKRRRMPGEGQGDEIVSLLEQVQELGQLLHRSNEQVEFQEVAEFLSRLMQSNVYIVGRKGKILGYGVAEHELTEEWLNIMTREQRFPGDFQKHLLRIEQTIANLTDEQKKPLYVFSPEENESFRSKHLMITPIIGARERQGTLLFARSQRPFNEDDQILAEYAATVVALEIVHSRQQQKEEESRQRALAHLAVESLSFSELQAAKYLLDAVRNSPEGIVVSSQIADQHGVTRSVIVNSIRKLESAGTIESRSLGMKGTHLRILNPYVEEEINRQFER

SEQ ID NO: 1828 - protein, 293 aa, Artificial
  Substituion in SEQ ID NO 1820
MRGRSRRPRGLAVREGTKRRRMPGEGQGDEIVSLLEQVQELGQLLHRSNEQVEFQEIAEFLSRLMQSNVYIVGRKGKILGYGVAEHELTEEWLNIMTREQRFPGDFNKHLLRIEQTIANLTDEQKKPLYVFSPEENESFRSKHLMITPIIGARERQGTLLFARSQRPFNEDDQILAEYAATVVALEIVHSRQQQKEEESRQRALAHLAVESLSFSELQAAKYLLDAVRNSPEGIVVSSQIADQHGVTRSVIVNSIRKLESAGTIESRSLGMKGTHLRILNPYVEEEINRQFER

SEQ ID NO: 1829 - protein, 293 aa, Artificial
  Substituion in SEQ ID NO 1820
MRGKSRRPRGLAVREGTKRRRMPGEGQGDEIVSLLEQVQELGQLLHRSNEQVEFQEVAEFLSRLMQSNVYIVGRKGKILGYGVAEHELTEEWLNIMTREQRFPGDFNKHLLRIEQTIANLTDEQKKPLYVFSPEENESFRSKHLMITPIIGARERQGTLLFARSQRPFNEDDQILAEYAATVVALEIVHSRQQQKEEESRQRALAHLAVESLSFSELQAAKYLLDAVRNSPEGIVVSSQIADQHGVTRSVIVNSIRKLESAGTIESRSLGMKGTHLRILNPYVEEEINRQFER

SEQ ID NO: 1830 - protein, 293 aa, Artificial
  Substituion in SEQ ID NO 1820
MRGRSRRPRGLAVREGTKRRRMPGEGQGDEIVSLIEQVQELGQLLHRSNEQVEFQEVAEFLSRLMQSNVYIVGRKGKILGYGVAEHELTEEWLNIMTREQRFPGDFNKHLLRIEQTIANLTDEQKKPLYVFSPEENESFRSKHLMITPIIGARERQGTLLFARSQRPFNEDDQILAEYAATVVALEIVHSRQQQKEEESRQRALAHLAVESLSFSELQAAKYLLDAVRNSPEGIVVSSQIADQHGVTRSVIVNSIRKLESAGTIESRSLGMKGTHLRILNPYVEEEINRQFER

SEQ ID NO: 1831 - protein, 293 aa, Artificial
  Substituion in SEQ ID NO 1820
MRGRSRRPRGLAVREGTKRRRMPGEGQGDEIVSILEQVQELGQLLHRSNEQVEFQEVAEFLSRLMQSNVYIVGRKGKILGYGVAEHELTEEWLNIMTREQRFPGDFNKHLLRIEQTIANLTDEQKKPLYVFSPEENESFRSKHLMITPIIGARERQGTLLFARSQRPFNEDDQILAEYAATVVALEIVHSRQQQKEEESRQRALAHLAVESLSFSELQAAKYLLDAVRNSPEGIVVSSQIADQHGVTRSVIVNSIRKLESAGTIESRSLGMKGTHLRILNPYVEEEINRQFER

SEQ ID NO: 1832 - DNA, 882 bp, Artificial
  Substituion in SEQ ID NO 1821
gtgcgtgggagatcccgccgccctcgtggcctggcggtcagggaaggtacaaaacgccggcggatgccgggggaaggacaaggtgacgagattgtgagtttgttggaacaggtacaagaacttgggcaactgttgcaccgctcgaacgagcaggtggaatttcaagaagtcgcggaatttttgagccgcctcatgcagtcgaacgtgtacatcgtggggcgcaagggcaagatcctcggctatggcgtcgcggagcacgagctgaccgaggagtggctgaacatcatgacgcgggaacagcggttcccgggcgacttccaaaaacacctgctgcgcatcgagcagaccattgcaaatctgacggacgagcagaagaagccgctctacgtgttctcccctgaggagaacgagtcgttccgctccaagcacctgatgatcacgcccatcatcggggcgcgcgagcgccagggcacgcttctgttcgcgaggtcccagcggccgttcaacgaggacgaccagatcctggccgagtacgcggcgacggtcgtcgcgctcgagattgtgcactcccggcaacagcagaaggaagaggagagccggcagcgggcgctcgcccatctggcggtggaatcgctcagcttctccgagctgcaggccgccaagtacctgctggacgcggttcgcaactcgccagagggcattgtggtgagcagccagattgcggatcagcacggcgtgacgcgctcggtgattgtcaacagcattcggaagctggagagcgcgggcaccatcgaaagccgctcgctcggcatgaagggcacgcacctccgcatcctgaatccttacgtggaagaggagatcaaccgccaattcgagcgatga

SEQ ID NO: 1833 - DNA, 882 bp, Artificial
  Substituion in SEQ ID NO 1821
gtgcgtgggagatcccgccgccctcgtggcctggcggtcagggaaggtacaaaacgccggcggatgccgggggaaggacaaggtgacgagattgtgagtttgttggaacaggtacaagaacttgggcaactgttgcaccgctcgaacgagcaggtggaatttcaagaaattgcggaatttttgagccgcctcatgcagtcgaacgtgtacatcgtggggcgcaagggcaagatcctcggctatggcgtcgcggagcacgagctgaccgaggagtggctgaacatcatgacgcgggaacagcggttcccgggcgacttcaacaaacacctgctgcgcatcgagcagaccattgcaaatctgacggacgagcagaagaagccgctctacgtgttctcccctgaggagaacgagtcgttccgctccaagcacctgatgatcacgcccatcatcggggcgcgcgagcgccagggcacgcttctgttcgcgaggtcccagcggccgttcaacgaggacgaccagatcctggccgagtacgcggcgacggtcgtcgcgctcgagattgtgcactcccggcaacagcagaaggaagaggagagccggcagcgggcgctcgcccatctggcggtggaatcgctcagcttctccgagctgcaggccgccaagtacctgctggacgcggttcgcaactcgccagagggcattgtggtgagcagccagattgcggatcagcacggcgtgacgcgctcggtgattgtcaacagcattcggaagctggagagcgcgggcaccatcgaaagccgctcgctcggcatgaagggcacgcacctccgcatcctgaatccttacgtggaagaggagatcaaccgccaattcgagcgatga

SEQ ID NO: 1834 - DNA, 882 bp, Artificial
  Substituion in SEQ ID NO 1821
gtgcgtgggaaatcccgccgccctcgtggcctggcggtcagggaaggtacaaaacgccggcggatgccgggggaaggacaaggtgacgagattgtgagtttgttggaacaggtacaagaacttgggcaactgttgcaccgctcgaacgagcaggtggaatttcaagaagtcgcggaatttttgagccgcctcatgcagtcgaacgtgtacatcgtggggcgcaagggcaagatcctcggctatggcgtcgcggagcacgagctgaccgaggagtggctgaacatcatgacgcgggaacagcggttcccgggcgacttcaacaaacacctgctgcgcatcgagcagaccattgcaaatctgacggacgagcagaagaagccgctctacgtgttctcccctgaggagaacgagtcgttccgctccaagcacctgatgatcacgcccatcatcggggcgcgcgagcgccagggcacgcttctgttcgcgaggtcccagcggccgttcaacgaggacgaccagatcctggccgagtacgcggcgacggtcgtcgcgctcgagattgtgcactcccggcaacagcagaaggaagaggagagccggcagcgggcgctcgcccatctggcggtggaatcgctcagcttctccgagctgcaggccgccaagtacctgctggacgcggttcgcaactcgccagagggcattgtggtgagcagccagattgcggatcagcacggcgtgacgcgctcggtgattgtcaacagcattcggaagctggagagcgcgggcaccatcgaaagccgctcgctcggcatgaagggcacgcacctccgcatcctgaatccttacgtggaagaggagatcaaccgccaattcgagcgatga

SEQ ID NO: 1835 - DNA, 882 bp, Artificial
  Substituion in SEQ ID NO 1821
gtgcgtgggagatcccgccgccctcgtggcctggcggtcagggaaggtacaaaacgccggcggatgccgggggaaggacaaggtgacgagattgtgagtttgattgaacaggtacaagaacttgggcaactgttgcaccgctcgaacgagcaggtggaatttcaagaagtcgcggaatttttgagccgcctcatgcagtcgaacgtgtacatcgtggggcgcaagggcaagatcctcggctatggcgtcgcggagcacgagctgaccgaggagtggctgaacatcatgacgcgggaacagcggttcccgggcgacttcaacaaacacctgctgcgcatcgagcagaccattgcaaatctgacggacgagcagaagaagccgctctacgtgttctcccctgaggagaacgagtcgttccgctccaagcacctgatgatcacgcccatcatcggggcgcgcgagcgccagggcacgcttctgttcgcgaggtcccagcggccgttcaacgaggacgaccagatcctggccgagtacgcggcgacggtcgtcgcgctcgagattgtgcactcccggcaacagcagaaggaagaggagagccggcagcgggcgctcgcccatctggcggtggaatcgctcagcttctccgagctgcaggccgccaagtacctgctggacgcggttcgcaactcgccagagggcattgtggtgagcagccagattgcggatcagcacggcgtgacgcgctcggtgattgtcaacagcattcggaagctggagagcgcgggcaccatcgaaagccgctcgctcggcatgaagggcacgcacctccgcatcctgaatccttacgtggaagaggagatcaaccgccaattcgagcgatga

SEQ ID NO: 1836 - DNA, 882 bp, Artificial
  Substituion in SEQ ID NO 1821
gtgcgtgggagatcccgccgccctcgtggcctggcggtcagggaaggtacaaaacgccggcggatgccgggggaaggacaaggtgacgagattgtgagtattttggaacaggtacaagaacttgggcaactgttgcaccgctcgaacgagcaggtggaatttcaagaagtcgcggaatttttgagccgcctcatgcagtcgaacgtgtacatcgtggggcgcaagggcaagatcctcggctatggcgtcgcggagcacgagctgaccgaggagtggctgaacatcatgacgcgggaacagcggttcccgggcgacttcaacaaacacctgctgcgcatcgagcagaccattgcaaatctgacggacgagcagaagaagccgctctacgtgttctcccctgaggagaacgagtcgttccgctccaagcacctgatgatcacgcccatcatcggggcgcgcgagcgccagggcacgcttctgttcgcgaggtcccagcggccgttcaacgaggacgaccagatcctggccgagtacgcggcgacggtcgtcgcgctcgagattgtgcactcccggcaacagcagaaggaagaggagagccggcagcgggcgctcgcccatctggcggtggaatcgctcagcttctccgagctgcaggccgccaagtacctgctggacgcggttcgcaactcgccagagggcattgtggtgagcagccagattgcggatcagcacggcgtgacgcgctcggtgattgtcaacagcattcggaagctggagagcgcgggcaccatcgaaagccgctcgctcggcatgaagggcacgcacctccgcatcctgaatccttacgtggaagaggagatcaaccgccaattcgagcgatga

SEQ ID NO: 1837 - protein, 349 aa, Alicyclobacillus acidocaldarius
MGGIALKRHGRRLAWVAVAAAAFGAWHAWPRPERPHAHAHGSHSVAPSSASWTATDPGTTRLGGRETILVLGSDKRPEDPRGNADVLLVASLDDSHRRIELLSIPRDTQVAFPDGRYHKINEALASGGPEETCMLVERLIGLPIDHYAIIRFDALVHMVDRIGGLDIDVPRNMDYRTGDKVYGVIRLRKGRHHLSGEQALQFVRYRHDALGDIGRTERQQAFLVALKDQLLRPQTLPRLPEVAFDAWKMIDTDMSLGDISRLAARAPQYKTYRTVHTTLPGSFHDPDPSIPGDLSYWVVNPAEARYVAKRFFADGEVPPRIIQDPRETRTWLPPEARAAQRPADRSTSG

SEQ ID NO: 1838 - DNA, 1050 bp, Alicyclobacillus acidocaldarius
atgggagggatcgccttgaagcgacacggtcggcgtttggcgtgggtggccgtggctgccgcggcgttcggagcctggcacgcctggcctcggccggaaaggccgcatgcgcacgcgcatggctcgcactcggtcgcgccgtcttccgccagttggaccgccacggacccaggcaccacgcggcttggggggcgcgagacgattctcgtcttgggcagcgacaagcgcccggaagacccgcgcgggaatgccgacgtgctcctcgtcgcgagcctcgatgacagccatcgccgcattgaactcctctccatcccgcgcgacacccaggtggctttcccggacggccgctatcacaagatcaatgaagccctggcgagcggcgggccagaagagacctgcatgctggtggagcgcttgattggtctccccatcgaccattacgccatcattcgattcgatgcgctcgtgcatatggtggatcgcatcggcggcctcgacatcgatgtgccgcgcaacatggattaccgcacgggcgacaaggtgtacggcgtcattcgcttgcggaaaggccggcatcacctgagcggcgaacaggcgctccaatttgtccgctaccgccacgacgcgctcggcgacattgggcgcaccgagcgacagcaggcgtttctcgtggcgctgaaggatcagctccttcgccctcaaacgctgccccggctgcccgaagtggcattcgacgcgtggaagatgatcgacaccgacatgtccctcggcgacatttcgcggctggcggcgcgcgcgccgcagtacaagacgtaccggaccgtgcacaccaccctgccgggctcctttcacgatcccgacccgtccatcccgggagacttgagctactgggtggtcaatccggctgaagcccggtacgtcgccaagcggtttttcgcggatggcgaagtgccgccgcggatcattcaggatcctcgggagacgcgcacctggcttccgccagaggcacgcgcggctcaaaggcccgccgaccgttcgacatcgggctga

SEQ ID NO: 1839 - protein, 273 aa, Moorella thermoacetica ATCC 39073
ETGSTDTGGSQPGTLNILLLGTDARPGEKVGNTDTIILAHFDGERLALLSIPRDTRVNIPGHGVDKINAAYSIGGPDLTTSIVADLTGVPISKYVLLRWDGFIKIIDLLGGVTVNIPRDMYYYDPVDGPQYKINLKKGLQHLDGHQALAFVRFRKEALGDIDRTGQQQELIKALLEKVRQPGTLLKMPRLLPEIYKNVETNMGLDEMLTMARAGLHLKNMTVVSQTLPGYFQTINGISYWGVDPAQARQVAQALFEYGQTTKQVVLDAPASQT

SEQ ID NO: 1840 - protein, 274 aa, Desulfitobacterium hafniense Y51
LKDRVTVLLIGMDNRPGEALSNTDTLMVASLDQKSKKMVLLSVPRDTQVILNQKKEKVNAIARLQKGPISTQQYLQELLGTPIDGYVLTNFQGFKNIVDGLGGITIDVEKDMYYDTGEAQDRFINLKKGVQRLNGTQALQYARFRNDELADITRTSRQQEVIKAIVAEATTPRNIPKLPIIIPKVYQAIDTNLNLGQIWALAMAFKNKDTYEVINQTLPGQFSDEEGISYWKVNPKETKVILNQLFQGKTSPIFETIQKVHVPAQPPASKEAKP

SEQ ID NO: 1841 - protein, 274 aa, Desulfitobacterium hafniense DCB-2; identical to SEQ ID NO: 1840

SEQ ID NO: 1842 - protein, 257 aa, Carboxydothermus hydrogenoformans Z-2901
GRVNILLLGVDDRHSKNRRERTDTIIFASIDSNLKKVVLVSIPRDTRVNIPGHGWDKINAAHVVGGIDLTKQVVSDLLGKPVDYYVLVNFEDFKKVIDTLGGVTIDVEKDMYHADEYPYTINLKKGRQHLNGEKALMYVRYRSDALGDISRTQRQQKFLKALAEQALQPGTLLKLPKLIPEIIQMVETDMSTKDLMSLLAFSRELNKDSIITQTLPGYFYNYNGVSYWQADLEVAKNLVDMLFAGQIEQNIVLGTKE

SEQ ID NO: 1843 - protein, 254 aa, Pelotomaculum thermopropionicum SI
RLNVLLLGIDARQGETMARTDTMILASVDTKSKQMILLSIPRDTGVEIPGHGWDKINSAAVYGGPELSMKVVSNLLGIPVRYYVLTNFSGFKDIVDALGGVTLEVEQNMYHEGDEEYGGAYGINLKKGVQRLDGDKALQYVRYREYPMGDIDRTRAQQKFLVALAKEVLQPSTIPKLPKLIPEISRYVKTNLSVSEMYKLAAAAKNLENGNILTQTLPGRPVEIGGISYWGVEPAEARQMVAKLFNGETVTNVV

SEQ ID NO: 1844 - protein, 349 aa, Artificial
  Substituion in SEQ ID NO 1837
MGGIALKRHGRRLAWIAVAAAAFGAWHAWPRPERPHAHAHGSHSVAPSSASWTATDPGTTRLGGRETILVLGSDKRPEDPRGNADVLLVASLDDSHRRIELLSIPRDTQVAFPDGRYHKINEALASGGPEETCMLVERLIGLPIDHYAIIRFDALVHMVDRIGGLDIDVPRNMDYRTGDKVYGVIRLRKGRHHLSGEQALQFVRYRHDALGDIGRTERQQAFLVALKDQLLRPQTLPRLPEVAFDAWKMIDTDMSLGDISRLAARAPQYKTYRTVHTTLPGSFHDPDPSIPGDLSYWVVNPAEARYVAKRFFADGEVPPRIIQDPRETRTWLPPEARAAQRPADRSTSG

SEQ ID NO: 1845 - protein, 349 aa, Artificial
  Substituion in SEQ ID NO 1837
MGGIALKRHGRRLAWVAVAAAAFGAWHAWPRPERPHAHAHGSHSVAPSSASWTATDPGTTRLGGRETILVLGSDKRPEDPRGNADVLLVASLDDSHRRIELLSIPRDTQVAFPDGRYHKINEALASGGPEETCMLVERLIGLPIDHYAIIRFDALVHMVDRIGGLDIDVPRNMDYRTGDKVYGVIRLRKGRHHLSGEQALQFVRYRHDALGDIGRTERQQAFLVALKDQLLRPQTLPRLPEVAFDAWKMIDTDMSLGDISRLAARAPQYKTYRTVHTTLPGSFHDPDPSIPGDLSYWIVNPAEARYVAKRFFADGEVPPRIIQDPRETRTWLPPEARAAQRPADRSTSG

SEQ ID NO: 1846 - protein, 349 aa, Artificial
  Substituion in SEQ ID NO 1837
MGGIALKRHGRRLAWVAVAAAAFGAWHAWPRPERPHAHAHGSHSVAPSSASWTATDPGTTRLGGRETILVLGSDKRPEDPRGNADVLLVASLDDSHRRIELLSIPRDTQVAFPDGRYHKINEALASGGPEETCMLVERLIGLPIDHYAIIRFDALVHMVDRIGGLDIDVPRNMDYRTGDKVYGVIRLRKGRHHLSGEQALQFVRYRHDALGDIGRTERQQAFIVALKDQLLRPQTLPRLPEVAFDAWKMIDTDMSLGDISRLAARAPQYKTYRTVHTTLPGSFHDPDPSIPGDLSYWVVNPAEARYVAKRFFADGEVPPRIIQDPRETRTWLPPEARAAQRPADRSTSG

SEQ ID NO: 1847 - protein, 349 aa, Artificial
  Substituion in SEQ ID NO 1837
MGGIALKRHGRRLAWVAVAAAAFGAWHAWPRPERPHAHAHGSHSVAPSSASWTATDPGTTRLGGRETILVLGSDKRPEDPRGNADVLLVASLDDSHRRIELLSIPRDTQVAFPDGRYHKINEALASGGPEETCMLVERLIGLPIDHYAIIRFDALVHMVDRIGGLDIDVPRNMDYRTGDKVYGVIRLRKGRHHLSGEQALQFVRYRHDALGDIGRTERQQAFLVALKDQLLRPQTLPRIPEVAFDAWKMIDTDMSLGDISRLAARAPQYKTYRTVHTTLPGSFHDPDPSIPGDLSYWVVNPAEARYVAKRFFADGEVPPRIIQDPRETRTWLPPEARAAQRPADRSTSG

SEQ ID NO: 1848 - protein, 349 aa, Artificial
  Substituion in SEQ ID NO 1837
MGGIALKRHGRRLAWVAVAAAAFGAWHAWPRPERPHAHAHGSHSVAPSSASWTATDPGTTRLGGRETILVLGSDKRPEDPRGNADVLLVASLDDSHRRIELLSIPRDTQVAFPDGRYHKINEALASGGPEETCMLVERLIGLPIDHYAIIRFDALVHMVDRIGGLDIDVPRNMDYRTGDKVYGVIRLRKGRHHLSGEQALQFIRYRHDALGDIGRTERQQAFLVALKDQLLRPQTLPRLPEVAFDAWKMIDTDMSLGDISRLAARAPQYKTYRTVHTTLPGSFHDPDPSIPGDLSYWVVNPAEARYVAKRFFADGEVPPRIIQDPRETRTWLPPEARAAQRPADRSTSG

SEQ ID NO: 1849 - DNA, 1050 bp, Artificial
  Substituion in SEQ ID NO 1838
atgggagggatcgccttgaagcgacacggtcggcgtttggcgtggattgccgtggctgccgcggcgttcggagcctggcacgcctggcctcggccggaaaggccgcatgcgcacgcgcatggctcgcactcggtcgcgccgtcttccgccagttggaccgccacggacccaggcaccacgcggcttggggggcgcgagacgattctcgtcttgggcagcgacaagcgcccggaagacccgcgcgggaatgccgacgtgctcctcgtcgcgagcctcgatgacagccatcgccgcattgaactcctctccatcccgcgcgacacccaggtggctttcccggacggccgctatcacaagatcaatgaagccctggcgagcggcgggccagaagagacctgcatgctggtggagcgcttgattggtctccccatcgaccattacgccatcattcgattcgatgcgctcgtgcatatggtggatcgcatcggcggcctcgacatcgatgtgccgcgcaacatggattaccgcacgggcgacaaggtgtacggcgtcattcgcttgcggaaaggccggcatcacctgagcggcgaacaggcgctccaatttgtccgctaccgccacgacgcgctcggcgacattgggcgcaccgagcgacagcaggcgtttctcgtggcgctgaaggatcagctccttcgccctcaaacgctgccccggctgcccgaagtggcattcgacgcgtggaagatgatcgacaccgacatgtccctcggcgacatttcgcggctggcggcgcgcgcgccgcagtacaagacgtaccggaccgtgcacaccaccctgccgggctcctttcacgatcccgacccgtccatcccgggagacttgagctactgggtggtcaatccggctgaagcccggtacgtcgccaagcggtttttcgcggatggcgaagtgccgccgcggatcattcaggatcctcgggagacgcgcacctggcttccgccagaggcacgcgcggctcaaaggcccgccgaccgttcgacatcgggctga

SEQ ID NO: 1850 - DNA, 1050 bp, Artificial
  Substituion in SEQ ID NO 1838
atgggagggatcgccttgaagcgacacggtcggcgtttggcgtgggtggccgtggctgccgcggcgttcggagcctggcacgcctggcctcggccggaaaggccgcatgcgcacgcgcatggctcgcactcggtcgcgccgtcttccgccagttggaccgccacggacccaggcaccacgcggcttggggggcgcgagacgattctcgtcttgggcagcgacaagcgcccggaagacccgcgcgggaatgccgacgtgctcctcgtcgcgagcctcgatgacagccatcgccgcattgaactcctctccatcccgcgcgacacccaggtggctttcccggacggccgctatcacaagatcaatgaagccctggcgagcggcgggccagaagagacctgcatgctggtggagcgcttgattggtctccccatcgaccattacgccatcattcgattcgatgcgctcgtgcatatggtggatcgcatcggcggcctcgacatcgatgtgccgcgcaacatggattaccgcacgggcgacaaggtgtacggcgtcattcgcttgcggaaaggccggcatcacctgagcggcgaacaggcgctccaatttgtccgctaccgccacgacgcgctcggcgacattgggcgcaccgagcgacagcaggcgtttctcgtggcgctgaaggatcagctccttcgccctcaaacgctgccccggctgcccgaagtggcattcgacgcgtggaagatgatcgacaccgacatgtccctcggcgacatttcgcggctggcggcgcgcgcgccgcagtacaagacgtaccggaccgtgcacaccaccctgccgggctcctttcacgatcccgacccgtccatcccgggagacttgagctactggattgtcaatccggctgaagcccggtacgtcgccaagcggtttttcgcggatggcgaagtgccgccgcggatcattcaggatcctcgggagacgcgcacctggcttccgccagaggcacgcgcggctcaaaggcccgccgaccgttcgacatcgggctga

SEQ ID NO: 1851 - DNA, 1050 bp, Artificial
  Substituion in SEQ ID NO 1838
atgggagggatcgccttgaagcgacacggtcggcgtttggcgtgggtggccgtggctgccgcggcgttcggagcctggcacgcctggcctcggccggaaaggccgcatgcgcacgcgcatggctcgcactcggtcgcgccgtcttccgccagttggaccgccacggacccaggcaccacgcggcttggggggcgcgagacgattctcgtcttgggcagcgacaagcgcccggaagacccgcgcgggaatgccgacgtgctcctcgtcgcgagcctcgatgacagccatcgccgcattgaactcctctccatcccgcgcgacacccaggtggctttcccggacggccgctatcacaagatcaatgaagccctggcgagcggcgggccagaagagacctgcatgctggtggagcgcttgattggtctccccatcgaccattacgccatcattcgattcgatgcgctcgtgcatatggtggatcgcatcggcggcctcgacatcgatgtgccgcgcaacatggattaccgcacgggcgacaaggtgtacggcgtcattcgcttgcggaaaggccggcatcacctgagcggcgaacaggcgctccaatttgtccgctaccgccacgacgcgctcggcgacattgggcgcaccgagcgacagcaggcgtttattgtggcgctgaaggatcagctccttcgccctcaaacgctgccccggctgcccgaagtggcattcgacgcgtggaagatgatcgacaccgacatgtccctcggcgacatttcgcggctggcggcgcgcgcgccgcagtacaagacgtaccggaccgtgcacaccaccctgccgggctcctttcacgatcccgacccgtccatcccgggagacttgagctactgggtggtcaatccggctgaagcccggtacgtcgccaagcggtttttcgcggatggcgaagtgccgccgcggatcattcaggatcctcgggagacgcgcacctggcttccgccagaggcacgcgcggctcaaaggcccgccgaccgttcgacatcgggctga

SEQ ID NO: 1852 - DNA, 1050 bp, Artificial
  Substituion in SEQ ID NO 1838
atgggagggatcgccttgaagcgacacggtcggcgtttggcgtgggtggccgtggctgccgcggcgttcggagcctggcacgcctggcctcggccggaaaggccgcatgcgcacgcgcatggctcgcactcggtcgcgccgtcttccgccagttggaccgccacggacccaggcaccacgcggcttggggggcgcgagacgattctcgtcttgggcagcgacaagcgcccggaagacccgcgcgggaatgccgacgtgctcctcgtcgcgagcctcgatgacagccatcgccgcattgaactcctctccatcccgcgcgacacccaggtggctttcccggacggccgctatcacaagatcaatgaagccctggcgagcggcgggccagaagagacctgcatgctggtggagcgcttgattggtctccccatcgaccattacgccatcattcgattcgatgcgctcgtgcatatggtggatcgcatcggcggcctcgacatcgatgtgccgcgcaacatggattaccgcacgggcgacaaggtgtacggcgtcattcgcttgcggaaaggccggcatcacctgagcggcgaacaggcgctccaatttgtccgctaccgccacgacgcgctcggcgacattgggcgcaccgagcgacagcaggcgtttctcgtggcgctgaaggatcagctccttcgccctcaaacgctgccccggattcccgaagtggcattcgacgcgtggaagatgatcgacaccgacatgtccctcggcgacatttcgcggctggcggcgcgcgcgccgcagtacaagacgtaccggaccgtgcacaccaccctgccgggctcctttcacgatcccgacccgtccatcccgggagacttgagctactgggtggtcaatccggctgaagcccggtacgtcgccaagcggtttttcgcggatggcgaagtgccgccgcggatcattcaggatcctcgggagacgcgcacctggcttccgccagaggcacgcgcggctcaaaggcccgccgaccgttcgacatcgggctga

SEQ ID NO: 1853 - DNA, 1050 bp, Artificial
  Substituion in SEQ ID NO 1838
atgggagggatcgccttgaagcgacacggtcggcgtttggcgtgggtggccgtggctgccgcggcgttcggagcctggcacgcctggcctcggccggaaaggccgcatgcgcacgcgcatggctcgcactcggtcgcgccgtcttccgccagttggaccgccacggacccaggcaccacgcggcttggggggcgcgagacgattctcgtcttgggcagcgacaagcgcccggaagacccgcgcgggaatgccgacgtgctcctcgtcgcgagcctcgatgacagccatcgccgcattgaactcctctccatcccgcgcgacacccaggtggctttcccggacggccgctatcacaagatcaatgaagccctggcgagcggcgggccagaagagacctgcatgctggtggagcgcttgattggtctccccatcgaccattacgccatcattcgattcgatgcgctcgtgcatatggtggatcgcatcggcggcctcgacatcgatgtgccgcgcaacatggattaccgcacgggcgacaaggtgtacggcgtcattcgcttgcggaaaggccggcatcacctgagcggcgaacaggcgctccaatttattcgctaccgccacgacgcgctcggcgacattgggcgcaccgagcgacagcaggcgtttctcgtggcgctgaaggatcagctccttcgccctcaaacgctgccccggctgcccgaagtggcattcgacgcgtggaagatgatcgacaccgacatgtccctcggcgacatttcgcggctggcggcgcgcgcgccgcagtacaagacgtaccggaccgtgcacaccaccctgccgggctcctttcacgatcccgacccgtccatcccgggagacttgagctactgggtggtcaatccggctgaagcccggtacgtcgccaagcggtttttcgcggatggcgaagtgccgccgcggatcattcaggatcctcgggagacgcgcacctggcttccgccagaggcacgcgcggctcaaaggcccgccgaccgttcgacatcgggctga

SEQ ID NO: 1854 - protein, 250 aa, Alicyclobacillus acidocaldarius
MTKGSIRSMRESVPLYKQLKSELLEKILSGEWPPGEQIPSEAELASMYDVSRTTVRQAVGDLVTSGFIVRRQGKGTFVAEVDHPATSTTLYGFAEELRAAGLPVDVRVDVIEMRTCPEDIARWLRMTRSKQVLYIERTAYVEDMAYFHERSYLVPPYQVSSRMTPDPKMYDSIYGFFEQNGVRINSGSQTISAELADEEDCARFGLTPPAAVLCIERITRDESGAPVEYSLVRYPSDRYQLRVHLLRHPR

SEQ ID NO: 1855 - DNA, 753 bp, Alicyclobacillus acidocaldarius
ttgacgaaaggatcgatccggagcatgcgtgagagcgtcccactctataaacagctgaaatcggagttgctcgagaagatcctgagcggggaatggccccctggcgaacagatcccgtcggaggcggagttggcttcgatgtacgacgtcagccgcacgacggtccgccaggcggtgggcgatctcgtcacctcgggattcatcgtgcgccggcagggcaaggggacctttgtcgcggaagtcgaccacccggcgacatccaccacgctgtatggatttgccgaggaactccgggctgccgggcttcccgtggacgtgcgcgtcgacgtgatcgagatgcgcacctgtcccgaggacatcgcccgctggctgcggatgacgcggtccaagcaggtgctctacatcgaacgcaccgcgtacgtggaggacatggcctattttcacgagcgttcctatctcgtgccgccttaccaggtgtcgtcgaggatgacgccggatccgaagatgtacgactccatctacggctttttcgaacaaaacggcgtccggatcaactcgggcagtcagaccatctccgccgaactcgcggacgaggaagattgcgcgcgattcgggttgaccccgcccgccgccgtgctgtgcatcgaacggatcacgagggacgagtccggcgcgcccgtcgaatattcgctggttcgctacccgtcggaccgataccagcttcgcgtgcatctgcttcggcatcctcgttga

SEQ ID NO: 1856 - protein, 233 aa, Geobacillus kaustophilus HTA426
IPIYYQLEQYMKEKIEKGEWQPGEMIPSERELAEMYDISRMTVRQAVNNLVNDGYLIRRRGKGTFVAAQKIEQPLKGLTSFSEDMRARGMEPGTIVLSFEMVPASEKLAEGLGVTEGDDLYEVRRLRLADGLPMALETLYIPVNLVPGLTRDVVSGSVYEFIEKEKGMIIGSAVQTLEASVARKVEAEHLKMKEGAPVLLLERRTHLVDGRPLEVVKSVYRGDRYKFMIEMKR

SEQ ID NO: 1857 - protein, 233 aa, Geobacillus thermodenitrificans NG80-2
VPIYYQLEQYMKEKIEKGEWQPGEMIPSERELAETYDISRMTVRQAVNNLVNDGYLVRRRGKGTFVAAKKIEQPLKGLTSFSEDMRARGMEPDTVVLGFETVPASKKLAEWLAVKEGDALYEIRRLRLADGSPMALETLYIPCALAPHLTREIVNGSVYEFMEKEVGLAIGTAVQVIEASVARKLEVEHLQVKEGAPVLLLERRTYLTDGRPLEVVKSVYRGDRYKFIVEMER

SEQ ID NO: 1858 - protein, 236 aa, Pelobacter propionicus DSM 2379
MPLYHQVESHLKENIGNGTWKAGEAIPPERMLVDQYGVSRITIRQALANLVAAGLLYRKHGKGTFVAGAQDRPITESLANLTGHLEELQLRGLNPQVRVLALETRTLAAEVAEALERSPAAPGWYLYRLVTVDRQPLMLSTVWLPRDLEIELTEDILKQHGMALLLTRNGIFPLRGRQRIGASSAGPEEAQLLGIRPGDAVLCVKRVIYGAASRPLVWFRTLYRSDRYEYEVELKR

SEQ ID NO: 1859 - protein, 233 aa, Ralstonia pickettii 12J
PLYERIKGTLREGILSGHYAPASLLPSEAALGEQFNASRITVRQALADLQNEGLIFRRHGKGTFVSQPKAFQNVTALQGFAEAMSAQGHAIRNRVLKLRTLPAPTDVAQALQLAPGTAVTELHRVRLLDQVPVSLEVTWLPEPLGSSVARADLVTRDVFLVLEQDAGVALGHATLAIDAALADHATATALDTGAGAALLRVERLTHDAQGTPIDFERLYFRGDAFQYRLRLDR

SEQ ID NO: 1860 - protein, 226 aa, Bacillus coagulans 36D1
IPIYFQIQEEIRKKIREGEWKTGEAIPSERVLSDLFEVSRMTVRQAVQGLVDEGILMRKRGSGTFISEHKVEQPLEGRMSFTRLMEERGMKASNKIVAFFEREASVQEMEALTLKEPENVLHIERLRYGDEIPIVFESIITPARIAAGLTEEKLNRSFYQFLEREKGLRLGKGYQTIEAVAASARLAKLLKVAPGSPVLSIERVTSLSDGTPFEYVKAQYAGSRFK

SEQ ID NO: 1861 - protein, 250 aa, Artificial
  Substituion in SEQ ID NO 1854
MTKGSIRSMRESVPLYKQLKSELLEKILSGEWPPGEQIPSEAELASMYDVSRTTVRQAVGDLVTSGFIVRRQGKGTFVAEVDHPATSTTLYGFAEELRAAGLPVDVRVDVIEMRTCPEDIARWLRMTRSKQVLYIERTAYVEDMAYFHERSYLVPPYQVSSRMTPDPKMYDSIYGFFEQNGVRINSGSQTISAELADEEDCARFGLTPPAAVLCIERITRDESGAPVEYSLVRYPSDRYNLRVHLLRHPR

SEQ ID NO: 1862 - protein, 250 aa, Artificial
  Substituion in SEQ ID NO 1854
MTKGSIRSMRESVPLYKQLKSELLEKILSGEWPPGEQIPSEAELASMYDVSRTTVRQAVGDLVTSGFIVRRQGKGTFVAEVDHPATSTTLYGFAEELRAAGLPVDVRVDVIEMRTCPEDIARWLRMTRSKQVLYIERTAYVEDMAYFHERSYLVPPYQVSSRMTPDPKMYDSIYGFFEQNGVRINSGSQTISAEIADEEDCARFGLTPPAAVLCIERITRDESGAPVEYSLVRYPSDRYQLRVHLLRHPR

SEQ ID NO: 1863 - protein, 250 aa, Artificial
  Substituion in SEQ ID NO 1854
MTKGSIRSMRESVPLYKQLKSELLEKILSGEWPPGEQIPSEAELASMYDVSRTTVRQAVGDLVTSGFIVRRQGKGTFVAEVDHPATSTTLYGFAEELRAAGLPVDVRVDVIEMRTCPEDIARWLRMTRSKQVLYIERTAYVEDMAYFHERSYLVPPYQVSSRMTPDPKMYDSIYGFFEQNGVRINSGSQTISAELADEEDCARFGLTPPAAVLCIERITRDESGAPVEYSIVRYPSDRYQLRVHLLRHPR

SEQ ID NO: 1864 - protein, 250 aa, Artificial
  Substituion in SEQ ID NO 1854
MTKGSIRSMRESVPLYKQLKSELLEKILSGEWPPGEQIPSEAELASMYDVSRTTVRQAVGDLVTSGFIVRRQGKGTFVAEVDHPATSTTLYGFAEELRAAGLPVDVRVDVIEMRTCPEDIARWLRMTRSKQVLYIERTAYVEDMAYFHERSYLVPPYQVSSRMTPDPKMYDSIYGFFEQNGVRINSGSQTISAELADEEDCARFGLTPPAAVLCIDRITRDESGAPVEYSLVRYPSDRYQLRVHLLRHPR

SEQ ID NO: 1865 - protein, 250 aa, Artificial
  Substituion in SEQ ID NO 1854
MTKGSIRSMRESVPLYKQLKSELLEKILSGEWPPGEQIPSEAELASMYDVSRTTVRQAVGDLVTSGFIVRRQGKGTFVAEVDHPATSTTLYGFAEELRAAGLPVDVRVDVIEMRTCPEDIARWLKMTRSKQVLYIERTAYVEDMAYFHERSYLVPPYQVSSRMTPDPKMYDSIYGFFEQNGVRINSGSQTISAELADEEDCARFGLTPPAAVLCIERITRDESGAPVEYSLVRYPSDRYQLRVHLLRHPR

SEQ ID NO: 1866 - DNA, 753 bp, Artificial
  Substituion in SEQ ID NO 1855
ttgacgaaaggatcgatccggagcatgcgtgagagcgtcccactctataaacagctgaaatcggagttgctcgagaagatcctgagcggggaatggccccctggcgaacagatcccgtcggaggcggagttggcttcgatgtacgacgtcagccgcacgacggtccgccaggcggtgggcgatctcgtcacctcgggattcatcgtgcgccggcagggcaaggggacctttgtcgcggaagtcgaccacccggcgacatccaccacgctgtatggatttgccgaggaactccgggctgccgggcttcccgtggacgtgcgcgtcgacgtgatcgagatgcgcacctgtcccgaggacatcgcccgctggctgcggatgacgcggtccaagcaggtgctctacatcgaacgcaccgcgtacgtggaggacatggcctattttcacgagcgttcctatctcgtgccgccttaccaggtgtcgtcgaggatgacgccggatccgaagatgtacgactccatctacggctttttcgaacaaaacggcgtccggatcaactcgggcagtcagaccatctccgccgaactcgcggacgaggaagattgcgcgcgattcgggttgaccccgcccgccgccgtgctgtgcatcgaacggatcacgagggacgagtccggcgcgcccgtcgaatattcgctggttcgctacccgtcggaccgatacaatcttcgcgtgcatctgcttcggcatcctcgttga

SEQ ID NO: 1867 - DNA, 753 bp, Artificial
  Substituion in SEQ ID NO 1855
ttgacgaaaggatcgatccggagcatgcgtgagagcgtcccactctataaacagctgaaatcggagttgctcgagaagatcctgagcggggaatggccccctggcgaacagatcccgtcggaggcggagttggcttcgatgtacgacgtcagccgcacgacggtccgccaggcggtgggcgatctcgtcacctcgggattcatcgtgcgccggcagggcaaggggacctttgtcgcggaagtcgaccacccggcgacatccaccacgctgtatggatttgccgaggaactccgggctgccgggcttcccgtggacgtgcgcgtcgacgtgatcgagatgcgcacctgtcccgaggacatcgcccgctggctgcggatgacgcggtccaagcaggtgctctacatcgaacgcaccgcgtacgtggaggacatggcctattttcacgagcgttcctatctcgtgccgccttaccaggtgtcgtcgaggatgacgccggatccgaagatgtacgactccatctacggctttttcgaacaaaacggcgtccggatcaactcgggcagtcagaccatctccgccgaaattgcggacgaggaagattgcgcgcgattcgggttgaccccgcccgccgccgtgctgtgcatcgaacggatcacgagggacgagtccggcgcgcccgtcgaatattcgctggttcgctacccgtcggaccgataccagcttcgcgtgcatctgcttcggcatcctcgttga

SEQ ID NO: 1868 - DNA, 753 bp, Artificial
  Substituion in SEQ ID NO 1855
ttgacgaaaggatcgatccggagcatgcgtgagagcgtcccactctataaacagctgaaatcggagttgctcgagaagatcctgagcggggaatggccccctggcgaacagatcccgtcggaggcggagttggcttcgatgtacgacgtcagccgcacgacggtccgccaggcggtgggcgatctcgtcacctcgggattcatcgtgcgccggcagggcaaggggacctttgtcgcggaagtcgaccacccggcgacatccaccacgctgtatggatttgccgaggaactccgggctgccgggcttcccgtggacgtgcgcgtcgacgtgatcgagatgcgcacctgtcccgaggacatcgcccgctggctgcggatgacgcggtccaagcaggtgctctacatcgaacgcaccgcgtacgtggaggacatggcctattttcacgagcgttcctatctcgtgccgccttaccaggtgtcgtcgaggatgacgccggatccgaagatgtacgactccatctacggctttttcgaacaaaacggcgtccggatcaactcgggcagtcagaccatctccgccgaactcgcggacgaggaagattgcgcgcgattcgggttgaccccgcccgccgccgtgctgtgcatcgaacggatcacgagggacgagtccggcgcgcccgtcgaatattcgattgttcgctacccgtcggaccgataccagcttcgcgtgcatctgcttcggcatcctcgttga

SEQ ID NO: 1869 - DNA, 753 bp, Artificial
  Substituion in SEQ ID NO 1855
ttgacgaaaggatcgatccggagcatgcgtgagagcgtcccactctataaacagctgaaatcggagttgctcgagaagatcctgagcggggaatggccccctggcgaacagatcccgtcggaggcggagttggcttcgatgtacgacgtcagccgcacgacggtccgccaggcggtgggcgatctcgtcacctcgggattcatcgtgcgccggcagggcaaggggacctttgtcgcggaagtcgaccacccggcgacatccaccacgctgtatggatttgccgaggaactccgggctgccgggcttcccgtggacgtgcgcgtcgacgtgatcgagatgcgcacctgtcccgaggacatcgcccgctggctgcggatgacgcggtccaagcaggtgctctacatcgaacgcaccgcgtacgtggaggacatggcctattttcacgagcgttcctatctcgtgccgccttaccaggtgtcgtcgaggatgacgccggatccgaagatgtacgactccatctacggctttttcgaacaaaacggcgtccggatcaactcgggcagtcagaccatctccgccgaactcgcggacgaggaagattgcgcgcgattcgggttgaccccgcccgccgccgtgctgtgcatcgatcggatcacgagggacgagtccggcgcgcccgtcgaatattcgctggttcgctacccgtcggaccgataccagcttcgcgtgcatctgcttcggcatcctcgttga

SEQ ID NO: 1870 - DNA, 753 bp, Artificial
  Substituion in SEQ ID NO 1855
ttgacgaaaggatcgatccggagcatgcgtgagagcgtcccactctataaacagctgaaatcggagttgctcgagaagatcctgagcggggaatggccccctggcgaacagatcccgtcggaggcggagttggcttcgatgtacgacgtcagccgcacgacggtccgccaggcggtgggcgatctcgtcacctcgggattcatcgtgcgccggcagggcaaggggacctttgtcgcggaagtcgaccacccggcgacatccaccacgctgtatggatttgccgaggaactccgggctgccgggcttcccgtggacgtgcgcgtcgacgtgatcgagatgcgcacctgtcccgaggacatcgcccgctggctgaaaatgacgcggtccaagcaggtgctctacatcgaacgcaccgcgtacgtggaggacatggcctattttcacgagcgttcctatctcgtgccgccttaccaggtgtcgtcgaggatgacgccggatccgaagatgtacgactccatctacggctttttcgaacaaaacggcgtccggatcaactcgggcagtcagaccatctccgccgaactcgcggacgaggaagattgcgcgcgattcgggttgaccccgcccgccgccgtgctgtgcatcgaacggatcacgagggacgagtccggcgcgcccgtcgaatattcgctggttcgctacccgtcggaccgataccagcttcgcgtgcatctgcttcggcatcctcgttga

SEQ ID NO: 1871 - protein, 75 aa, Alicyclobacillus acidocaldarius
MAPVKDGRGKSLLTNREREVFELLVQDKTTKEIASQLFVSEKTVRNHISNVMKKLNVKGRSQAVVELVRLGEITI

SEQ ID NO: 1872 - DNA, 228 bp, Alicyclobacillus acidocaldarius
atggcacctgtcaaggacgggcgcggcaagtcgctgttgaccaaccgagaacgagaagtgttcgagctcctcgttcaggataagacgacgaaggaaatcgcttcgcaactcttcgtcagcgagaagaccgtgcggaaccatatatccaacgtgatgaagaagctgaacgtcaaagggcgctcgcaggccgtggtggaactggtgcggctgggcgagatcacgatttga

SEQ ID NO: 1873 - protein, 71 aa, Bacillus amyloliquefaciens FZB42
KDFQSKPLLTKREREVFELLVQDKTTKEIASELFISEKTVRNHISNAMQKLGVKGRSQAVVELLRMGELEL

SEQ ID NO: 1874 - protein, 71 aa, Bacillus licheniformis ATCC 14580
KEFQSKPLLTKREREVFELLVQDKTTKEIASELFISEKTVRNHISNAMQKLGVKGRSQAVVELLRMGELEL

SEQ ID NO: 1875 - protein, 66 aa, Bacillus halodurans C-125
KPLLTKREREVFELLVQDKTTKEIAEQLFISEKTVRNHISNTMQKLGVKGRSQAVIELIRLGELEI

SEQ ID NO: 1876 - protein, 66 aa, Bacillus clausii KSM-K16
KPLLTKREREVFELLVQDQTTKEIANHLFISEKTVRNHISNTMQKLGVKGRSQAVIELIRLGELTI

SEQ ID NO: 1877 - protein, 68 aa, Bacillus cereus subsp. cytotoxis NVH 391-98
QSKPLLTKREREVFELLVQDKTTKEIASELFISEKTVRNHISNAMQKLGVKGRSQAVVELLRMGELEL

SEQ ID NO: 1878 - protein, 75 aa, Artificial
  Substituion in SEQ ID NO 1871
MAPVKDGRGKSLLTNREREVFELLVQDKTTKEIASNLFVSEKTVRNHISNVMKKLNVKGRSQAVVELVRLGEITI

SEQ ID NO: 1879 - protein, 75 aa, Artificial
  Substituion in SEQ ID NO 1871
MAPVKDGRGKSLLTNREREVFELLVQDKTTKEIASQLFVSEKTVRNHISNVMKKLNVKGRSQAVVELIRLGEITI

SEQ ID NO: 1880 - protein, 75 aa, Artificial
  Substituion in SEQ ID NO 1871
MAPVKDGRGKSLLTQREREVFELLVQDKTTKEIASQLFVSEKTVRNHISNVMKKLNVKGRSQAVVELVRLGEITI

SEQ ID NO: 1881 - protein, 75 aa, Artificial
  Substituion in SEQ ID NO 1871
MAPVKDGRGKSLLTNREREVFELLVQDRTTKEIASQLFVSEKTVRNHISNVMKKLNVKGRSQAVVELVRLGEITI

SEQ ID NO: 1882 - protein, 75 aa, Artificial
  Substituion in SEQ ID NO 1871
MAPVKDGRGKSLLTNREREVFELLVQDKTTKEIASQLFISEKTVRNHISNVMKKLNVKGRSQAVVELVRLGEITI

SEQ ID NO: 1883 - DNA, 228 bp, Artificial
  Substituion in SEQ ID NO 1872
atggcacctgtcaaggacgggcgcggcaagtcgctgttgaccaaccgagaacgagaagtgttcgagctcctcgttcaggataagacgacgaaggaaatcgcttcgaatctcttcgtcagcgagaagaccgtgcggaaccatatatccaacgtgatgaagaagctgaacgtcaaagggcgctcgcaggccgtggtggaactggtgcggctgggcgagatcacgatttga

SEQ ID NO: 1884 - DNA, 228 bp, Artificial
  Substituion in SEQ ID NO 1872
atggcacctgtcaaggacgggcgcggcaagtcgctgttgaccaaccgagaacgagaagtgttcgagctcctcgttcaggataagacgacgaaggaaatcgcttcgcaactcttcgtcagcgagaagaccgtgcggaaccatatatccaacgtgatgaagaagctgaacgtcaaagggcgctcgcaggccgtggtggaactgattcggctgggcgagatcacgatttga

SEQ ID NO: 1885 - DNA, 228 bp, Artificial
  Substituion in SEQ ID NO 1872
atggcacctgtcaaggacgggcgcggcaagtcgctgttgacccaacgagaacgagaagtgttcgagctcctcgttcaggataagacgacgaaggaaatcgcttcgcaactcttcgtcagcgagaagaccgtgcggaaccatatatccaacgtgatgaagaagctgaacgtcaaagggcgctcgcaggccgtggtggaactggtgcggctgggcgagatcacgatttga

SEQ ID NO: 1886 - DNA, 228 bp, Artificial
  Substituion in SEQ ID NO 1872
atggcacctgtcaaggacgggcgcggcaagtcgctgttgaccaaccgagaacgagaagtgttcgagctcctcgttcaggatcgtacgacgaaggaaatcgcttcgcaactcttcgtcagcgagaagaccgtgcggaaccatatatccaacgtgatgaagaagctgaacgtcaaagggcgctcgcaggccgtggtggaactggtgcggctgggcgagatcacgatttga

SEQ ID NO: 1887 - DNA, 228 bp, Artificial
  Substituion in SEQ ID NO 1872
atggcacctgtcaaggacgggcgcggcaagtcgctgttgaccaaccgagaacgagaagtgttcgagctcctcgttcaggataagacgacgaaggaaatcgcttcgcaactcttcattagcgagaagaccgtgcggaaccatatatccaacgtgatgaagaagctgaacgtcaaagggcgctcgcaggccgtggtggaactggtgcggctgggcgagatcacgatttga

SEQ ID NO: 1888 - protein, 161 aa, Alicyclobacillus acidocaldarius
MVRFIGLWARTGCGYPLADYSPFVEEIEKALRLVAATVRRRGRVLLKDYDLTSPQFDALITLYNEGELTIGELSAKLYLAYSTTTDLVDRLERAGYVSRQRDLVDRRVVRVQLRDKGAQVIEAVLSARRAYLDSILKHVSIEQRRAILQALDLLLTNMGNS

SEQ ID NO: 1889 - DNA, 486 bp, Alicyclobacillus acidocaldarius
atggtacgatttattggactctgggccaggacaggatgtgggtatcctttggcagactacagtcccttcgttgaggaaattgaaaaggcgctgcgccttgtcgccgccaccgtgcggcgccgcggcagggtcctgttgaaagactacgacctcacgtcgccccagtttgatgcgctcatcacgctgtacaacgaaggcgagttgaccatcggcgagctgtcggccaagttgtacctcgcgtacagcacgaccaccgacttggtggacaggctcgagcgcgccggttatgtatcccgccagcgggacctcgtggatcgccgtgtcgtgcgcgtgcaactccgggacaagggcgcgcaggtcattgaggcggtgctctccgcgcgccgtgcctacctcgattcgatcttgaaacacgtctccatcgagcagcgccgcgcgattctacaagcactggatcttcttttgacgaatatgggtaattcgtga

SEQ ID NO: 1890 - protein, 140 aa, Oceanobacillus iheyensis HTE831
ELSDSVNQMEKRLRYISGMIKQNGRKILNNYPITSPQFIALQWLLEEGDLTIGELSNRISHAFSTTTDLVDRMEKNELVERVRDTNDRRVVRIHLLEKGKHIIEEVIDKRQAYLGEVLTKFSEEEKEQLNQLLDFLYTEM

SEQ ID NO: 1891 - protein, 129 aa, Alkaliphilus metalliredigens QYMF
EIEKELRYLCTVIKQKGREILTDFQITPPQFQALQYLISEDSLTIGELSNKMFLACSTITDLVDRMEKNDLVKRARDEKDRRVVRIVVLDNGHEIINQVLHARRNYLEEVLLDVSSEQRDSVLQGISLI

SEQ ID NO: 1892 - protein, 137 aa, Alkaliphilus oremlandii OhILAs
ARYDDNIIEIEREIRYLCTKIKQKGREILADFSITPPQFEALQYLNNCQGITIGELSNKMFLACSTVTDLVDRMEKNDLVKRVRDEKDKRVVRPQVSEKGYQLIEEVLHARRNYLADVMKDVSEKDRKFILDGITMI

SEQ ID NO: 1893 - protein, 128 aa, Geobacillus thermodenitrificans NG80-2
PSAMNEKTVAELEKLLRYIAANLKQRGREILTNYPITPPQFVALQWLLEEGDLTVGELSNKMYLACSTTTDLIDRMERNGLVSRVRDEHDRRVVRIHLLEKGERIIEEVIEKRQRDLARVLENFSDEE

SEQ ID NO: 1894 - protein, 120 aa, Geobacillus kaustophilus HTA426
VAELEKLLRYIAANLKQRGREILTNYPITPPQFVALQWLLEEGDLTVGELSNKMYLACSTTTDLVDRMERNGLVARVRDEHDRRVVRIRLLEKGERIIEEVIEKRQRDLASVLESFSDEE

SEQ ID NO: 1895 - protein, 161 aa, Artificial
  Substituion in SEQ ID NO 1888
MVKFIGLWARTGCGYPLADYSPFVEEIEKALRLVAATVRRRGRVLLKDYDLTSPQFDALITLYNEGELTIGELSAKLYLAYSTTTDLVDRLERAGYVSRQRDLVDRRVVRVQLRDKGAQVIEAVLSARRAYLDSILKHVSIEQRRAILQALDLLLTNMGNS

SEQ ID NO: 1896 - protein, 161 aa, Artificial
  Substituion in SEQ ID NO 1888
MVRFIGLWARTGCGYPLADYSPFVEEIEKALRLVAATVRRRGRVLLKDYDLTSPQFDALITLYNEGELTIGELSAKLYLAYSTTTDLVDRLERAGYVSRQRDLVDRRVVRVQLRDKGAQVIEAVLSARRAYLDSILKHVSIEQRRAILQALDILLTNMGNS

SEQ ID NO: 1897 - protein, 161 aa, Artificial
  Substituion in SEQ ID NO 1888
MVRFIGLWARTGCGYPLADYSPFVEEIEKALRLVAATVRRRGRVLLKDYDLTSPQFDALITLYNEGELTIGELSAKLYLAYSTTTDLVDRLERAGYVSRQRDLVDRRVVRVQLRDKGAQIIEAVLSARRAYLDSILKHVSIEQRRAILQALDLLLTNMGNS

SEQ ID NO: 1898 - protein, 161 aa, Artificial
  Substituion in SEQ ID NO 1888
MVRFIGLWARTGCGYPLADYSPFVEEIEKALRLVAATVRRRGRVLLKDYDLTSPQFDALITLYNEGELTIGELSAKLYLAYSTTTDLVDRLERAGYVSRQRDIVDRRVVRVQLRDKGAQVIEAVLSARRAYLDSILKHVSIEQRRAILQALDLLLTNMGNS

SEQ ID NO: 1899 - protein, 161 aa, Artificial
  Substituion in SEQ ID NO 1888
MVRFIGLWARTGCGYPLADYSPFVDEIEKALRLVAATVRRRGRVLLKDYDLTSPQFDALITLYNEGELTIGELSAKLYLAYSTTTDLVDRLERAGYVSRQRDLVDRRVVRVQLRDKGAQVIEAVLSARRAYLDSILKHVSIEQRRAILQALDLLLTNMGNS

SEQ ID NO: 1900 - DNA, 486 bp, Artificial
  Substituion in SEQ ID NO 1889
atggtaaaatttattggactctgggccaggacaggatgtgggtatcctttggcagactacagtcccttcgttgaggaaattgaaaaggcgctgcgccttgtcgccgccaccgtgcggcgccgcggcagggtcctgttgaaagactacgacctcacgtcgccccagtttgatgcgctcatcacgctgtacaacgaaggcgagttgaccatcggcgagctgtcggccaagttgtacctcgcgtacagcacgaccaccgacttggtggacaggctcgagcgcgccggttatgtatcccgccagcgggacctcgtggatcgccgtgtcgtgcgcgtgcaactccgggacaagggcgcgcaggtcattgaggcggtgctctccgcgcgccgtgcctacctcgattcgatcttgaaacacgtctccatcgagcagcgccgcgcgattctacaagcactggatcttcttttgacgaatatgggtaattcgtga

SEQ ID NO: 1901 - DNA, 486 bp, Artificial
  Substituion in SEQ ID NO 1889
atggtacgatttattggactctgggccaggacaggatgtgggtatcctttggcagactacagtcccttcgttgaggaaattgaaaaggcgctgcgccttgtcgccgccaccgtgcggcgccgcggcagggtcctgttgaaagactacgacctcacgtcgccccagtttgatgcgctcatcacgctgtacaacgaaggcgagttgaccatcggcgagctgtcggccaagttgtacctcgcgtacagcacgaccaccgacttggtggacaggctcgagcgcgccggttatgtatcccgccagcgggacctcgtggatcgccgtgtcgtgcgcgtgcaactccgggacaagggcgcgcaggtcattgaggcggtgctctccgcgcgccgtgcctacctcgattcgatcttgaaacacgtctccatcgagcagcgccgcgcgattctacaagcactggatattcttttgacgaatatgggtaattcgtga

SEQ ID NO: 1902 - DNA, 486 bp, Artificial
  Substituion in SEQ ID NO 1889
atggtacgatttattggactctgggccaggacaggatgtgggtatcctttggcagactacagtcccttcgttgaggaaattgaaaaggcgctgcgccttgtcgccgccaccgtgcggcgccgcggcagggtcctgttgaaagactacgacctcacgtcgccccagtttgatgcgctcatcacgctgtacaacgaaggcgagttgaccatcggcgagctgtcggccaagttgtacctcgcgtacagcacgaccaccgacttggtggacaggctcgagcgcgccggttatgtatcccgccagcgggacctcgtggatcgccgtgtcgtgcgcgtgcaactccgggacaagggcgcgcagattattgaggcggtgctctccgcgcgccgtgcctacctcgattcgatcttgaaacacgtctccatcgagcagcgccgcgcgattctacaagcactggatcttcttttgacgaatatgggtaattcgtga

SEQ ID NO: 1903 - DNA, 486 bp, Artificial
  Substituion in SEQ ID NO 1889
atggtacgatttattggactctgggccaggacaggatgtgggtatcctttggcagactacagtcccttcgttgaggaaattgaaaaggcgctgcgccttgtcgccgccaccgtgcggcgccgcggcagggtcctgttgaaagactacgacctcacgtcgccccagtttgatgcgctcatcacgctgtacaacgaaggcgagttgaccatcggcgagctgtcggccaagttgtacctcgcgtacagcacgaccaccgacttggtggacaggctcgagcgcgccggttatgtatcccgccagcgggacattgtggatcgccgtgtcgtgcgcgtgcaactccgggacaagggcgcgcaggtcattgaggcggtgctctccgcgcgccgtgcctacctcgattcgatcttgaaacacgtctccatcgagcagcgccgcgcgattctacaagcactggatcttcttttgacgaatatgggtaattcgtga

SEQ ID NO: 1904 - DNA, 486 bp, Artificial
  Substituion in SEQ ID NO 1889
atggtacgatttattggactctgggccaggacaggatgtgggtatcctttggcagactacagtcccttcgttgatgaaattgaaaaggcgctgcgccttgtcgccgccaccgtgcggcgccgcggcagggtcctgttgaaagactacgacctcacgtcgccccagtttgatgcgctcatcacgctgtacaacgaaggcgagttgaccatcggcgagctgtcggccaagttgtacctcgcgtacagcacgaccaccgacttggtggacaggctcgagcgcgccggttatgtatcccgccagcgggacctcgtggatcgccgtgtcgtgcgcgtgcaactccgggacaagggcgcgcaggtcattgaggcggtgctctccgcgcgccgtgcctacctcgattcgatcttgaaacacgtctccatcgagcagcgccgcgcgattctacaagcactggatcttcttttgacgaatatgggtaattcgtga

SEQ ID NO: 1905 - protein, 166 aa, Alicyclobacillus acidocaldarius
MTRHEARECALQALCVLDVQRDLGSAEAIASALAERGTDAGGDFTYIEELVDGTRRHLDEIDELLARHMERWSPERIGRVERNVLRLATYELLFEPELPIASAIDEAVEIAKTFATEQSGRFVNGVLAKLLPAVADRRRADTREAGQEKRTASAAEPAREGVDDGA

SEQ ID NO: 1906 - DNA, 501 bp, Alicyclobacillus acidocaldarius
ttgacccgacatgaagcgagagagtgcgcgctgcaggcgctgtgcgtgctcgacgtccagcgcgatctcggctcggcggaagcgatagcctccgcgttggccgaacgcggcacggatgccgggggagacttcacgtacatcgaggaactcgtcgatggcacgcgccggcatctggacgagatcgacgagttgcttgcccggcacatggagcgctggtcgcctgaacgcatcgggcgcgtcgagcggaacgttttgcgcctcgccacttacgaactgctgttcgagccggaactgcccattgccagcgccatcgacgaggccgtggagattgccaaaacgttcgccacggagcaatccggtcgcttcgtgaacggtgtgctcgcgaagcttttgcccgccgtggcggatcggcgacgtgcggatacgcgcgaggcggggcaggagaagcggacagcaagcgcggccgaaccggcgcgggagggcgtcgacgatggcgcgtga

SEQ ID NO: 1907 - protein, 128 aa, Geobacillus kaustophilus HTA426
MKRHEAREKALQALFQIDVGRIPPDEALHNVTGGGDIDPFLRQLVFGVVEHQEEIDELLRANLEKWTLERVANVDRAILRMATYEMKYADDVPVSVSLDEAVELAKKFGDWKSGSFVNGVLSKVKAAL

SEQ ID NO: 1908 - protein, 122 aa, Bacillus sp. B14905
MKRHEAREKALQVLFQLDNTDLTVEEAMGHIKGQPTNAFYEKIVTGTAEHLEEIDATLEQHLEKWSLARLPKIERTVLRLAVYELLYMPETPKRVVLNEAIELCKTFGDDSSSKFVNGVLSK

SEQ ID NO: 1909 - protein, 124 aa, Bacillus subtilis subsp. subtilis str. 168
MKRRTAREKALQALFQIDVSDIAVNEAIEHALDEEKTDPFFEQLVHGVLEHQDQLDEMISKHLVNWKLDRIANVDRAILRLAAYEMAYAEDIPVNVSMNEAIELAKRFGDDKATKFVNGVLSNI

SEQ ID NO: 1910 - protein, 128 aa, Exiguobacterium sibiricum 255-15
MKRHMARELAVQSLFQMELSDLSAQEAIEFAVEGKEYDTFVTRLVEGVEANKPEIDQKLRAALVNWSFERIGNIERTILRLAVYELLFEAKIPVRVTINEAIELTKAFADEEATKIVNGVLGKVAQEV

SEQ ID NO: 1911 - protein, 128 aa, Geobacillus thermodenitrificans NG80-2
MKRHEAREKALQALFQIDVGHIPPDEAIGNVTGSGEVDPFLRQLVFDVIEHRAEIDELLRSNLEKWKLERVANVDRVILRMATYEMKYVDDVPVSVSLDEAVELAKKFGDWKSGSFVNGVLSKVKAAL

SEQ ID NO: 1912 - protein, 166 aa, Artificial
  Substituion in SEQ ID NO 1905
MTRHEARECALQALCVLDVQRDLGSAEAIASALAERGTDAGGDFTYIEELVDGTRRHLDDIDELLARHMERWSPERIGRVERNVLRLATYELLFEPELPIASAIDEAVEIAKTFATEQSGRFVNGVLAKLLPAVADRRRADTREAGQEKRTASAAEPAREGVDDGA

SEQ ID NO: 1913 - protein, 166 aa, Artificial
  Substituion in SEQ ID NO 1905
MTRHEARECALQALCVLDVQRDLGSAEAIASALAERGTDAGGDFTYIEELVDGTRRHLDEIDELLARHMERWSPERIGRVERNVLRLATYELLFEPELPIASAIDEAVEIAKTFATEQSGRFVNGVLAKLLPAVAERRRADTREAGQEKRTASAAEPAREGVDDGA

SEQ ID NO: 1914 - protein, 166 aa, Artificial
  Substituion in SEQ ID NO 1905
MTRHEARECALQALCVLDVQRDLGSAEAIASALAERGTDAGGDFTYIEELVDGTKRHLDEIDELLARHMERWSPERIGRVERNVLRLATYELLFEPELPIASAIDEAVEIAKTFATEQSGRFVNGVLAKLLPAVADRRRADTREAGQEKRTASAAEPAREGVDDGA

SEQ ID NO: 1915 - protein, 166 aa, Artificial
  Substituion in SEQ ID NO 1905
MTRHEARECALQALCVLDVQRDLGSAEAIASALAERGTDAGGDFTYIEELVDGTRRHLDEIDELLARHMERWSPERIGRVERNVLRLATYELLFEPELPIASAIDEAVEIAKTFATEQSGKFVNGVLAKLLPAVADRRRADTREAGQEKRTASAAEPAREGVDDGA

SEQ ID NO: 1916 - protein, 166 aa, Artificial
  Substituion in SEQ ID NO 1905
MTRHDARECALQALCVLDVQRDLGSAEAIASALAERGTDAGGDFTYIEELVDGTRRHLDEIDELLARHMERWSPERIGRVERNVLRLATYELLFEPELPIASAIDEAVEIAKTFATEQSGRFVNGVLAKLLPAVADRRRADTREAGQEKRTASAAEPAREGVDDGA

SEQ ID NO: 1917 - DNA, 501 bp, Artificial
  Substituion in SEQ ID NO 1906
ttgacccgacatgaagcgagagagtgcgcgctgcaggcgctgtgcgtgctcgacgtccagcgcgatctcggctcggcggaagcgatagcctccgcgttggccgaacgcggcacggatgccgggggagacttcacgtacatcgaggaactcgtcgatggcacgcgccggcatctggacgatatcgacgagttgcttgcccggcacatggagcgctggtcgcctgaacgcatcgggcgcgtcgagcggaacgttttgcgcctcgccacttacgaactgctgttcgagccggaactgcccattgccagcgccatcgacgaggccgtggagattgccaaaacgttcgccacggagcaatccggtcgcttcgtgaacggtgtgctcgcgaagcttttgcccgccgtggcggatcggcgacgtgcggatacgcgcgaggcggggcaggagaagcggacagcaagcgcggccgaaccggcgcgggagggcgtcgacgatggcgcgtga

SEQ ID NO: 1918 - DNA, 501 bp, Artificial
  Substituion in SEQ ID NO 1906
ttgacccgacatgaagcgagagagtgcgcgctgcaggcgctgtgcgtgctcgacgtccagcgcgatctcggctcggcggaagcgatagcctccgcgttggccgaacgcggcacggatgccgggggagacttcacgtacatcgaggaactcgtcgatggcacgcgccggcatctggacgagatcgacgagttgcttgcccggcacatggagcgctggtcgcctgaacgcatcgggcgcgtcgagcggaacgttttgcgcctcgccacttacgaactgctgttcgagccggaactgcccattgccagcgccatcgacgaggccgtggagattgccaaaacgttcgccacggagcaatccggtcgcttcgtgaacggtgtgctcgcgaagcttttgcccgccgtggcggaacggcgacgtgcggatacgcgcgaggcggggcaggagaagcggacagcaagcgcggccgaaccggcgcgggagggcgtcgacgatggcgcgtga

SEQ ID NO: 1919 - DNA, 501 bp, Artificial
  Substituion in SEQ ID NO 1906
ttgacccgacatgaagcgagagagtgcgcgctgcaggcgctgtgcgtgctcgacgtccagcgcgatctcggctcggcggaagcgatagcctccgcgttggccgaacgcggcacggatgccgggggagacttcacgtacatcgaggaactcgtcgatggcacgaaacggcatctggacgagatcgacgagttgcttgcccggcacatggagcgctggtcgcctgaacgcatcgggcgcgtcgagcggaacgttttgcgcctcgccacttacgaactgctgttcgagccggaactgcccattgccagcgccatcgacgaggccgtggagattgccaaaacgttcgccacggagcaatccggtcgcttcgtgaacggtgtgctcgcgaagcttttgcccgccgtggcggatcggcgacgtgcggatacgcgcgaggcggggcaggagaagcggacagcaagcgcggccgaaccggcgcgggagggcgtcgacgatggcgcgtga

SEQ ID NO: 1920 - DNA, 501 bp, Artificial
  Substituion in SEQ ID NO 1906
ttgacccgacatgaagcgagagagtgcgcgctgcaggcgctgtgcgtgctcgacgtccagcgcgatctcggctcggcggaagcgatagcctccgcgttggccgaacgcggcacggatgccgggggagacttcacgtacatcgaggaactcgtcgatggcacgcgccggcatctggacgagatcgacgagttgcttgcccggcacatggagcgctggtcgcctgaacgcatcgggcgcgtcgagcggaacgttttgcgcctcgccacttacgaactgctgttcgagccggaactgcccattgccagcgccatcgacgaggccgtggagattgccaaaacgttcgccacggagcaatccggtaaattcgtgaacggtgtgctcgcgaagcttttgcccgccgtggcggatcggcgacgtgcggatacgcgcgaggcggggcaggagaagcggacagcaagcgcggccgaaccggcgcgggagggcgtcgacgatggcgcgtga

SEQ ID NO: 1921 - DNA, 501 bp, Artificial
  Substituion in SEQ ID NO 1906
ttgacccgacatgatgcgagagagtgcgcgctgcaggcgctgtgcgtgctcgacgtccagcgcgatctcggctcggcggaagcgatagcctccgcgttggccgaacgcggcacggatgccgggggagacttcacgtacatcgaggaactcgtcgatggcacgcgccggcatctggacgagatcgacgagttgcttgcccggcacatggagcgctggtcgcctgaacgcatcgggcgcgtcgagcggaacgttttgcgcctcgccacttacgaactgctgttcgagccggaactgcccattgccagcgccatcgacgaggccgtggagattgccaaaacgttcgccacggagcaatccggtcgcttcgtgaacggtgtgctcgcgaagcttttgcccgccgtggcggatcggcgacgtgcggatacgcgcgaggcggggcaggagaagcggacagcaagcgcggccgaaccggcgcgggagggcgtcgacgatggcgcgtga

SEQ ID NO: 1922 - protein, 446 aa, Alicyclobacillus acidocaldarius
MTLRGIGCVVPLRLAHTNADFDSVDSERGGCRMKRHSRALGLGLGALCLVATSAAPQVARAASAPGIVQIREAADAGPTQSAPAASVDLAKQARSAVLMDFATGKVLYAKNAHERLPMASITKIMTLLLIFEAIDSGKLKWTDRVQASERAASMGGSQIFLEPGETMTVRDLVKGIAIASANDACVAMAEHLDGSEEAFVARMNQRAKELGMTDTHFANCNGLPAPNHYSSAHDIAVMSRALLMHPEITAFTSVYSDYLRKDTDHPLWLVNTNKLVRFYDGVDGLKTGYTQEAKYCLSATAKRDGFRVIAVVMGEPKPTVRNAEIAAMLNYAFAHYKSVQVYPRGHVVGQVAVKRGTRDRVEAVTAEPVAFVTERSSKTAYTTEIQWMTLKAPVSRGQVVGHVLVKSGGQIVANVPVVAKDDVPKATFFQSLGKTVKKVITFGQAQ

SEQ ID NO: 1923 - DNA, 1341 bp, Alicyclobacillus acidocaldarius
gtgaccctacgtggcatcggatgcgtagtgccgcttcgtcttgcacacactaacgccgatttcgattcggtggactccgagagaggaggttgcaggatgaagcggcattctcgcgccctcgggctcggcctcggcgccctgtgtctcgtcgcgacgagcgctgcgccccaagtcgctcgtgcggcctcggcgcccgggatcgttcaaattcgcgaggcggcggacgccggcccgacgcaatctgcgccggccgcgagcgtcgatctcgccaaacaggcgaggtccgcggtcctgatggattttgcgaccgggaaggtgctttacgcgaaaaacgcccacgagcgcctgcccatggcgagcatcacgaagatcatgacgctccttctcatttttgaggcgatcgacagcggcaagttgaagtggaccgatcgcgtccaagcgagcgagcgagccgccagcatgggcggatcgcagatctttctcgaacccggtgagacgatgaccgtgcgcgacctcgtgaagggcatcgccatcgcttcggccaacgacgcctgcgtcgccatggccgagcacctcgatggaagcgaagaggcgttcgtcgctcgcatgaaccaacgcgcgaaggagctcggcatgaccgacacgcacttcgccaactgcaacgggcttcctgccccaaaccattattccagtgcgcacgacatcgccgtcatgtcgagggcgcttctcatgcatcccgagatcacggcgttcacctcggtgtacagcgactacttgcgcaaggacacggatcacccgctctggctcgtcaacaccaacaaactcgtccgcttctacgacggggtggacgggctgaagacgggctacacgcaggaggcgaaatattgtctttccgccacggcgaagcgcgatgggtttcgcgtgatcgccgtggtgatgggcgagccgaaacccacggtccgaaatgcggaaattgcggccatgctgaattacgcgtttgcgcactacaaatcggtccaagtgtatccccgcggccatgtggtggggcaagtcgcggtcaagcgtggcacgcgcgatcgcgtcgaggcggtgacggccgaaccggtggcctttgtcaccgagcgttccagcaaaaccgcgtataccaccgagatccagtggatgacgctgaaggcaccggtgtctcgcggccaggtggtcggacacgtgctggtgaaatccggcggtcagattgtggcgaatgtgccggttgtcgcgaaggacgacgtgccgaaggcgacgttcttccagagccttggcaagaccgtgaagaaagtgatcacgttcggccaggcccaatga

SEQ ID NO: 1924 - protein, 354 aa, Bacillus sp. SG-1
PFASAEEKKTELAAGAKSAILIERDTGTVLYDKNSHEKLPPASMTKIMTMILIMEALDKGQIKWEDEVRTSEYAASMGGSQIFLEPGEVMTVKEMLLGISIGSANDASVAMAEHIAGSEEGFVEKMNNKVKDLGLKDTNFKNPTGLPASEHYSSAHDMAMMAKELLKYQEITKYTGTYESYLREDTDKKFWLVNTNKLVRFYPGVDGLKTGFTNEAKYCLTATAKKDNMRVIAVVFGEPTPKDRNAEISKMFDYAFSQYQTQPLFEKGASVGKAEISKGKAKEVEAMTNEPISLLAKKGEKLDGIEKKVKLQKLKAPVKKGDTIGKLVVEKDGKTLSETPLIAKEDVPQASFWQ

SEQ ID NO: 1925 - protein, 361 aa, Geobacillus kaustophilus HTA426
AKVKLADEAKSAILIERDTGKVLYEKNAHEPLPPASMTKIMTMLLVMEAIDEGKLSYDEKVRASEYAASMGGSQIFLEPGEEMTVDELLRGIAIGSANDASVAMAEQIAGSEEAFVEMMNEKAKQLGLKNTHFANATGLPAEHHYSSAYDMAMMARELLKYEDITKYTSKYEDYLRENTDKKFWLVNTNRLVKFYPGVDGLKTGYTAEAKYCLTATAKKNGMRVIAVVFGAPTPKSRNAQITKMLDYAFSQYRTHPVYKRNETVARVNISKGKRSSVEAVTSEPVSVLTKKGQSVEQIEKVIKVKDNVKAPVRKGDELGVLILKQDGKEILHSPIVAKQTVEEASFWDLFKRVFGRFVQAG

SEQ ID NO: 1926 - protein, 363 aa, Bacillus halodurans C-125
PVGLAAEKQPNLAKEASSAIVIERDTGQVLFEKNSDEKLPPASMTKIMTLLLIMEAIDSGKITYDDMVRTSENAASMGGSQVFLEPGEEMSVRDMIKAIAIASGNDASVAMAEHLAGTEEEFVGMMNEKARQLGLKNTNFVNTNGLPEKDHYTSAYDLAMISKELLKYEDITEFTSVYEDYLRKGTDKEFWLVNTNRLVKFYPGVDGLKTGFTKEAKYCLTATAVKNGMRVITVVMGAPTPKERNSQITEMLDFAFSQYQTHQVYERDTYMMDLNVRKGNKKSVPIFTSESVSLVTKKGESIDNVTERVEWKESLLAPVHKGDVVGTLYLERDGEILSETPLIAGEDVASASFWQMFKRIVGK

SEQ ID NO: 1927 - protein, 358 aa, Geobacillus thermodenitrificans NG80-2
ELADEAKSAILIERDTGKVLYEKNPHEKLPPASMTKIMTMLLIMEAIDEGKLSYDEKVRTSEYAASMGGSQIFLEPGEEMTVDELLRAIAIGSANDASVAMAERIAGSEEAFVEMMNEKAKELGLKETKFANTTGLPAEGHYSSAYDMAIMARELLKYEGITKYTSKYEDYLRENTDKKFWLVNTNRLVKFYPGVDGLKTGFTSEAGYCLTATAKKNGMRVIAVVFGAPTPKSRNAQITKMLDYAFHHYQAHPVYKRNETVARVDVSKGKQKSVAAVTSEPVSVLTKKGQSVEQIEKVVKVKDGVKAPVRKGDELGVLILKQDGKEILRSPLVAKQTVAEASFWDLFKRVFGRFVQAG

SEQ ID NO: 1928 - protein, 368 aa, Bacillus amyloliquefaciens FZB42
TASAPSAFAKPDGKHTSELAHEAKSAVLIERDTGSILYNKNSRERLAPASMTKIMTMLLIMEALDKGKIKMSDKVRTSEHAASMGGSQIFLEPGEEMTVKEMLKGIAIASGNDASVAMAEYIAGSEEDFVSRMNKKAKELGLKDTSFKNPTGLPEKDHYSSAYDMAKMAKELLKYDKITQFTGTYEDYLRENTDKKFWLVNTNRLIKFYPGVDGVKTGFTGEAKYCLTATAKKGNMRVIAVVFGASTPKERNAQVTKMLDYAFSQFKTHPLYKRDQIVGTVKVKKGKQKLIKLTTSEPISLLAKKGENMDKVKKEVKINGNVTAPVKKGEVLGSLVLKKDGKVLVESPVTAKDDMEKAGFLTFLKRTM

SEQ ID NO: 1929 - protein, 446 aa, Artificial
  Substituion in SEQ ID NO 1922
MTLRGIGCVVPLRLAHTNADFDSVDSERGGCRMKRHSRALGLGLGALCLVATSAAPQVARAASAPGIVQIREAADAGPTQSAPAASVDLAKQARSAVLMDFATGKVLYAKNAHERLPMASITKIMTLLLIFEAIDSGKLKWTDRVQASERAASMGGSQIFLEPGETMTVRDLVKGIAIASANDACVAMAEHLDGSEEAFVARMNQRAKELGMTDTHFANCNGLPAPNHYSSAHDIAVMSRALLMHPEITAFTSVYSDYLRKDTDHPLWLVNTNKLVRFYDGVDGLKTGYTQEAKYCLSATAKRDGFRVIAVVMGEPKPTVRNAEIAAMLNYAFAHYKSVQVYPRGHVVGQVAVKRGTRDRVEAVTAEPVAFVTERSSKTAYTTEIQWMTLKAPVSRGQVVGHVLVKSGGQIVANVPVVAKDDVPKATFFQSLGKTVKKVLTFGQAQ

SEQ ID NO: 1930 - protein, 446 aa, Artificial
  Substituion in SEQ ID NO 1922
MTLRGIGCVVPLRLAHTNADFDSVDSERGGCRMKRHSRALGLGLGALCLVATSAAPQVARAASAPGIVQIREAADAGPTQSAPAASVDLAKQARSAVLMDFATGKVLYAKNAHERLPMASITKIMTLLLIFEAIDSGKLKWTDRVQASERAASMGGSQIFLEPGETMTVRDLVKGIAIASANDACVAMAEHLDGSEEAFVARMNQRAKELGMTDTHFANCNGLPAPNHYSSAHDIAVMSRALLMHPEITAFTSVYSDYLRKDTDHPLWLVNTNKLVRFYDGVDGLKTGYTQEAKYCLSATAKRDGFRVIAVVMGEPKPTVRNAEIAAMLNYAFAHYKSVQVYPRGHVVGQVAVKRGTRDRVEAVTAEPVAFVTERSSKTAYTTEIQWMTLRAPVSRGQVVGHVLVKSGGQIVANVPVVAKDDVPKATFFQSLGKTVKKVITFGQAQ

SEQ ID NO: 1931 - protein, 446 aa, Artificial
  Substituion in SEQ ID NO 1922
MTLRGLGCVVPLRLAHTNADFDSVDSERGGCRMKRHSRALGLGLGALCLVATSAAPQVARAASAPGIVQIREAADAGPTQSAPAASVDLAKQARSAVLMDFATGKVLYAKNAHERLPMASITKIMTLLLIFEAIDSGKLKWTDRVQASERAASMGGSQIFLEPGETMTVRDLVKGIAIASANDACVAMAEHLDGSEEAFVARMNQRAKELGMTDTHFANCNGLPAPNHYSSAHDIAVMSRALLMHPEITAFTSVYSDYLRKDTDHPLWLVNTNKLVRFYDGVDGLKTGYTQEAKYCLSATAKRDGFRVIAVVMGEPKPTVRNAEIAAMLNYAFAHYKSVQVYPRGHVVGQVAVKRGTRDRVEAVTAEPVAFVTERSSKTAYTTEIQWMTLKAPVSRGQVVGHVLVKSGGQIVANVPVVAKDDVPKATFFQSLGKTVKKVITFGQAQ

SEQ ID NO: 1932 - protein, 446 aa, Artificial
  Substituion in SEQ ID NO 1922
MTLRGIGCVVPLRLAHTNADFDSVDSERGGCRMKRHSRALGLGLGALCLVATSAAPQVARAASAPGIVNIREAADAGPTQSAPAASVDLAKQARSAVLMDFATGKVLYAKNAHERLPMASITKIMTLLLIFEAIDSGKLKWTDRVQASERAASMGGSQIFLEPGETMTVRDLVKGIAIASANDACVAMAEHLDGSEEAFVARMNQRAKELGMTDTHFANCNGLPAPNHYSSAHDIAVMSRALLMHPEITAFTSVYSDYLRKDTDHPLWLVNTNKLVRFYDGVDGLKTGYTQEAKYCLSATAKRDGFRVIAVVMGEPKPTVRNAEIAAMLNYAFAHYKSVQVYPRGHVVGQVAVKRGTRDRVEAVTAEPVAFVTERSSKTAYTTEIQWMTLKAPVSRGQVVGHVLVKSGGQIVANVPVVAKDDVPKATFFQSLGKTVKKVITFGQAQ

SEQ ID NO: 1933 - protein, 446 aa, Artificial
  Substituion in SEQ ID NO 1922
MTLRGIGCVVPLRLAHTNADFDSVDSERGGCRMKRHSRALGLGLGALCLVATSAAPQVARAASAPGIVQIREAADAGPTQSAPAASVDLAKQARSAVLMDFATGKVLYAKNAHERLPMASITKIMTLLLIFEAIDSGKLKWTDRVQASERAASMGGSQIFLEPGETMTVRDLVKGIAIASANDACVAMAEHLDGSEEAFVARMNQRAKELGMTDTHFANCNGLPAPNHYSSAHDIAVMSRALLMHPEITAFTSVYSDYLRKDTDHPLWLVNTNKLVRFYDGVDGLKTGYTQEAKYCLSATARRDGFRVIAVVMGEPKPTVRNAEIAAMLNYAFAHYKSVQVYPRGHVVGQVAVKRGTRDRVEAVTAEPVAFVTERSSKTAYTTEIQWMTLKAPVSRGQVVGHVLVKSGGQIVANVPVVAKDDVPKATFFQSLGKTVKKVITFGQAQ

SEQ ID NO: 1934 - DNA, 1341 bp, Artificial
  Substituion in SEQ ID NO 1923
gtgaccctacgtggcatcggatgcgtagtgccgcttcgtcttgcacacactaacgccgatttcgattcggtggactccgagagaggaggttgcaggatgaagcggcattctcgcgccctcgggctcggcctcggcgccctgtgtctcgtcgcgacgagcgctgcgccccaagtcgctcgtgcggcctcggcgcccgggatcgttcaaattcgcgaggcggcggacgccggcccgacgcaatctgcgccggccgcgagcgtcgatctcgccaaacaggcgaggtccgcggtcctgatggattttgcgaccgggaaggtgctttacgcgaaaaacgcccacgagcgcctgcccatggcgagcatcacgaagatcatgacgctccttctcatttttgaggcgatcgacagcggcaagttgaagtggaccgatcgcgtccaagcgagcgagcgagccgccagcatgggcggatcgcagatctttctcgaacccggtgagacgatgaccgtgcgcgacctcgtgaagggcatcgccatcgcttcggccaacgacgcctgcgtcgccatggccgagcacctcgatggaagcgaagaggcgttcgtcgctcgcatgaaccaacgcgcgaaggagctcggcatgaccgacacgcacttcgccaactgcaacgggcttcctgccccaaaccattattccagtgcgcacgacatcgccgtcatgtcgagggcgcttctcatgcatcccgagatcacggcgttcacctcggtgtacagcgactacttgcgcaaggacacggatcacccgctctggctcgtcaacaccaacaaactcgtccgcttctacgacggggtggacgggctgaagacgggctacacgcaggaggcgaaatattgtctttccgccacggcgaagcgcgatgggtttcgcgtgatcgccgtggtgatgggcgagccgaaacccacggtccgaaatgcggaaattgcggccatgctgaattacgcgtttgcgcactacaaatcggtccaagtgtatccccgcggccatgtggtggggcaagtcgcggtcaagcgtggcacgcgcgatcgcgtcgaggcggtgacggccgaaccggtggcctttgtcaccgagcgttccagcaaaaccgcgtataccaccgagatccagtggatgacgctgaaggcaccggtgtctcgcggccaggtggtcggacacgtgctggtgaaatccggcggtcagattgtggcgaatgtgccggttgtcgcgaaggacgacgtgccgaaggcgacgttcttccagagccttggcaagaccgtgaagaaagtgttaacgttcggccaggcccaatga

SEQ ID NO: 1935 - DNA, 1341 bp, Artificial
  Substituion in SEQ ID NO 1923
gtgaccctacgtggcatcggatgcgtagtgccgcttcgtcttgcacacactaacgccgatttcgattcggtggactccgagagaggaggttgcaggatgaagcggcattctcgcgccctcgggctcggcctcggcgccctgtgtctcgtcgcgacgagcgctgcgccccaagtcgctcgtgcggcctcggcgcccgggatcgttcaaattcgcgaggcggcggacgccggcccgacgcaatctgcgccggccgcgagcgtcgatctcgccaaacaggcgaggtccgcggtcctgatggattttgcgaccgggaaggtgctttacgcgaaaaacgcccacgagcgcctgcccatggcgagcatcacgaagatcatgacgctccttctcatttttgaggcgatcgacagcggcaagttgaagtggaccgatcgcgtccaagcgagcgagcgagccgccagcatgggcggatcgcagatctttctcgaacccggtgagacgatgaccgtgcgcgacctcgtgaagggcatcgccatcgcttcggccaacgacgcctgcgtcgccatggccgagcacctcgatggaagcgaagaggcgttcgtcgctcgcatgaaccaacgcgcgaaggagctcggcatgaccgacacgcacttcgccaactgcaacgggcttcctgccccaaaccattattccagtgcgcacgacatcgccgtcatgtcgagggcgcttctcatgcatcccgagatcacggcgttcacctcggtgtacagcgactacttgcgcaaggacacggatcacccgctctggctcgtcaacaccaacaaactcgtccgcttctacgacggggtggacgggctgaagacgggctacacgcaggaggcgaaatattgtctttccgccacggcgaagcgcgatgggtttcgcgtgatcgccgtggtgatgggcgagccgaaacccacggtccgaaatgcggaaattgcggccatgctgaattacgcgtttgcgcactacaaatcggtccaagtgtatccccgcggccatgtggtggggcaagtcgcggtcaagcgtggcacgcgcgatcgcgtcgaggcggtgacggccgaaccggtggcctttgtcaccgagcgttccagcaaaaccgcgtataccaccgagatccagtggatgacgctgcgtgcaccggtgtctcgcggccaggtggtcggacacgtgctggtgaaatccggcggtcagattgtggcgaatgtgccggttgtcgcgaaggacgacgtgccgaaggcgacgttcttccagagccttggcaagaccgtgaagaaagtgatcacgttcggccaggcccaatga

SEQ ID NO: 1936 - DNA, 1341 bp, Artificial
  Substituion in SEQ ID NO 1923
gtgaccctacgtggcttaggatgcgtagtgccgcttcgtcttgcacacactaacgccgatttcgattcggtggactccgagagaggaggttgcaggatgaagcggcattctcgcgccctcgggctcggcctcggcgccctgtgtctcgtcgcgacgagcgctgcgccccaagtcgctcgtgcggcctcggcgcccgggatcgttcaaattcgcgaggcggcggacgccggcccgacgcaatctgcgccggccgcgagcgtcgatctcgccaaacaggcgaggtccgcggtcctgatggattttgcgaccgggaaggtgctttacgcgaaaaacgcccacgagcgcctgcccatggcgagcatcacgaagatcatgacgctccttctcatttttgaggcgatcgacagcggcaagttgaagtggaccgatcgcgtccaagcgagcgagcgagccgccagcatgggcggatcgcagatctttctcgaacccggtgagacgatgaccgtgcgcgacctcgtgaagggcatcgccatcgcttcggccaacgacgcctgcgtcgccatggccgagcacctcgatggaagcgaagaggcgttcgtcgctcgcatgaaccaacgcgcgaaggagctcggcatgaccgacacgcacttcgccaactgcaacgggcttcctgccccaaaccattattccagtgcgcacgacatcgccgtcatgtcgagggcgcttctcatgcatcccgagatcacggcgttcacctcggtgtacagcgactacttgcgcaaggacacggatcacccgctctggctcgtcaacaccaacaaactcgtccgcttctacgacggggtggacgggctgaagacgggctacacgcaggaggcgaaatattgtctttccgccacggcgaagcgcgatgggtttcgcgtgatcgccgtggtgatgggcgagccgaaacccacggtccgaaatgcggaaattgcggccatgctgaattacgcgtttgcgcactacaaatcggtccaagtgtatccccgcggccatgtggtggggcaagtcgcggtcaagcgtggcacgcgcgatcgcgtcgaggcggtgacggccgaaccggtggcctttgtcaccgagcgttccagcaaaaccgcgtataccaccgagatccagtggatgacgctgaaggcaccggtgtctcgcggccaggtggtcggacacgtgctggtgaaatccggcggtcagattgtggcgaatgtgccggttgtcgcgaaggacgacgtgccgaaggcgacgttcttccagagccttggcaagaccgtgaagaaagtgatcacgttcggccaggcccaatga

SEQ ID NO: 1937 - DNA, 1341 bp, Artificial
  Substituion in SEQ ID NO 1923
gtgaccctacgtggcatcggatgcgtagtgccgcttcgtcttgcacacactaacgccgatttcgattcggtggactccgagagaggaggttgcaggatgaagcggcattctcgcgccctcgggctcggcctcggcgccctgtgtctcgtcgcgacgagcgctgcgccccaagtcgctcgtgcggcctcggcgcccgggatcgttaatattcgcgaggcggcggacgccggcccgacgcaatctgcgccggccgcgagcgtcgatctcgccaaacaggcgaggtccgcggtcctgatggattttgcgaccgggaaggtgctttacgcgaaaaacgcccacgagcgcctgcccatggcgagcatcacgaagatcatgacgctccttctcatttttgaggcgatcgacagcggcaagttgaagtggaccgatcgcgtccaagcgagcgagcgagccgccagcatgggcggatcgcagatctttctcgaacccggtgagacgatgaccgtgcgcgacctcgtgaagggcatcgccatcgcttcggccaacgacgcctgcgtcgccatggccgagcacctcgatggaagcgaagaggcgttcgtcgctcgcatgaaccaacgcgcgaaggagctcggcatgaccgacacgcacttcgccaactgcaacgggcttcctgccccaaaccattattccagtgcgcacgacatcgccgtcatgtcgagggcgcttctcatgcatcccgagatcacggcgttcacctcggtgtacagcgactacttgcgcaaggacacggatcacccgctctggctcgtcaacaccaacaaactcgtccgcttctacgacggggtggacgggctgaagacgggctacacgcaggaggcgaaatattgtctttccgccacggcgaagcgcgatgggtttcgcgtgatcgccgtggtgatgggcgagccgaaacccacggtccgaaatgcggaaattgcggccatgctgaattacgcgtttgcgcactacaaatcggtccaagtgtatccccgcggccatgtggtggggcaagtcgcggtcaagcgtggcacgcgcgatcgcgtcgaggcggtgacggccgaaccggtggcctttgtcaccgagcgttccagcaaaaccgcgtataccaccgagatccagtggatgacgctgaaggcaccggtgtctcgcggccaggtggtcggacacgtgctggtgaaatccggcggtcagattgtggcgaatgtgccggttgtcgcgaaggacgacgtgccgaaggcgacgttcttccagagccttggcaagaccgtgaagaaagtgatcacgttcggccaggcccaatga

SEQ ID NO: 1938 - DNA, 1341 bp, Artificial
  Substituion in SEQ ID NO 1923
gtgaccctacgtggcatcggatgcgtagtgccgcttcgtcttgcacacactaacgccgatttcgattcggtggactccgagagaggaggttgcaggatgaagcggcattctcgcgccctcgggctcggcctcggcgccctgtgtctcgtcgcgacgagcgctgcgccccaagtcgctcgtgcggcctcggcgcccgggatcgttcaaattcgcgaggcggcggacgccggcccgacgcaatctgcgccggccgcgagcgtcgatctcgccaaacaggcgaggtccgcggtcctgatggattttgcgaccgggaaggtgctttacgcgaaaaacgcccacgagcgcctgcccatggcgagcatcacgaagatcatgacgctccttctcatttttgaggcgatcgacagcggcaagttgaagtggaccgatcgcgtccaagcgagcgagcgagccgccagcatgggcggatcgcagatctttctcgaacccggtgagacgatgaccgtgcgcgacctcgtgaagggcatcgccatcgcttcggccaacgacgcctgcgtcgccatggccgagcacctcgatggaagcgaagaggcgttcgtcgctcgcatgaaccaacgcgcgaaggagctcggcatgaccgacacgcacttcgccaactgcaacgggcttcctgccccaaaccattattccagtgcgcacgacatcgccgtcatgtcgagggcgcttctcatgcatcccgagatcacggcgttcacctcggtgtacagcgactacttgcgcaaggacacggatcacccgctctggctcgtcaacaccaacaaactcgtccgcttctacgacggggtggacgggctgaagacgggctacacgcaggaggcgaaatattgtctttccgccacggcgcgtcgcgatgggtttcgcgtgatcgccgtggtgatgggcgagccgaaacccacggtccgaaatgcggaaattgcggccatgctgaattacgcgtttgcgcactacaaatcggtccaagtgtatccccgcggccatgtggtggggcaagtcgcggtcaagcgtggcacgcgcgatcgcgtcgaggcggtgacggccgaaccggtggcctttgtcaccgagcgttccagcaaaaccgcgtataccaccgagatccagtggatgacgctgaaggcaccggtgtctcgcggccaggtggtcggacacgtgctggtgaaatccggcggtcagattgtggcgaatgtgccggttgtcgcgaaggacgacgtgccgaaggcgacgttcttccagagccttggcaagaccgtgaagaaagtgatcacgttcggccaggcccaatga

SEQ ID NO: 1939 - protein, 128 aa, Alicyclobacillus acidocaldarius
MNFLTRPHKERGCRVSVETKLERGIVVIELKGELDHHAVEQMRDRIEQQLAEHGYRGLVMSFRNIDFMDSSGLGLILGRYRSVSEHGGKMALCEVNPTLRRLFEMSGLLKVIPVYDSEEAAVAAILGA

SEQ ID NO: 1940 - DNA, 387 bp, Alicyclobacillus acidocaldarius
gtgaatttcttgaccagaccgcataaggagaggggatgcagggtgtccgtggagaccaagttggagcgagggatcgtggtcatcgagctgaagggagaactggaccaccacgcggtggaacaaatgagggatcggatcgaacagcagcttgcggaacacggctaccggggcctcgtgatgtcgtttcggaacatcgattttatggacagttcgggcctcggcctgattctgggccgctatcgaagcgtctccgagcacggaggcaagatggcgctctgtgaagtcaacccgacgttgagacggctcttcgaaatgtccggtttgctcaaggtgattcccgtttacgactctgaagaagctgctgtggcagcgatattgggagcgtga

SEQ ID NO: 1941 - protein, 111 aa, Paenibacillus larvae subsp. larvae BRL-230010
LQIEFEQRRRALIVRLQGELDHHTADMVKTRMEEAIAKGDARNLVLSLRDLSFMDSSGLGVILGRYKQITGRGGKMIVCDVNPSIYRLFELSGLFKIVAIEDNERKAISSL

SEQ ID NO: 1942 - protein, 111 aa, Paenibacillus polymyxa
LQIEMEHHRGVLIVRLSGELDHHTSDMVRMQMDEAIQRRQCEHIVLSLKNLQFMDSSGLGVILGRYKLINQKGGEMAVCDVNPPVHRLLDMSGLFKIMPIYDNEVNALTEL

SEQ ID NO: 1943 - protein, 111 aa, Bacillus cereus ATCC 14579
LSMQLEVKRDVLCVRLEGELDHHTAEELRTKVTDMIETHGVHHIVLSLENLSFMDSSGLGVILGRYKHVKGLGGEMVVCAISPPVKRLFEMSGLFKIVRLEESEAHALATL

SEQ ID NO: 1944 - protein, 111 aa, Bacillus anthracis str. Ames
LSMQLEVKRDVLCVRLAGELDHHTAEELRTKVTDMIETHGVHHIVLSLENLSFMDSSGLGVILGRYKHVKGLGGEMVVCAISPPVKRLFEMSGLFKIVRLEESEAHALATL

SEQ ID NO: 1945 - protein, 111 aa, Bacillus weihenstephanensis KBAB4
LSMHLEVKRDVLCVRLEGELDHHTAEELRTKVTDMIETHGVHHIILSLENLTFMDSSGLGVILGRYKHVKGLGGEMVVCAISPPVKRLFEMSGLFKIVRLEESEAHALATL

SEQ ID NO: 1946 - protein, 128 aa, Artificial
  Substituion in SEQ ID NO 1939
MNFLTRPHKERGCRVSVETKLERGIVVIELKGELDHHAVEQMRDRIEQQLAEHGYRGLVMSFRNIDFMDSSGLGLILGRYRSVSEHGGKMALCDVNPTLRRLFEMSGLLKVIPVYDSEEAAVAAILGA

SEQ ID NO: 1947 - protein, 128 aa, Artificial
  Substituion in SEQ ID NO 1939
MNFLTRPHKERGCRVSVETKLERGIVVIDLKGELDHHAVEQMRDRIEQQLAEHGYRGLVMSFRNIDFMDSSGLGLILGRYRSVSEHGGKMALCEVNPTLRRLFEMSGLLKVIPVYDSEEAAVAAILGA

SEQ ID NO: 1948 - protein, 128 aa, Artificial
  Substituion in SEQ ID NO 1939
MNFLTRPHKERGCRVSVETKLERGIVVIELKGELDHHAVEQMRDRIEQQLAEHGYRGLVMSFRNIDFMDSSGLGLILGRYRSVSEHGGKMALCEVNPTLRRLFEMSGLLKVLPVYDSEEAAVAAILGA

SEQ ID NO: 1949 - protein, 128 aa, Artificial
  Substituion in SEQ ID NO 1939
MNFLTRPHKERGCRVSVETKLERGIVVIELKGELDHHAVEQMRDRIEQQLAEHGYRGLVMSFRNIDFMDSSGLGLILGRYRSVSDHGGKMALCEVNPTLRRLFEMSGLLKVIPVYDSEEAAVAAILGA

SEQ ID NO: 1950 - protein, 128 aa, Artificial
  Substituion in SEQ ID NO 1939
MQFLTRPHKERGCRVSVETKLERGIVVIELKGELDHHAVEQMRDRIEQQLAEHGYRGLVMSFRNIDFMDSSGLGLILGRYRSVSEHGGKMALCEVNPTLRRLFEMSGLLKVIPVYDSEEAAVAAILGA

SEQ ID NO: 1951 - DNA, 387 bp, Artificial
  Substituion in SEQ ID NO 1940
gtgaatttcttgaccagaccgcataaggagaggggatgcagggtgtccgtggagaccaagttggagcgagggatcgtggtcatcgagctgaagggagaactggaccaccacgcggtggaacaaatgagggatcggatcgaacagcagcttgcggaacacggctaccggggcctcgtgatgtcgtttcggaacatcgattttatggacagttcgggcctcggcctgattctgggccgctatcgaagcgtctccgagcacggaggcaagatggcgctctgtgatgtcaacccgacgttgagacggctcttcgaaatgtccggtttgctcaaggtgattcccgtttacgactctgaagaagctgctgtggcagcgatattgggagcgtga

SEQ ID NO: 1952 - DNA, 387 bp, Artificial
  Substituion in SEQ ID NO 1940
gtgaatttcttgaccagaccgcataaggagaggggatgcagggtgtccgtggagaccaagttggagcgagggatcgtggtcatcgatctgaagggagaactggaccaccacgcggtggaacaaatgagggatcggatcgaacagcagcttgcggaacacggctaccggggcctcgtgatgtcgtttcggaacatcgattttatggacagttcgggcctcggcctgattctgggccgctatcgaagcgtctccgagcacggaggcaagatggcgctctgtgaagtcaacccgacgttgagacggctcttcgaaatgtccggtttgctcaaggtgattcccgtttacgactctgaagaagctgctgtggcagcgatattgggagcgtga

SEQ ID NO: 1953 - DNA, 387 bp, Artificial
  Substituion in SEQ ID NO 1940
gtgaatttcttgaccagaccgcataaggagaggggatgcagggtgtccgtggagaccaagttggagcgagggatcgtggtcatcgagctgaagggagaactggaccaccacgcggtggaacaaatgagggatcggatcgaacagcagcttgcggaacacggctaccggggcctcgtgatgtcgtttcggaacatcgattttatggacagttcgggcctcggcctgattctgggccgctatcgaagcgtctccgagcacggaggcaagatggcgctctgtgaagtcaacccgacgttgagacggctcttcgaaatgtccggtttgctcaaggtgttacccgtttacgactctgaagaagctgctgtggcagcgatattgggagcgtga

SEQ ID NO: 1954 - DNA, 387 bp, Artificial
  Substituion in SEQ ID NO 1940
gtgaatttcttgaccagaccgcataaggagaggggatgcagggtgtccgtggagaccaagttggagcgagggatcgtggtcatcgagctgaagggagaactggaccaccacgcggtggaacaaatgagggatcggatcgaacagcagcttgcggaacacggctaccggggcctcgtgatgtcgtttcggaacatcgattttatggacagttcgggcctcggcctgattctgggccgctatcgaagcgtctccgatcacggaggcaagatggcgctctgtgaagtcaacccgacgttgagacggctcttcgaaatgtccggtttgctcaaggtgattcccgtttacgactctgaagaagctgctgtggcagcgatattgggagcgtga

SEQ ID NO: 1955 - DNA, 387 bp, Artificial
  Substituion in SEQ ID NO 1940
gtgcaattcttgaccagaccgcataaggagaggggatgcagggtgtccgtggagaccaagttggagcgagggatcgtggtcatcgagctgaagggagaactggaccaccacgcggtggaacaaatgagggatcggatcgaacagcagcttgcggaacacggctaccggggcctcgtgatgtcgtttcggaacatcgattttatggacagttcgggcctcggcctgattctgggccgctatcgaagcgtctccgagcacggaggcaagatggcgctctgtgaagtcaacccgacgttgagacggctcttcgaaatgtccggtttgctcaaggtgattcccgtttacgactctgaagaagctgctgtggcagcgatattgggagcgtga

SEQ ID NO: 1956 - protein, 256 aa, Alicyclobacillus acidocaldarius
MDQAKERPVPHHVDEYEKLSDEEVRELLERSHNGDAEARERLIVHNQRLVWAVVQRFLGRGYEAEDLFQIGCIGLMKAVDKFDLSYDVKFSTYAVPMIIGEIQRFLRDDSTVKVSRSLKETAKQIRHVRDRLAKELGRQPHITEIAEAMGMEPSEIVFAQEALRAPASIHETVYENDGDPIYLMDQIADEETEGKFDKVELHEIIGRLPERERFIVYMRFFRDKTQSDVARVLGISQVQVSRLEKRILQQIRQELE

SEQ ID NO: 1957 - DNA, 771 bp, Alicyclobacillus acidocaldarius
gtggatcaggcaaaggagcgtcccgttccacatcatgtggatgaatacgagaaactttccgacgaagaggtccgggagcttctggagcggagccacaacggcgacgcggaggcgagggagcgactcatcgtccataaccagcgcctcgtgtgggccgtggtccaacgatttctcgggcgcggttatgaagcggaagatctcttccaaatcgggtgcatcggcctgatgaaggccgtcgacaagttcgacctttcctacgacgtcaaattctcgacctacgccgtaccgatgatcatcggcgagatccagcggtttctgagggacgacagcacggtcaaagtaagccgaagtctcaaggagacggcgaagcagatccgccacgtgcgggatcggcttgccaaggagctcggccgccagccccatattaccgagatcgcggaggccatgggcatggagccgtcggaaatcgtgtttgcacaagaggcacttcgcgcgccggcgtccatccatgagacggtgtacgaaaacgatggcgatcccatctatctgatggatcaaatcgcggacgaggagaccgagggcaagtttgacaaggtggaactgcacgagattatcgggcgacttccagagcgcgagcgtttcatcgtgtacatgcggttcttccgcgataaaacgcagagcgacgtggcgcgcgtgctgggcatttctcaggtgcaggtgtcgcgattggaaaagcgaattcttcagcaaattcgccaggagcttgaatga

SEQ ID NO: 1958 - protein, 251 aa, Geobacillus thermodenitrificans NG80-2
MPMDVDVKQDQSPIKDQEMKELIRRSQEGDQEARDEIIEKNMRLVWSVVQRFLNRGYEADDLFQIGCIGLLKSVDKFDLSYDVKFSTYAVPMIIGEIQRFLRDDGTVKVSRSLKEMGNKIRKAKDELSKTRGRAPTITEIADHLGVSPEEVVLAQEAVRSPASIHETVYENDGDPITLLDQIADADEASWFEKIALKKAIEELDERERLIVYLRYYKDQTQSEVAARLGISQVQVSRLEKKILQHIKEKMD

SEQ ID NO: 1959 - protein, 238 aa, Geobacillus stearothermophilus
IKDQEMKELIRRSQEGDQEARDEIIEKNMRLVWSVVQRFLNRGYEADDLFQIGCIGLLKSVDKFDLSYDVKFSTYAVPMIIGEIQRFLRDDGTVKVSRSLKEMGNKIRKAKDELSKTRGRSPTITEIADHLGISPEDVVLAQEAVRLPTSIHETVYENDGDPITLLDQIADADEASWFDKIALKKAIEELDERERLIVYLRYYRDRTQSEVASRLGISQVQVSRLEKKILQHIKDKMD

SEQ ID NO: 1960 - protein, 238 aa, Geobacillus kaustophilus HTA426
IKDQEMKELIRRSQEGDQEARDEIIEKNMRLVWSVVQRFLNRGYEADDLFQIGCIGLLKSVDKFDLSYDVKFSTYAVPMIIGEIQRFLRDDGTVKVSRSLKEMGNKIRKAKDELSKTRGRAPTVTEIADHLGISPEDVVLAQEAVRSPTSIHETVYENDGDPITLLDQIADADEASWFDKIALKKAIEELDERERLIVYLRYYKDQTQSEVASRLGISQVQVSRLEKKILQHIKDKMD

SEQ ID NO: 1961 - protein, 241 aa, Bacillus Stearothermophilus A
HMQGQSPIKDQEMKELIRRSQEGDQEARDEIIEKNMRLVWSVVQRFLNRGYEADDLFQIGCIGLLKSVDKFDLSYDVKFSTYAVPMIIGEIQRFLRDDGTVKVSRSLKEMGNKIRKAKDELSKTRGRAPTVTEIADHLGISPEDVVLAQEAVRLPTSIHETVYENDGDPITLLDQIADADEASWFDKIALKKAIEELDERERLIVYLRYYKDQTQSEVASRLGISQVQMSRLEKKILQHIK

SEQ ID NO: 1962 - protein, 239 aa, Bacillus pumilus SAFR-032
QLSNDEVKELIKKSQDGDQQARDLLVEKNMRLVWSVVQRFLNRGYEPDDLFQIGCIGLLKSVDKFDLSYDVKFSTYAVPMIIGEIQRFIRDDGTVKVSRSLKELGNKIRRARDELSKSHGRMPTVQEIAEYLDITPEDVVLAQEAVRTPSSIHETVYENDGDPITLLDQIADHSEERWFDKIALKEAIKELEEREKLIVYLRYYKDQTQSEVAERLGISQVQVSRLEKKILKQIQMQMD

SEQ ID NO: 1963 - protein, 256 aa, Artificial
  Substituion in SEQ ID NO 1956
MDQAKERPVPHHVDEYEKLSDEEVRELLERSHNGDAEARERLIVHNQRLVWAVVQRFLGRGYEAEDLFQIGCIGLMKAVDKFDLSYDVKFSTYAVPMIIGEIQRFLRDDSTVKVSRSLKETAKQIRHVRDRLAKELGRQPHITEIAEAMGMEPSEIVFAQEALRAPASIHETVYENDGDPIYLMDQIADEETEGKFDKVELHEIIGRLPERERFIVYMRFFRDKTQSDVARVLGISQVQVSRLEKRILQQIRQEIE

SEQ ID NO: 1964 - protein, 256 aa, Artificial
  Substituion in SEQ ID NO 1956
MDQAKERPVPHHVDEYEKLSDEEVRELLERSHNGDAEARERLIVHNQRLVWAVVQRFLGRGYEAEDLFQIGCIGLMKAVDKFDLSYDVKFSTYAVPMIIGEIQRFLRDDSTVKVSRSLKETAKQIRHVRDRLAKELGRQPHITEIAEAMGMEPSEIVFAQEALRAPASIHETVYENDGDPIYLMDQIADEETEGKFDKVELHEIIGRLPERERFIVYMRFFKDKTQSDVARVLGISQVQVSRLEKRILQQIRQELE

SEQ ID NO: 1965 - protein, 256 aa, Artificial
  Substituion in SEQ ID NO 1956
MDQAKERPVPHHVDEYEKLSDEEVRELLERSHNGDAEARERLIVHNQRLVWAVVQRFLGRGYEAEDLFQIGCIGLMKAVDKFDLSYDVKFSTYAVPMIIGEIQRFLRDDSTVKVSRSLKETAKQIRHVRDRLAKELGRQPHITEIAEAMGMEPSEIVFAQEALRAPASIHETVYENDGDPIYLMDQIADEETEGKFDKVELHEIIGRLPERERFIVYMRFFRDKTQSDVARVLGISQVQVSRLEKRILQQIRQELD

SEQ ID NO: 1966 - protein, 256 aa, Artificial
  Substituion in SEQ ID NO 1956
MDQAKERPVPHHVDEYEKISDEEVRELLERSHNGDAEARERLIVHNQRLVWAVVQRFLGRGYEAEDLFQIGCIGLMKAVDKFDLSYDVKFSTYAVPMIIGEIQRFLRDDSTVKVSRSLKETAKQIRHVRDRLAKELGRQPHITEIAEAMGMEPSEIVFAQEALRAPASIHETVYENDGDPIYLMDQIADEETEGKFDKVELHEIIGRLPERERFIVYMRFFRDKTQSDVARVLGISQVQVSRLEKRILQQIRQELE

SEQ ID NO: 1967 - protein, 256 aa, Artificial
  Substituion in SEQ ID NO 1956
MDQAKERPVPHHVDEYEKLSDEEVRELLERSHNGDAEARERLIVHNQRLVWAVVQRFLGRGYEAEDLFQIGCIGLMKAVDKFDLSYDVKFSTYAVPMIIGEIQRFLRDDSTVKVSRSLKETAKQIRHVRDRLAKELGRQPHITEIAEAMGMEPSEIVFAQEALRAPASIHETVYENDGDPIYLMDQIADEETEGKFDKVELHDIIGRLPERERFIVYMRFFRDKTQSDVARVLGISQVQVSRLEKRILQQIRQELE

SEQ ID NO: 1968 - DNA, 771 bp, Artificial
  Substituion in SEQ ID NO 1957
gtggatcaggcaaaggagcgtcccgttccacatcatgtggatgaatacgagaaactttccgacgaagaggtccgggagcttctggagcggagccacaacggcgacgcggaggcgagggagcgactcatcgtccataaccagcgcctcgtgtgggccgtggtccaacgatttctcgggcgcggttatgaagcggaagatctcttccaaatcgggtgcatcggcctgatgaaggccgtcgacaagttcgacctttcctacgacgtcaaattctcgacctacgccgtaccgatgatcatcggcgagatccagcggtttctgagggacgacagcacggtcaaagtaagccgaagtctcaaggagacggcgaagcagatccgccacgtgcgggatcggcttgccaaggagctcggccgccagccccatattaccgagatcgcggaggccatgggcatggagccgtcggaaatcgtgtttgcacaagaggcacttcgcgcgccggcgtccatccatgagacggtgtacgaaaacgatggcgatcccatctatctgatggatcaaatcgcggacgaggagaccgagggcaagtttgacaaggtggaactgcacgagattatcgggcgacttccagagcgcgagcgtttcatcgtgtacatgcggttcttccgcgataaaacgcagagcgacgtggcgcgcgtgctgggcatttctcaggtgcaggtgtcgcgattggaaaagcgaattcttcagcaaattcgccaggagattgaatga

SEQ ID NO: 1969 - DNA, 771 bp, Artificial
  Substituion in SEQ ID NO 1957
gtggatcaggcaaaggagcgtcccgttccacatcatgtggatgaatacgagaaactttccgacgaagaggtccgggagcttctggagcggagccacaacggcgacgcggaggcgagggagcgactcatcgtccataaccagcgcctcgtgtgggccgtggtccaacgatttctcgggcgcggttatgaagcggaagatctcttccaaatcgggtgcatcggcctgatgaaggccgtcgacaagttcgacctttcctacgacgtcaaattctcgacctacgccgtaccgatgatcatcggcgagatccagcggtttctgagggacgacagcacggtcaaagtaagccgaagtctcaaggagacggcgaagcagatccgccacgtgcgggatcggcttgccaaggagctcggccgccagccccatattaccgagatcgcggaggccatgggcatggagccgtcggaaatcgtgtttgcacaagaggcacttcgcgcgccggcgtccatccatgagacggtgtacgaaaacgatggcgatcccatctatctgatggatcaaatcgcggacgaggagaccgagggcaagtttgacaaggtggaactgcacgagattatcgggcgacttccagagcgcgagcgtttcatcgtgtacatgcggttcttcaaagataaaacgcagagcgacgtggcgcgcgtgctgggcatttctcaggtgcaggtgtcgcgattggaaaagcgaattcttcagcaaattcgccaggagcttgaatga

SEQ ID NO: 1970 - DNA, 771 bp, Artificial
  Substituion in SEQ ID NO 1957
gtggatcaggcaaaggagcgtcccgttccacatcatgtggatgaatacgagaaactttccgacgaagaggtccgggagcttctggagcggagccacaacggcgacgcggaggcgagggagcgactcatcgtccataaccagcgcctcgtgtgggccgtggtccaacgatttctcgggcgcggttatgaagcggaagatctcttccaaatcgggtgcatcggcctgatgaaggccgtcgacaagttcgacctttcctacgacgtcaaattctcgacctacgccgtaccgatgatcatcggcgagatccagcggtttctgagggacgacagcacggtcaaagtaagccgaagtctcaaggagacggcgaagcagatccgccacgtgcgggatcggcttgccaaggagctcggccgccagccccatattaccgagatcgcggaggccatgggcatggagccgtcggaaatcgtgtttgcacaagaggcacttcgcgcgccggcgtccatccatgagacggtgtacgaaaacgatggcgatcccatctatctgatggatcaaatcgcggacgaggagaccgagggcaagtttgacaaggtggaactgcacgagattatcgggcgacttccagagcgcgagcgtttcatcgtgtacatgcggttcttccgcgataaaacgcagagcgacgtggcgcgcgtgctgggcatttctcaggtgcaggtgtcgcgattggaaaagcgaattcttcagcaaattcgccaggagcttgattga

SEQ ID NO: 1971 - DNA, 771 bp, Artificial
  Substituion in SEQ ID NO 1957
gtggatcaggcaaaggagcgtcccgttccacatcatgtggatgaatacgagaaaatttccgacgaagaggtccgggagcttctggagcggagccacaacggcgacgcggaggcgagggagcgactcatcgtccataaccagcgcctcgtgtgggccgtggtccaacgatttctcgggcgcggttatgaagcggaagatctcttccaaatcgggtgcatcggcctgatgaaggccgtcgacaagttcgacctttcctacgacgtcaaattctcgacctacgccgtaccgatgatcatcggcgagatccagcggtttctgagggacgacagcacggtcaaagtaagccgaagtctcaaggagacggcgaagcagatccgccacgtgcgggatcggcttgccaaggagctcggccgccagccccatattaccgagatcgcggaggccatgggcatggagccgtcggaaatcgtgtttgcacaagaggcacttcgcgcgccggcgtccatccatgagacggtgtacgaaaacgatggcgatcccatctatctgatggatcaaatcgcggacgaggagaccgagggcaagtttgacaaggtggaactgcacgagattatcgggcgacttccagagcgcgagcgtttcatcgtgtacatgcggttcttccgcgataaaacgcagagcgacgtggcgcgcgtgctgggcatttctcaggtgcaggtgtcgcgattggaaaagcgaattcttcagcaaattcgccaggagcttgaatga

SEQ ID NO: 1972 - DNA, 771 bp, Artificial
  Substituion in SEQ ID NO 1957
gtggatcaggcaaaggagcgtcccgttccacatcatgtggatgaatacgagaaactttccgacgaagaggtccgggagcttctggagcggagccacaacggcgacgcggaggcgagggagcgactcatcgtccataaccagcgcctcgtgtgggccgtggtccaacgatttctcgggcgcggttatgaagcggaagatctcttccaaatcgggtgcatcggcctgatgaaggccgtcgacaagttcgacctttcctacgacgtcaaattctcgacctacgccgtaccgatgatcatcggcgagatccagcggtttctgagggacgacagcacggtcaaagtaagccgaagtctcaaggagacggcgaagcagatccgccacgtgcgggatcggcttgccaaggagctcggccgccagccccatattaccgagatcgcggaggccatgggcatggagccgtcggaaatcgtgtttgcacaagaggcacttcgcgcgccggcgtccatccatgagacggtgtacgaaaacgatggcgatcccatctatctgatggatcaaatcgcggacgaggagaccgagggcaagtttgacaaggtggaactgcacgatattatcgggcgacttccagagcgcgagcgtttcatcgtgtacatgcggttcttccgcgataaaacgcagagcgacgtggcgcgcgtgctgggcatttctcaggtgcaggtgtcgcgattggaaaagcgaattcttcagcaaattcgccaggagcttgaatga

SEQ ID NO: 1973 - protein, 233 aa, Alicyclobacillus acidocaldarius
MAQTRILVVDDEERIRRLVRMYLERNGFEVDEAADGKEALHKALNQAYALIILDLMLPGMDGRDVCAQIRQHSNVPIMMLTAAGDEANRVHGFELGADDYVVKPFSPRELVLRVKAMLKRTGEMEYARNAIQTLTFPGLEIQIDARRVEVNGQEVNLTPKEFDLLVYMAQRPDKVFSREELLRDVWNYQFFGDQRTVDTHIKRLREKLGQASPEVSRYIVTVWGVGYKFEVAS

SEQ ID NO: 1974 - DNA, 702 bp, Alicyclobacillus acidocaldarius
atggcacaaacgcgaattttggtcgtggacgacgaggaacggattcgccgattggttcgcatgtacctcgagcgaaacgggtttgaagtggacgaggcggccgatggcaaagaagcactccacaaggccttgaatcaggcgtacgcattgatcatcctggatctcatgttgcctgggatggacggaagagacgtgtgcgcgcaaattcgccagcacagcaatgtgcccattatgatgctcacggcggcgggagacgaggcgaatcgcgtgcatgggttcgagctgggagcggatgattacgtggtgaagccgttcagcccacgcgaactcgtcctgcgcgtgaaggccatgctcaagcgcacgggtgaaatggagtatgcccgaaatgccattcaaaccctgacgtttcccggcttggagattcaaattgacgcgcgccgtgtcgaggtcaatgggcaagaagtcaatctgaccccgaaagagtttgaccttttggtctatatggcccaacgtcccgacaaggttttcagccgcgaagagcttctgagggatgtttggaattaccaattctttggggatcagcgcaccgtggatacccatatcaagcggttgcgcgaaaagttagggcaggcttctcccgaggtgagccgctatatcgtgaccgtctggggcgtcgggtacaagttcgaggtggcttcgtga

SEQ ID NO: 1975 - protein, 232 aa, Geobacillus kaustophilus HTA426
RILVVDDEERIRRLLKMYLERENYVIDEAGDGNEALEKALTNDYDVILLDLMLPGKDGIEVCKEIRAQKTTPIMMLTAKGEESNRVQGFEVGTDDYIVKPFSPREVVLRVKALLRRAANAAYAPVETTAKDVLVFPHLTIDNDAHRVTVDGKEVSLTPKEYELLLFLARSPDKVFDREQLLKEVWHYEFFGDLRTVDTHIKRLREKLNKASPQAGKMIVTVWGVGYKFEAVS

SEQ ID NO: 1976 - protein, 231 aa, Geobacillus thermodenitrificans NG80-2
ILVVDDEERIRRLLKMYLERENYVIDEAGDGNVALEKALANDYDVILLDLMLPGKDGIEVCKEIREHKTTPIIMLTAKGEESNRVQGFEVGTDDYIVKPFSPREVVLRVKALLRRAANATYAPVETTTKDVLVFPHLTIDNDAHRVTVDGKEVSLTPKEYELLLFLARSPDKVFDREQLLKEVWHYEFFGDLRTVDTHIKRLREKLNKASPQAGKMIVTVWGVGYKFEAVS

SEQ ID NO: 1977 - protein, 229 aa, Paenibacillus larvae subsp. larvae BRL-230010
ILVVDDEERIRRLLRMYLEKEGYDIEESQDGETALKLAMDKDYDLILLDIMLPGMDGTEVCARLRQFKTTPVIMLTAKGEETNRVHGFEVGADDYVVKPFSPREVIYRVKAILRRSSATAFLSKDSNSSNNIVFPHLVIEHDAHRVTAGGQEVALTPKEYELLHYLAVSPDKVFSREELLKDVWNYEFFGDLRTVDTHVKRLREKLNKVSPEAAVMITTVWGVGYKLEV

SEQ ID NO: 1978 - protein, 232 aa, Bacillus halodurans C-125
EAKILVVDDEDRIRNLLKMYLEREAYDVEEASDGKEALEKALAFDYDVILLDLMMPEMDGIEVCQKLRKQKATPIIMLTAKGEEANRVQGFEVGTDDYIVKPFSPREVVLRVKALLRRSSSTKFLQTDTQAKDVLVFPHLSIDNDAHRVTVADQEINLTPKEYELLYYLAQSPDKVFSREQLLKDVWNYDFFGDLRTVDTHIKRLREKLNRVSPQAASMISTVWGVGYKFEV

SEQ ID NO: 1979 - protein, 228 aa, Bacillus clausii KSM-K16
LLVVDDEERIRRLLRMYLEREEYQIEEASNGEEALELALAKEYDLILLDVMMPGMDGVEMCQELRKKKATPVMMLTAKGEEANRVQGFEVGADDYIVKPFSPREVVLRVKALLRRASATKFLQTDTQTKDVLVFGPLTIDNDAHRVTVDKTEISLTPKEYELLFYLAQSPDKVFSREQLLKDVWNYEFFGDLRTVDTHVKRLREKLNRVSPEVAAIISTVWGVGYKFE

SEQ ID NO: 1980 - protein, 233 aa, Artificial
  Substituion in SEQ ID NO 1973
MAQTRILVVDDEERIRRLVRMYLEKNGFEVDEAADGKEALHKALNQAYALIILDLMLPGMDGRDVCAQIRQHSNVPIMMLTAAGDEANRVHGFELGADDYVVKPFSPRELVLRVKAMLKRTGEMEYARNAIQTLTFPGLEIQIDARRVEVNGQEVNLTPKEFDLLVYMAQRPDKVFSREELLRDVWNYQFFGDQRTVDTHIKRLREKLGQASPEVSRYIVTVWGVGYKFEVAS

SEQ ID NO: 1981 - protein, 233 aa, Artificial
  Substituion in SEQ ID NO 1973
MAQTRILVVDDEERIRRLVRMYLERNGFEVDEAADGKEALHKALNQAYALIILDLMLPGMDGRDVCAQIRQHSNVPIMMLTAAGDEANRVHGFELGADDYVVKPFSPRELVLRVKAMLKRTGEMEYARNAIQTLTFPGLEIQIDARRVEVNGQEVNLTPKEFDLLVYMANRPDKVFSREELLRDVWNYQFFGDQRTVDTHIKRLREKLGQASPEVSRYIVTVWGVGYKFEVAS

SEQ ID NO: 1982 - protein, 233 aa, Artificial
  Substituion in SEQ ID NO 1973
MAQTRILVVDDEERIRRLVRMYLERNGFEVDEAADGKEALHKALNQAYALIILDLMLPGMDGRDVCAQIRNHSNVPIMMLTAAGDEANRVHGFELGADDYVVKPFSPRELVLRVKAMLKRTGEMEYARNAIQTLTFPGLEIQIDARRVEVNGQEVNLTPKEFDLLVYMAQRPDKVFSREELLRDVWNYQFFGDQRTVDTHIKRLREKLGQASPEVSRYIVTVWGVGYKFEVAS

SEQ ID NO: 1983 - protein, 233 aa, Artificial
  Substituion in SEQ ID NO 1973
MAQTRILVVDDEERIRRLVRMYLERNGFEVDEAADGKEALHKALNQAYALIILDLMLPGMDGRDVCAQIRQHSNVPIMMLTAAGDEANRVHGFELGADDYVVKPFSPRELVLRVKAMLKRTGEMEYARQAIQTLTFPGLEIQIDARRVEVNGQEVNLTPKEFDLLVYMAQRPDKVFSREELLRDVWNYQFFGDQRTVDTHIKRLREKLGQASPEVSRYIVTVWGVGYKFEVAS

SEQ ID NO: 1984 - protein, 233 aa, Artificial
  Substituion in SEQ ID NO 1973
MAQTRILVVDDEERIRRLVRMYLERNGFEVDEAADGKEALHKALNQAYALIILDLMLPGMDGRDVCAQIRQHSNVPIMMLTAAGDEANRVHGFELGADDYVVKPFSPRELVLRVKAMLKRTGEMEYARNALQTLTFPGLEIQIDARRVEVNGQEVNLTPKEFDLLVYMAQRPDKVFSREELLRDVWNYQFFGDQRTVDTHIKRLREKLGQASPEVSRYIVTVWGVGYKFEVAS

SEQ ID NO: 1985 - DNA, 702 bp, Artificial
  Substituion in SEQ ID NO 1974
atggcacaaacgcgaattttggtcgtggacgacgaggaacggattcgccgattggttcgcatgtacctcgagaaaaacgggtttgaagtggacgaggcggccgatggcaaagaagcactccacaaggccttgaatcaggcgtacgcattgatcatcctggatctcatgttgcctgggatggacggaagagacgtgtgcgcgcaaattcgccagcacagcaatgtgcccattatgatgctcacggcggcgggagacgaggcgaatcgcgtgcatgggttcgagctgggagcggatgattacgtggtgaagccgttcagcccacgcgaactcgtcctgcgcgtgaaggccatgctcaagcgcacgggtgaaatggagtatgcccgaaatgccattcaaaccctgacgtttcccggcttggagattcaaattgacgcgcgccgtgtcgaggtcaatgggcaagaagtcaatctgaccccgaaagagtttgaccttttggtctatatggcccaacgtcccgacaaggttttcagccgcgaagagcttctgagggatgtttggaattaccaattctttggggatcagcgcaccgtggatacccatatcaagcggttgcgcgaaaagttagggcaggcttctcccgaggtgagccgctatatcgtgaccgtctggggcgtcgggtacaagttcgaggtggcttcgtga

SEQ ID NO: 1986 - DNA, 702 bp, Artificial
  Substituion in SEQ ID NO 1974
atggcacaaacgcgaattttggtcgtggacgacgaggaacggattcgccgattggttcgcatgtacctcgagcgaaacgggtttgaagtggacgaggcggccgatggcaaagaagcactccacaaggccttgaatcaggcgtacgcattgatcatcctggatctcatgttgcctgggatggacggaagagacgtgtgcgcgcaaattcgccagcacagcaatgtgcccattatgatgctcacggcggcgggagacgaggcgaatcgcgtgcatgggttcgagctgggagcggatgattacgtggtgaagccgttcagcccacgcgaactcgtcctgcgcgtgaaggccatgctcaagcgcacgggtgaaatggagtatgcccgaaatgccattcaaaccctgacgtttcccggcttggagattcaaattgacgcgcgccgtgtcgaggtcaatgggcaagaagtcaatctgaccccgaaagagtttgaccttttggtctatatggccaatcgtcccgacaaggttttcagccgcgaagagcttctgagggatgtttggaattaccaattctttggggatcagcgcaccgtggatacccatatcaagcggttgcgcgaaaagttagggcaggcttctcccgaggtgagccgctatatcgtgaccgtctggggcgtcgggtacaagttcgaggtggcttcgtga

SEQ ID NO: 1987 - DNA, 702 bp, Artificial
  Substituion in SEQ ID NO 1974
atggcacaaacgcgaattttggtcgtggacgacgaggaacggattcgccgattggttcgcatgtacctcgagcgaaacgggtttgaagtggacgaggcggccgatggcaaagaagcactccacaaggccttgaatcaggcgtacgcattgatcatcctggatctcatgttgcctgggatggacggaagagacgtgtgcgcgcaaattcgcaatcacagcaatgtgcccattatgatgctcacggcggcgggagacgaggcgaatcgcgtgcatgggttcgagctgggagcggatgattacgtggtgaagccgttcagcccacgcgaactcgtcctgcgcgtgaaggccatgctcaagcgcacgggtgaaatggagtatgcccgaaatgccattcaaaccctgacgtttcccggcttggagattcaaattgacgcgcgccgtgtcgaggtcaatgggcaagaagtcaatctgaccccgaaagagtttgaccttttggtctatatggcccaacgtcccgacaaggttttcagccgcgaagagcttctgagggatgtttggaattaccaattctttggggatcagcgcaccgtggatacccatatcaagcggttgcgcgaaaagttagggcaggcttctcccgaggtgagccgctatatcgtgaccgtctggggcgtcgggtacaagttcgaggtggcttcgtga

SEQ ID NO: 1988 - DNA, 702 bp, Artificial
  Substituion in SEQ ID NO 1974
atggcacaaacgcgaattttggtcgtggacgacgaggaacggattcgccgattggttcgcatgtacctcgagcgaaacgggtttgaagtggacgaggcggccgatggcaaagaagcactccacaaggccttgaatcaggcgtacgcattgatcatcctggatctcatgttgcctgggatggacggaagagacgtgtgcgcgcaaattcgccagcacagcaatgtgcccattatgatgctcacggcggcgggagacgaggcgaatcgcgtgcatgggttcgagctgggagcggatgattacgtggtgaagccgttcagcccacgcgaactcgtcctgcgcgtgaaggccatgctcaagcgcacgggtgaaatggagtatgcccgacaagccattcaaaccctgacgtttcccggcttggagattcaaattgacgcgcgccgtgtcgaggtcaatgggcaagaagtcaatctgaccccgaaagagtttgaccttttggtctatatggcccaacgtcccgacaaggttttcagccgcgaagagcttctgagggatgtttggaattaccaattctttggggatcagcgcaccgtggatacccatatcaagcggttgcgcgaaaagttagggcaggcttctcccgaggtgagccgctatatcgtgaccgtctggggcgtcgggtacaagttcgaggtggcttcgtga

SEQ ID NO: 1989 - DNA, 702 bp, Artificial
  Substituion in SEQ ID NO 1974
atggcacaaacgcgaattttggtcgtggacgacgaggaacggattcgccgattggttcgcatgtacctcgagcgaaacgggtttgaagtggacgaggcggccgatggcaaagaagcactccacaaggccttgaatcaggcgtacgcattgatcatcctggatctcatgttgcctgggatggacggaagagacgtgtgcgcgcaaattcgccagcacagcaatgtgcccattatgatgctcacggcggcgggagacgaggcgaatcgcgtgcatgggttcgagctgggagcggatgattacgtggtgaagccgttcagcccacgcgaactcgtcctgcgcgtgaaggccatgctcaagcgcacgggtgaaatggagtatgcccgaaatgccttacaaaccctgacgtttcccggcttggagattcaaattgacgcgcgccgtgtcgaggtcaatgggcaagaagtcaatctgaccccgaaagagtttgaccttttggtctatatggcccaacgtcccgacaaggttttcagccgcgaagagcttctgagggatgtttggaattaccaattctttggggatcagcgcaccgtggatacccatatcaagcggttgcgcgaaaagttagggcaggcttctcccgaggtgagccgctatatcgtgaccgtctggggcgtcgggtacaagttcgaggtggcttcgtga

SEQ ID NO: 1990 - protein, 590 aa, Alicyclobacillus acidocaldarius
MIPNSIVAKMWLTIVGMVFVIQALLSVLLQQVFNKYIVTREEASLTQLALTIESVLATATDRSIKEQVASDIAKRVERATVVYGIPYTANAALKAAYDAMTPAERQALSRGQPVTLRGALGKVNRLTVYVQIPSARSPQPGMLAVSQDTSVLDEPLREIRNMVLFDTVLGVILATGFAFVISKNLSRPLVDMTRAAEEMARGHYRQRVRVVTKDEVGRLGHTFNALARQLAETIEQLSMEREGLQRILSSLQDGVVATDLDGRVVLANPPAKRHLRHLSVAERGIVDEERLPDRLMSLWVRVREQQDAVYREDTWDGRTIGITMLPLYETDGTTLRGALCVLRDITEERRLDRLRKDFIANVSHELRTPLSMLQGYTEALLDDISDDPDMRRELTEIIHDETLRMKRLVNDLLNLAQLESGQFKLHFARVDLTQVMRRVARKFQALASDEDHLTFEVSIPDHPVMVDGDEDRLEQVFTNLLDNAFRHTAQGTIRFELDIRHDYAYVRVADTGSGIPEEDVPYIFERFYKADKARTRSRSGTGLGLAIARQLVIEHRGEILVESHLGEGTTFTVVLPLASPNDHGEGESVS

SEQ ID NO: 1991 - DNA, 1773 bp, Alicyclobacillus acidocaldarius
gtgatacccaacagcatcgtagccaagatgtggctgacgattgtcggcatggtgttcgtcattcaagcgctcctgtccgtcttgctccagcaagtctttaacaagtacattgtcactcgcgaagaagcgagcctcacccagctcgctttgaccatcgagtcggtgctcgcgacggcaaccgaccgatccatcaaagagcaagtggcaagtgatatcgccaagcgcgttgagcgtgcaactgtggtgtacgggatcccgtacaccgccaatgcggcattgaaggcagcctatgacgcgatgacgcctgcagagaggcaggctttgtcgcgcggtcagccggtcacgctgcgcggggctttgggcaaggtcaatcggctcaccgtgtacgtgcagatcccctctgccagatcgccacagcccggcatgttggcggtgtcacaggacacgagcgtgctggacgagcctttgcgggagatccgcaacatggtgctctttgatacggtactcggcgtgattctggcgacgggctttgcctttgtgatctcgaaaaacctgtctcgtccgctggtcgatatgacgcgagccgctgaggagatggcgcgcggccactatcgtcagcgcgttcgtgtggtgacgaaggacgaggtcggccggctcgggcacaccttcaacgcgctcgcgcgtcagttggcagagaccatcgagcagctttcgatggagcgagaaggcctgcagcggattctgtcgtcgctgcaagacggcgtggtggcgactgatctcgacggccgcgtcgtgttggccaatcctcctgcgaagcgccatttgcgccacctctcggtggcggagcgagggatcgtcgatgaggagagactccccgatcgtctcatgagcctatgggtgcgcgtgcgcgaacagcaggatgccgtgtaccgcgaggacacctgggacggccgcaccatcggcattacgatgctccctctctatgagacggacggtacgacgttgcgcggcgcactctgtgtcctccgcgacatcaccgaggagaggcggctggatcgcctccgcaaggacttcatcgcgaacgtctcgcatgaactgaggacgcctctcagcatgttgcagggatacacggaggcgcttctggacgacatctcggatgatcccgacatgcgccgagagctgaccgagattattcacgatgaaacgctgcgcatgaagcgcctcgtcaatgatctcctcaacctcgcgcagctggaaagcggacaattcaagctccacttcgcccgcgtcgatctcacgcaggtcatgcgacgcgtggcgcgcaaatttcaggcgcttgcgagcgacgaggaccatctgacgttcgaagtctccatcccggatcatccagtcatggtcgacggcgacgaggatcgcctggagcaggtcttcacgaatctgctcgacaatgcatttcggcatacggcacagggtaccattcgttttgaactggatattcgccacgactatgcctacgtgcgcgtggccgatacaggcagcggcataccggaagaggatgtgccctacattttcgagcgcttctacaaggctgacaaagcccgcacgcggtcgcggtctggaaccggcctcggtttggccatcgcccgccaactggtgattgagcatcgcggcgagatccttgtggaaagccacctcggagaaggcacgacgttcacggtggtcttgccacttgcttctccgaacgatcacggcgaaggagagagcgtctcatga

SEQ ID NO: 1992 - protein, 589 aa, Geobacillus kaustophilus HTA426
SVVGKLWFTILLLVSCVLFILSILLIKFLEDYYVQEAENDLTRLATKVAEVMHDYRDEQLARSIAWTLVDNRTKAVIVADESHYWYSPGDAGLDNMPLSSIRQDRDLRRVLTDGKTMKKRLYMPERHPKEKLPRDMIIVGVPMSMPDGSRGAVFIYQSLEAIADATERTKELIFLAAFIAIVMTTFFAFFLSTRITAPLRKMRQAAFEMARGHFDMKVPILTNDEIGGLAMAFNQMGRRLQFNINALNQEKEQLASILSSMADGVITFNRDGEILITNPPAERFLQAWYFEQGNDAEAMAPLPPQVKELFARVVREEKEQSTEVTLQGRTWVILMTPLYGKTMVRGAVAVLRDMTEERRLDKLRKDFIANVSHELRTPIAMLQGYSEAIIDDIAASEKEKKEMAKVIYDESLRMGRLVNDLLDLARMEAGHIELEYEQVKLVPYIERVIRKFYGLAKEKQIELTAEFRDRDIEIALDPDRIEQVLTNLIDNAIRHTESGGTVRLIIEPSGDGVTIHVQDSGSGIPEEDLPFVFERFYKADKARTRGRSGTGLGLAIAKNIVEAHKGLITVHSKLNEGTTFSFYLPARGP

SEQ ID NO: 1993 - protein, 591 aa, Geobacillus thermodenitrificans NG80-2
SVVGKLWFTILLLVSCVLFILTILLIKFFEEYYVQEAENDLTRLATKVAEVMHDYRDEQLARSIAWTLVDNRSKAIIVADESHYWYSPGEADLKDMPLSSIREDSDLRRVLTDQETVKKRLYATEWEQNGKPQHDMIIVGVPMSMPDGSRGAVFIYQSLEAIADATEHTKELIFLAAFIAIVMTTFFAFFLSTRITAPLRKMRQAAFEVARGHFDTKVPILTNDEIGGLAMAFNQMGRRLQFNINALNQEKEQLASILSSMADGVITFSREGEILITNPPAERFLQAWYFEQGNDAETMAPLPPQVKELFARVVREEKEQSTEVTIQGRTWVILMTPLYGKTMVRGAVAVLRDMTEERRLDKLRKDFIANVSHELRTPIAMLQGYSEAIIDDIAASEEEKKEMAKVIYDESLRMGRLVNDLLDLARMEAGHIELQYEQVELVPYVERVIRKFYGLAKEKQIELTAEFRDENIEIAFDPDRIEQVLTNLIDNAIRHTEAGGTVRLIIERSGDGVTIHVQDSGSGIPEEDLPFVFERFYKADKARTRGRSGTGLGLAIAKNIVETHKGRITVHSKLNEGTTFSFYLPAHGPKE

SEQ ID NO: 1994 - protein, 585 aa, Bacillus licheniformis ATCC 14580
SVVGKLWFTILLLVSFVLFILTFFLLEFIENYHVDEAEADLTKLASKVAVIMENHKDQETARSITWELADELTSIAVIKNENEYWYSPREHQKVASITLKDIKNDPDLNEALRKHQKVQKRTVISNQKNDQLIVGVPYGKGEDEGMVFLSQSLLAVKDTTQHTTRYILFAAAIAIVLTTIFAFFLSSRITYPLRKMRQGAQDLAKGKFDTKIPILTQDEIGELAIAFNQMGRQLKFHITALNQEKEHLSNILSSMADGVITINIDGTILVTNPPAERFLQAWYYEQNMNVKEGHELPPEARELFQNTVSTEKEQMIEMTLQGRTWVLLMSPLYNQSHVRGAVAVLRDMTEERRLDKLRKDFIANVSHELRTPISMLQGYSEAIVDDIASSEEEKKEIAQVIYDESLRMGRLVNDLLDLARMEAGHISLNVEPVELREFFERVFRKFYGVAGDKNITLSHNLDLHEAKFVFDPDKMEQVLTNLIDNAIRHTNAGGTVHVDVQSAESGLKIAVKDSGSGIPEEDLPFIFERFYKADKARTRGKGGTGLGLAIVKNIVDAHNGSITVHSMLNEGTSFTFYIPRNKQDD

SEQ ID NO: 1995 - protein, 581 aa, Bacillus subtilis subsp. subtilis str. 168
SVVGKLWFTILSLVLIVLFILTVLLLEFIENYHVEEAENDLTQLANKVAVILENHEDQALARSITWELADNLTSIAIIQDEKNHWYSPNDKNRLSSITVEQIQHDKDLNKALKDHKKVSKRTGLSDTDTDNERLIVGVPYEKDGKKGMVFLSQSLLAVKDTTKHTTRYIFLAAGIAIVLTTFFAFFLSSRVTYPLRKMREGAQDLAKGKFDTKIPILTQDEIGELATAFNQMGRQLNFHINALNQEKEQLSNILSSMADGVITINIDGTILVTNPPAERFLQAWYYEQNMNIKEGDNLPPEAKELFQNAVSTEKEQMIEMTLQGRSWVLLMSPLYAESHVRGAVAVLRDMTEERRLDKLREDFIANVSHELRTPISMLQGYSEAIVDDIASSEEDRKEIAQIIYDESLRMGRLVNDLLDLARMESGHTGLHYEKINVNEFLEKIIRKFSGVAKEKNIALDHDISLTEEEFMFDEDKMEQVFTNLIDNALRHTSAGGSVSISVHSVKDGLKIDIKDSGSGIPEEDLPFIFERFYKADKARTRGRAGTGLGLAIVKNIVEAHNGSITVHSRIDKGTTFSFYIP

SEQ ID NO: 1996 - protein, 581 aa, Bacillus pumilus SAFR-032
SVVGKLWLTILFLVLIVLSILTVLLLEFIENYHVEEAKSDLTQMANKVAVILESHDDQSLARSITSELADKLTSIAIIQEDGLEWYSSEKDGKLPAITKKQIEADSDLNQALKDRKKISKRAEPNAGNHKDERIVVGVPFEANGKKGMVFLSQSLLAVEQTTKHTTRYIFLAAGIAIVLTTIFAFFLSTRVTYPLRKMKEGAQDLAKGKFDTKIPILTQDEIGELAIAFNQMGKQLTFHITALNQEKEHLSNILSSMADGVITINIDGTILMTNPPAERFLQAWYYEQNMKIKDGDELPPEARELFHTAVSTEKEQMIEVTLQGRTWVLLMSPLYNQQDVRGAVAVLRDMTEERRLDKLRKDFIANVSHELRTPIAMLQGYSEAIIDDIAGSEEEKKEIAQIIYDESLRMGRLVNDLLDLARMEAGHITLNLESTDTEELTEKIYRKFLGIAKEKQVDLTYDIQVDEPHFVLDPDKMEQVFTNLIDNAIRHTPEGGEVHFSVQSVESGLKMDVKDSGSGIPEEDLPFIFERFYKADKARTRGRSGTGLGLAIVKNIVEAHQGSIHAHSKAGTGTHFTFYIP

SEQ ID NO: 1997 - protein, 590 aa, Artificial
  Substituion in SEQ ID NO 1990
MIPNSIVAKMWLTIVGMVFVIQALLSVLLQQVFNKYIVTREEASLTQLALTIESVLATATDRSIKEQVASDIAKRVERATVVYGIPYTANAALKAAYDAMTPAERQALSRGQPVTLRGALGKVNRLTVYVQIPSARSPQPGMLAVSQDTSVLDEPLREIRNMVLFDTVLGVILATGFAFVISKNLSRPLVDMTRAAEEMARGHYRQRVRVVTKDEVGRLGHTFNALARQLAETIEQLSMEREGLQRILSSLQDGVVATDLDGRVVLANPPAKRHLRHLSVAERGIVDEERLPDRLMSLWVRVREQQDAVYREDTWDGRTIGITMLPLYETDGTTLRGALCVLRDITEERRLDRLRKDFIANVSHELRTPLSMLQGYTEALLDDISDDPDMRRELTEIIHDETLRMKRLVNDLLNLAQLESGQFKLHFARVDLTQVMRRVARKFQALASDEDHLTFEVSIPDHPVMVDGDEDRLEQVFTNLLDNAFRHTAQGTIRFELDIRHDYAYVRVADTGSGIPEEDVPYIFERFYKADKARTRSRSGTGLGLAIARQLVIEHRGEILVESHLGEGTTFTVVLPLASPNDHGEGESIS

SEQ ID NO: 1998 - protein, 590 aa, Artificial
  Substituion in SEQ ID NO 1990
MIPNSIVAKMWLTIVGMVFVIQALLSVLLQQVFNKYIVTREEASLTQLALTIESVLATATDRSIKEQVASDIAKRVERATVVYGIPYTANAALKAAYDAMTPAERQALSRGQPVTLRGALGKVNRLTVYVQIPSARSPQPGMLAVSQDTSVLDEPLREIRNMVLFDTVLGVILATGFAFVISKNLSRPLVDMTRAAEEMARGHYRQRVRVVTKDEVGRLGHTFNALARQLAETIEQLSMEREGLQRILSSLQDGVVATDLDGRVVLANPPAKRHLRHLSVAERGIVDEERLPDRLMSLWVRVREQQDAVYREDTWDGRTIGITMLPLYETDGTTLRGALCVLRDITEERRLDRLRKDFIANVSHELRTPLSMLQGYTEALLDDISDDPDMRRELTEIIHDETLRMKRLVNDLLNLAQLESGQFKLHFARVDLTQVMRRVARKFQALASDEDHLTFEISIPDHPVMVDGDEDRLEQVFTNLLDNAFRHTAQGTIRFELDIRHDYAYVRVADTGSGIPEEDVPYIFERFYKADKARTRSRSGTGLGLAIARQLVIEHRGEILVESHLGEGTTFTVVLPLASPNDHGEGESVS

SEQ ID NO: 1999 - protein, 590 aa, Artificial
  Substituion in SEQ ID NO 1990
MIPNSIVAKMWLTIVGMVFVIQALLSVLLQQVFNKYIVTREEASLTQLALTIESVLATATDRSIKEQVASDIAKRVERATVVYGIPYTANAALKAAYDAMTPAERQALSRGQPVTLRGALGKVNRLTVYVQIPSARSPQPGMLAVSQDTSVLDEPLREIRNMVLFDTVLGVILATGFAFVISKNLSRPLVDMTRAAEEMARGHYRQRVRVVTKDEVGRLGHTFNALARQLAETIEQLSMEREGLQRILSSLQDGVVATDLDGRVILANPPAKRHLRHLSVAERGIVDEERLPDRLMSLWVRVREQQDAVYREDTWDGRTIGITMLPLYETDGTTLRGALCVLRDITEERRLDRLRKDFIANVSHELRTPLSMLQGYTEALLDDISDDPDMRRELTEIIHDETLRMKRLVNDLLNLAQLESGQFKLHFARVDLTQVMRRVARKFQALASDEDHLTFEVSIPDHPVMVDGDEDRLEQVFTNLLDNAFRHTAQGTIRFELDIRHDYAYVRVADTGSGIPEEDVPYIFERFYKADKARTRSRSGTGLGLAIARQLVIEHRGEILVESHLGEGTTFTVVLPLASPNDHGEGESVS

SEQ ID NO: 2000 - protein, 590 aa, Artificial
  Substituion in SEQ ID NO 1990
MIPNSIVAKMWLTIVGMVFVIQALLSVLLQQVFNKYIVTREEASLTQLALTIESVLATATDRSIKEQVASDIAKRVERATVVYGIPYTANAALKAAYDAMTPAERQALSRGQPVTLRGALGKVNRLTVYVQIPSARSPQPGMLAVSQDTSVLDEPLREIRNMVLFDTVLGVILATGFAFVISKNLSRPLVDMTRAAEEMARGHYRQRVRVVTKDEVGRLGHTFNALARQLAETIEQLSMEREGLQRILSSLQDGVVATDLDGRVVLANPPAKRHLRHLSVAERGIVDEERLPDRLMSLWVRVREQQDAVYREDTWDGRTIGITMLPLYETDGTTLRGALCVLRDITEERRLDRLRKDFIANVSHELRTPLSMLQGYTEAILDDISDDPDMRRELTEIIHDETLRMKRLVNDLLNLAQLESGQFKLHFARVDLTQVMRRVARKFQALASDEDHLTFEVSIPDHPVMVDGDEDRLEQVFTNLLDNAFRHTAQGTIRFELDIRHDYAYVRVADTGSGIPEEDVPYIFERFYKADKARTRSRSGTGLGLAIARQLVIEHRGEILVESHLGEGTTFTVVLPLASPNDHGEGESVS

SEQ ID NO: 2001 - protein, 590 aa, Artificial
  Substituion in SEQ ID NO 1990
MIPNSIVAKMWLTIVGMVFVIQALLSVLLQQIFNKYIVTREEASLTQLALTIESVLATATDRSIKEQVASDIAKRVERATVVYGIPYTANAALKAAYDAMTPAERQALSRGQPVTLRGALGKVNRLTVYVQIPSARSPQPGMLAVSQDTSVLDEPLREIRNMVLFDTVLGVILATGFAFVISKNLSRPLVDMTRAAEEMARGHYRQRVRVVTKDEVGRLGHTFNALARQLAETIEQLSMEREGLQRILSSLQDGVVATDLDGRVVLANPPAKRHLRHLSVAERGIVDEERLPDRLMSLWVRVREQQDAVYREDTWDGRTIGITMLPLYETDGTTLRGALCVLRDITEERRLDRLRKDFIANVSHELRTPLSMLQGYTEALLDDISDDPDMRRELTEIIHDETLRMKRLVNDLLNLAQLESGQFKLHFARVDLTQVMRRVARKFQALASDEDHLTFEVSIPDHPVMVDGDEDRLEQVFTNLLDNAFRHTAQGTIRFELDIRHDYAYVRVADTGSGIPEEDVPYIFERFYKADKARTRSRSGTGLGLAIARQLVIEHRGEILVESHLGEGTTFTVVLPLASPNDHGEGESVS

SEQ ID NO: 2002 - DNA, 1773 bp, Artificial
  Substituion in SEQ ID NO 1991
gtgatacccaacagcatcgtagccaagatgtggctgacgattgtcggcatggtgttcgtcattcaagcgctcctgtccgtcttgctccagcaagtctttaacaagtacattgtcactcgcgaagaagcgagcctcacccagctcgctttgaccatcgagtcggtgctcgcgacggcaaccgaccgatccatcaaagagcaagtggcaagtgatatcgccaagcgcgttgagcgtgcaactgtggtgtacgggatcccgtacaccgccaatgcggcattgaaggcagcctatgacgcgatgacgcctgcagagaggcaggctttgtcgcgcggtcagccggtcacgctgcgcggggctttgggcaaggtcaatcggctcaccgtgtacgtgcagatcccctctgccagatcgccacagcccggcatgttggcggtgtcacaggacacgagcgtgctggacgagcctttgcgggagatccgcaacatggtgctctttgatacggtactcggcgtgattctggcgacgggctttgcctttgtgatctcgaaaaacctgtctcgtccgctggtcgatatgacgcgagccgctgaggagatggcgcgcggccactatcgtcagcgcgttcgtgtggtgacgaaggacgaggtcggccggctcgggcacaccttcaacgcgctcgcgcgtcagttggcagagaccatcgagcagctttcgatggagcgagaaggcctgcagcggattctgtcgtcgctgcaagacggcgtggtggcgactgatctcgacggccgcgtcgtgttggccaatcctcctgcgaagcgccatttgcgccacctctcggtggcggagcgagggatcgtcgatgaggagagactccccgatcgtctcatgagcctatgggtgcgcgtgcgcgaacagcaggatgccgtgtaccgcgaggacacctgggacggccgcaccatcggcattacgatgctccctctctatgagacggacggtacgacgttgcgcggcgcactctgtgtcctccgcgacatcaccgaggagaggcggctggatcgcctccgcaaggacttcatcgcgaacgtctcgcatgaactgaggacgcctctcagcatgttgcagggatacacggaggcgcttctggacgacatctcggatgatcccgacatgcgccgagagctgaccgagattattcacgatgaaacgctgcgcatgaagcgcctcgtcaatgatctcctcaacctcgcgcagctggaaagcggacaattcaagctccacttcgcccgcgtcgatctcacgcaggtcatgcgacgcgtggcgcgcaaatttcaggcgcttgcgagcgacgaggaccatctgacgttcgaagtctccatcccggatcatccagtcatggtcgacggcgacgaggatcgcctggagcaggtcttcacgaatctgctcgacaatgcatttcggcatacggcacagggtaccattcgttttgaactggatattcgccacgactatgcctacgtgcgcgtggccgatacaggcagcggcataccggaagaggatgtgccctacattttcgagcgcttctacaaggctgacaaagcccgcacgcggtcgcggtctggaaccggcctcggtttggccatcgcccgccaactggtgattgagcatcgcggcgagatccttgtggaaagccacctcggagaaggcacgacgttcacggtggtcttgccacttgcttctccgaacgatcacggcgaaggagagagcatttcatga

SEQ ID NO: 2003 - DNA, 1773 bp, Artificial
  Substituion in SEQ ID NO 1991
gtgatacccaacagcatcgtagccaagatgtggctgacgattgtcggcatggtgttcgtcattcaagcgctcctgtccgtcttgctccagcaagtctttaacaagtacattgtcactcgcgaagaagcgagcctcacccagctcgctttgaccatcgagtcggtgctcgcgacggcaaccgaccgatccatcaaagagcaagtggcaagtgatatcgccaagcgcgttgagcgtgcaactgtggtgtacgggatcccgtacaccgccaatgcggcattgaaggcagcctatgacgcgatgacgcctgcagagaggcaggctttgtcgcgcggtcagccggtcacgctgcgcggggctttgggcaaggtcaatcggctcaccgtgtacgtgcagatcccctctgccagatcgccacagcccggcatgttggcggtgtcacaggacacgagcgtgctggacgagcctttgcgggagatccgcaacatggtgctctttgatacggtactcggcgtgattctggcgacgggctttgcctttgtgatctcgaaaaacctgtctcgtccgctggtcgatatgacgcgagccgctgaggagatggcgcgcggccactatcgtcagcgcgttcgtgtggtgacgaaggacgaggtcggccggctcgggcacaccttcaacgcgctcgcgcgtcagttggcagagaccatcgagcagctttcgatggagcgagaaggcctgcagcggattctgtcgtcgctgcaagacggcgtggtggcgactgatctcgacggccgcgtcgtgttggccaatcctcctgcgaagcgccatttgcgccacctctcggtggcggagcgagggatcgtcgatgaggagagactccccgatcgtctcatgagcctatgggtgcgcgtgcgcgaacagcaggatgccgtgtaccgcgaggacacctgggacggccgcaccatcggcattacgatgctccctctctatgagacggacggtacgacgttgcgcggcgcactctgtgtcctccgcgacatcaccgaggagaggcggctggatcgcctccgcaaggacttcatcgcgaacgtctcgcatgaactgaggacgcctctcagcatgttgcagggatacacggaggcgcttctggacgacatctcggatgatcccgacatgcgccgagagctgaccgagattattcacgatgaaacgctgcgcatgaagcgcctcgtcaatgatctcctcaacctcgcgcagctggaaagcggacaattcaagctccacttcgcccgcgtcgatctcacgcaggtcatgcgacgcgtggcgcgcaaatttcaggcgcttgcgagcgacgaggaccatctgacgttcgaaatttccatcccggatcatccagtcatggtcgacggcgacgaggatcgcctggagcaggtcttcacgaatctgctcgacaatgcatttcggcatacggcacagggtaccattcgttttgaactggatattcgccacgactatgcctacgtgcgcgtggccgatacaggcagcggcataccggaagaggatgtgccctacattttcgagcgcttctacaaggctgacaaagcccgcacgcggtcgcggtctggaaccggcctcggtttggccatcgcccgccaactggtgattgagcatcgcggcgagatccttgtggaaagccacctcggagaaggcacgacgttcacggtggtcttgccacttgcttctccgaacgatcacggcgaaggagagagcgtctcatga

SEQ ID NO: 2004 - DNA, 1773 bp, Artificial
  Substituion in SEQ ID NO 1991
gtgatacccaacagcatcgtagccaagatgtggctgacgattgtcggcatggtgttcgtcattcaagcgctcctgtccgtcttgctccagcaagtctttaacaagtacattgtcactcgcgaagaagcgagcctcacccagctcgctttgaccatcgagtcggtgctcgcgacggcaaccgaccgatccatcaaagagcaagtggcaagtgatatcgccaagcgcgttgagcgtgcaactgtggtgtacgggatcccgtacaccgccaatgcggcattgaaggcagcctatgacgcgatgacgcctgcagagaggcaggctttgtcgcgcggtcagccggtcacgctgcgcggggctttgggcaaggtcaatcggctcaccgtgtacgtgcagatcccctctgccagatcgccacagcccggcatgttggcggtgtcacaggacacgagcgtgctggacgagcctttgcgggagatccgcaacatggtgctctttgatacggtactcggcgtgattctggcgacgggctttgcctttgtgatctcgaaaaacctgtctcgtccgctggtcgatatgacgcgagccgctgaggagatggcgcgcggccactatcgtcagcgcgttcgtgtggtgacgaaggacgaggtcggccggctcgggcacaccttcaacgcgctcgcgcgtcagttggcagagaccatcgagcagctttcgatggagcgagaaggcctgcagcggattctgtcgtcgctgcaagacggcgtggtggcgactgatctcgacggccgcgtcattttggccaatcctcctgcgaagcgccatttgcgccacctctcggtggcggagcgagggatcgtcgatgaggagagactccccgatcgtctcatgagcctatgggtgcgcgtgcgcgaacagcaggatgccgtgtaccgcgaggacacctgggacggccgcaccatcggcattacgatgctccctctctatgagacggacggtacgacgttgcgcggcgcactctgtgtcctccgcgacatcaccgaggagaggcggctggatcgcctccgcaaggacttcatcgcgaacgtctcgcatgaactgaggacgcctctcagcatgttgcagggatacacggaggcgcttctggacgacatctcggatgatcccgacatgcgccgagagctgaccgagattattcacgatgaaacgctgcgcatgaagcgcctcgtcaatgatctcctcaacctcgcgcagctggaaagcggacaattcaagctccacttcgcccgcgtcgatctcacgcaggtcatgcgacgcgtggcgcgcaaatttcaggcgcttgcgagcgacgaggaccatctgacgttcgaagtctccatcccggatcatccagtcatggtcgacggcgacgaggatcgcctggagcaggtcttcacgaatctgctcgacaatgcatttcggcatacggcacagggtaccattcgttttgaactggatattcgccacgactatgcctacgtgcgcgtggccgatacaggcagcggcataccggaagaggatgtgccctacattttcgagcgcttctacaaggctgacaaagcccgcacgcggtcgcggtctggaaccggcctcggtttggccatcgcccgccaactggtgattgagcatcgcggcgagatccttgtggaaagccacctcggagaaggcacgacgttcacggtggtcttgccacttgcttctccgaacgatcacggcgaaggagagagcgtctcatga

SEQ ID NO: 2005 - DNA, 1773 bp, Artificial
  Substituion in SEQ ID NO 1991
gtgatacccaacagcatcgtagccaagatgtggctgacgattgtcggcatggtgttcgtcattcaagcgctcctgtccgtcttgctccagcaagtctttaacaagtacattgtcactcgcgaagaagcgagcctcacccagctcgctttgaccatcgagtcggtgctcgcgacggcaaccgaccgatccatcaaagagcaagtggcaagtgatatcgccaagcgcgttgagcgtgcaactgtggtgtacgggatcccgtacaccgccaatgcggcattgaaggcagcctatgacgcgatgacgcctgcagagaggcaggctttgtcgcgcggtcagccggtcacgctgcgcggggctttgggcaaggtcaatcggctcaccgtgtacgtgcagatcccctctgccagatcgccacagcccggcatgttggcggtgtcacaggacacgagcgtgctggacgagcctttgcgggagatccgcaacatggtgctctttgatacggtactcggcgtgattctggcgacgggctttgcctttgtgatctcgaaaaacctgtctcgtccgctggtcgatatgacgcgagccgctgaggagatggcgcgcggccactatcgtcagcgcgttcgtgtggtgacgaaggacgaggtcggccggctcgggcacaccttcaacgcgctcgcgcgtcagttggcagagaccatcgagcagctttcgatggagcgagaaggcctgcagcggattctgtcgtcgctgcaagacggcgtggtggcgactgatctcgacggccgcgtcgtgttggccaatcctcctgcgaagcgccatttgcgccacctctcggtggcggagcgagggatcgtcgatgaggagagactccccgatcgtctcatgagcctatgggtgcgcgtgcgcgaacagcaggatgccgtgtaccgcgaggacacctgggacggccgcaccatcggcattacgatgctccctctctatgagacggacggtacgacgttgcgcggcgcactctgtgtcctccgcgacatcaccgaggagaggcggctggatcgcctccgcaaggacttcatcgcgaacgtctcgcatgaactgaggacgcctctcagcatgttgcagggatacacggaggcgattctggacgacatctcggatgatcccgacatgcgccgagagctgaccgagattattcacgatgaaacgctgcgcatgaagcgcctcgtcaatgatctcctcaacctcgcgcagctggaaagcggacaattcaagctccacttcgcccgcgtcgatctcacgcaggtcatgcgacgcgtggcgcgcaaatttcaggcgcttgcgagcgacgaggaccatctgacgttcgaagtctccatcccggatcatccagtcatggtcgacggcgacgaggatcgcctggagcaggtcttcacgaatctgctcgacaatgcatttcggcatacggcacagggtaccattcgttttgaactggatattcgccacgactatgcctacgtgcgcgtggccgatacaggcagcggcataccggaagaggatgtgccctacattttcgagcgcttctacaaggctgacaaagcccgcacgcggtcgcggtctggaaccggcctcggtttggccatcgcccgccaactggtgattgagcatcgcggcgagatccttgtggaaagccacctcggagaaggcacgacgttcacggtggtcttgccacttgcttctccgaacgatcacggcgaaggagagagcgtctcatga

SEQ ID NO: 2006 - DNA, 1773 bp, Artificial
  Substituion in SEQ ID NO 1991
gtgatacccaacagcatcgtagccaagatgtggctgacgattgtcggcatggtgttcgtcattcaagcgctcctgtccgtcttgctccagcaaatttttaacaagtacattgtcactcgcgaagaagcgagcctcacccagctcgctttgaccatcgagtcggtgctcgcgacggcaaccgaccgatccatcaaagagcaagtggcaagtgatatcgccaagcgcgttgagcgtgcaactgtggtgtacgggatcccgtacaccgccaatgcggcattgaaggcagcctatgacgcgatgacgcctgcagagaggcaggctttgtcgcgcggtcagccggtcacgctgcgcggggctttgggcaaggtcaatcggctcaccgtgtacgtgcagatcccctctgccagatcgccacagcccggcatgttggcggtgtcacaggacacgagcgtgctggacgagcctttgcgggagatccgcaacatggtgctctttgatacggtactcggcgtgattctggcgacgggctttgcctttgtgatctcgaaaaacctgtctcgtccgctggtcgatatgacgcgagccgctgaggagatggcgcgcggccactatcgtcagcgcgttcgtgtggtgacgaaggacgaggtcggccggctcgggcacaccttcaacgcgctcgcgcgtcagttggcagagaccatcgagcagctttcgatggagcgagaaggcctgcagcggattctgtcgtcgctgcaagacggcgtggtggcgactgatctcgacggccgcgtcgtgttggccaatcctcctgcgaagcgccatttgcgccacctctcggtggcggagcgagggatcgtcgatgaggagagactccccgatcgtctcatgagcctatgggtgcgcgtgcgcgaacagcaggatgccgtgtaccgcgaggacacctgggacggccgcaccatcggcattacgatgctccctctctatgagacggacggtacgacgttgcgcggcgcactctgtgtcctccgcgacatcaccgaggagaggcggctggatcgcctccgcaaggacttcatcgcgaacgtctcgcatgaactgaggacgcctctcagcatgttgcagggatacacggaggcgcttctggacgacatctcggatgatcccgacatgcgccgagagctgaccgagattattcacgatgaaacgctgcgcatgaagcgcctcgtcaatgatctcctcaacctcgcgcagctggaaagcggacaattcaagctccacttcgcccgcgtcgatctcacgcaggtcatgcgacgcgtggcgcgcaaatttcaggcgcttgcgagcgacgaggaccatctgacgttcgaagtctccatcccggatcatccagtcatggtcgacggcgacgaggatcgcctggagcaggtcttcacgaatctgctcgacaatgcatttcggcatacggcacagggtaccattcgttttgaactggatattcgccacgactatgcctacgtgcgcgtggccgatacaggcagcggcataccggaagaggatgtgccctacattttcgagcgcttctacaaggctgacaaagcccgcacgcggtcgcggtctggaaccggcctcggtttggccatcgcccgccaactggtgattgagcatcgcggcgagatccttgtggaaagccacctcggagaaggcacgacgttcacggtggtcttgccacttgcttctccgaacgatcacggcgaaggagagagcgtctcatga

SEQ ID NO: 2007 - protein, 429 aa, Alicyclobacillus acidocaldarius
MIPFAIGLGVGLAIGALFALWQMSWFRSLRRYLLDAMDAIVQGRYDVRMYEYRSRPAEIAIFRHFNRMAERIQETLADLSQERDILRHILQNMTTGVIYLRSDGQVQMVNHAAERLFRRPVEQWKDRDHWTVFRNYQLGSAIDHALLFGTPWSGEFQIRDGVTVAVRLVPISAAPRMRNKADGRHDVLMLVNDVSEWRRLERMRSDFVANVSHELKTPIAAIRGFAETLLDGDVDEEAREKFLRTIYEESLRMGNLVSDLLELSKLEASDSHVDPVAVDLYEVLVRAVDRVRPVANEKEITIELPREQRLHVWAEPDLLLQVFLNLLTNAIHYSPPKSRVCVTWDVLVDRVKVHVKDNGIGIPKESLPRVFERFYRVHKDRSRASGGTGLGLAIVKHIVTALGGEVGVESEEGKGSDFWFTLSRLDARP

SEQ ID NO: 2008 - DNA, 1290 bp, Alicyclobacillus acidocaldarius
atgatcccgtttgccatcgggctcggcgtcgggctcgccatcggcgcgctgttcgcgttgtggcagatgagctggtttcgcagcctcaggcgctacctgctcgacgccatggacgccatcgtccagggccgctacgacgtgcgcatgtacgagtaccggagccgccctgccgagatcgccattttccgccacttcaaccgcatggccgagcgcatccaggagacgctggcggatctgtcgcaggagcgagacattctccggcacatcctgcagaacatgaccaccggcgtcatctacctcaggagcgacggccaggtgcagatggtcaatcacgccgccgagcggctgttccgccggcccgtggagcagtggaaggaccgagatcactggaccgtctttcgcaactaccagctcggctcggccatcgatcacgcccttctcttcggcacgccctggtccggggagttccagatccgcgacggcgtcaccgtggccgtgcgcctcgtgcccatctccgcggcgccccgcatgcggaacaaggccgacggtcggcacgacgtgctcatgttggtgaacgacgtctccgagtggcgccgcctcgagcgcatgcggagcgacttcgtcgccaacgtctcgcacgagctgaagacgcccatcgcagcgattcgcgggttcgccgagacgctgcttgacggcgacgtggacgaggaggcgcgcgaaaaattcctgcgcaccatctatgaggagtcgctccgcatgggcaacctcgtgtcggatctgctcgagctctcgaagctggaggcgagcgacagccacgtggacccggtcgccgtcgatctgtacgaggtgctcgtgcgcgccgtcgatcgcgtccggcccgtggcgaacgaaaaggagatcaccatcgaactgccgcgcgaacaacgcctgcacgtctgggccgagccggatctcctgctgcaggtgtttctgaacctgctgacgaacgccatccactactcgccgccgaagagccgcgtctgcgtcacctgggacgtgctggtcgatcgcgtcaaggtgcacgtgaaggacaacggcatcgggatccccaaggagtcgctgccgcgggtgttcgagcggttttaccgcgtgcacaaggaccgcagccgggcctccggcgggacgggccttgggctcgccatcgtcaagcacatcgtcaccgcgctcggcggcgaggtcggcgtcgagagcgaggagggcaagggcagcgacttctggttcacgctctccaggctcgacgcgcggccgtga

SEQ ID NO: 2009 - protein, 392 aa, Bacillus coagulans 36D1
IEVSNRLIEKDYDSRVRVNASGELRQLTKAINNLAHNLKQQMNEIDENEQQLTAVLENMDSGVMLIQTSGRIMLVNRAMEEMTGLSSGELIGKRHIEAGKSFGLSQLIDRSLKTGERFRDEVHLYYPKERILDAHIAPYVGESGELRGVVAVLHDVTETRRLEQIRSEFVANVSHELKTPVTSVKGFAETLLDGAMYDEATLREFLKIIYDESDRLHRLISDILDLSRIEQHRILLKMEQLNVVDVVAETVQTMRKRIEKKQLELVLPQKRHVMMEADKDRLRQILLNLVTNAIAYTPDKGRIEISLIERENELDLIVSDTGIGISEKDLPRIFERFYRVDKARSRQSGGTGLGLAIVKHLVESYHGKIRVESEEGKGSTFIVTLPRTQTRP

SEQ ID NO: 2010 - protein, 337 aa, Pelotomaculum thermopropionicum SI
RSINYLARQLKNNIEDVIAEKNRIKAILSSMSDGVIAMDAWGRMILINPVVEELFRITMAASRGKNILRVIRNYDLEKLLNQALETGRCMQKQIQILAPEPRVFQVHVIPLQNSGAERGGVVALLRDITERKILQEMRSEFVANVSHELRTPLTSIRGFAETLLDGALEEPDTARRFLEIINSETERLSRLIDELLNLSRLESHKWVPKRQPVNMGELIKRAVAILQPRAVEKNLAIKINLPEDLPVVQGDPDMLSQVLLNLIENAVVYTQAGGEVSISAAATQDEMKVDVKDNGIGIPPESLSRVFERFYRVDKARSREQGGTGLGLSIVKHIIDA

SEQ ID NO: 2011 - protein, 377 aa, Exiguobacterium sibiricum 255-15
YSSTKRFLRPIAEATEVLHELSHGNYKSRVYELTAPDESRDLGKSINLLARNLENASSGEAMQRARLESLIEYMGAGLMLIDEKGYVLLVNRTYREMFNIYGQSNGQLYYRVLPNEKMSQVIEDVYLTEKPNRKQSSVRFGLNSRTFMVSAAPIFGKNGRVQGTTVVFNDITEIKKLEQMRKDFVANVSHELKTPLTSIKGFAETLLDGAQDVPEIREQFLNIIHDESERMQTLVEDLLELSRLEQDNYQLETTIVDVTSLLHETATLLQRKATEKQMTIHLETEEEVFIRADLNRLKQVVVNLVANALNYTPNGGNVWISLEDGEEAVMLRIKDDGIGIHPKEMQRIFERFYRVDKARSRNSGGTGLGLAIVKHII

SEQ ID NO: 2012 - protein, 359 aa, Oceanobacillus iheyensis HTE831
VDRLIEGNYSARFYNGNSPEMEELSVKVNTLARNMSEIAIQEQMQSEQLTTIVDNMQSGLVLIDEKGYVHVVNRKFLEMFGEEESNYRGHLYYDVFENENVHETVQKTFLYEETVKKSFVHREGLNKIYVEVVGAPIFNERNMLKGAVLVLYDITELKKLEKMRKDFVANVSHELRTPITSIRGFAETLLDNNITDPATKEFMEIIYKESHRLQLLIEDLLALSRLEREDFRLLIDNYDVRQMVEEILPQLHQKAENKNLTFDLEVPDQLTMRADKDRMKQVLINLIDNSIHYTPSGGDICLAISEETDVIHFQVKDSGIGMDEKSQTRVFERFYRVDKARSRNTGGTGLGLAIVKHIV

SEQ ID NO: 2013 - protein, 341 aa, Paenibacillus larvae subsp. larvae BRL-230010
RTINRMAENLQIQMQHIRENEYRLQGVLENMVSGVMMVDQRGTITLVNRSAEDILGYSSHELLNKSYLDAGFQLEFTALLADAIETHTRVREELMLHFPQEQILEVHVSPIVQGDGQRKGVLVVLHDITAVRRLERIRSEFVANVSHELKTPVAAVKGFAETLMAGALEDKEMARSFLQIIYDESDRLNRLIGDILELSKIESKRIPLQFSPVDVESIVENSIQMMKAEAEKKHITLESCVENELYIEADEDRLRQILINLLSNGISYTPEGGRVSIGVEFVPSLDDNPDNERMRIRISDTGIGIPEKDLPRIFERFYRVDKARSRSSGGTGLGLSIVKHL

SEQ ID NO: 2014 - protein, 429 aa, Artificial
  Substituion in SEQ ID NO 2007
MIPFAIGLGVGLAIGALFALWQMSWFRSLRRYLLDAMDAIVQGRYDVRMYEYRSRPAEIAIFRHFNRMAERIQETLADLSQERDILRHILQNMTTGVIYLRSDGQVQMVNHAAERLFRRPVEQWKDRDHWTVFRNYQLGSAIDHALLFGTPWSGEFQIRDGVTVAVRLVPISAAPRMRNKADGRHDVLMLVNDVSEWRRLERMRSDFVANVSHELKTPIAAIRGFAETLLDGEVDEEAREKFLRTIYEESLRMGNLVSDLLELSKLEASDSHVDPVAVDLYEVLVRAVDRVRPVANEKEITIELPREQRLHVWAEPDLLLQVFLNLLTNAIHYSPPKSRVCVTWDVLVDRVKVHVKDNGIGIPKESLPRVFERFYRVHKDRSRASGGTGLGLAIVKHIVTALGGEVGVESEEGKGSDFWFTLSRLDARP

SEQ ID NO: 2015 - protein, 429 aa, Artificial
  Substituion in SEQ ID NO 2007
MIPFAIGLGVGLAIGALFALWQMSWFRSLRRYLLDAMDAIIQGRYDVRMYEYRSRPAEIAIFRHFNRMAERIQETLADLSQERDILRHILQNMTTGVIYLRSDGQVQMVNHAAERLFRRPVEQWKDRDHWTVFRNYQLGSAIDHALLFGTPWSGEFQIRDGVTVAVRLVPISAAPRMRNKADGRHDVLMLVNDVSEWRRLERMRSDFVANVSHELKTPIAAIRGFAETLLDGDVDEEAREKFLRTIYEESLRMGNLVSDLLELSKLEASDSHVDPVAVDLYEVLVRAVDRVRPVANEKEITIELPREQRLHVWAEPDLLLQVFLNLLTNAIHYSPPKSRVCVTWDVLVDRVKVHVKDNGIGIPKESLPRVFERFYRVHKDRSRASGGTGLGLAIVKHIVTALGGEVGVESEEGKGSDFWFTLSRLDARP

SEQ ID NO: 2016 - protein, 429 aa, Artificial
  Substituion in SEQ ID NO 2007
MIPFAIGLGVGLAIGALFALWQMSWFRSLRRYLLDAMDAIVQGRYDVRMYEYRSRPAEIAIFRHFNRMAERIQETLADLSQERDILRHILQNMTTGVIYLRSDGQVQMVNHAAERLFRRPVEQWKDRDHWTVFRNYQLGSAIDHALLFGTPWSGEFQIRDGVTVAVRLVPISAAPRMRNKADGRHEVLMLVNDVSEWRRLERMRSDFVANVSHELKTPIAAIRGFAETLLDGDVDEEAREKFLRTIYEESLRMGNLVSDLLELSKLEASDSHVDPVAVDLYEVLVRAVDRVRPVANEKEITIELPREQRLHVWAEPDLLLQVFLNLLTNAIHYSPPKSRVCVTWDVLVDRVKVHVKDNGIGIPKESLPRVFERFYRVHKDRSRASGGTGLGLAIVKHIVTALGGEVGVESEEGKGSDFWFTLSRLDARP

SEQ ID NO: 2017 - protein, 429 aa, Artificial
  Substituion in SEQ ID NO 2007
MIPFAIGLGVGLAIGALFALWQMSWFRSLRRYLLDAMDAIVQGRYDVRMYEYRSRPAEIAIFRHFNRMAERIQETLADLSQERDILRHILQNMTTGVIYLRSDGQVQMVNHAAERLFRRPVEQWKDRDHWTVFRNYQLGSAIDHALLFGTPWSGEFQIRDGVTVAVRLVPISAAPRMRNKADGRHDVLMLVNDVSEWRRLERMRSDFVANVSHELKTPIAAIRGFAETLLDGDVDEEAREKFLRTIYEESLRMGNLVSDLLELSKLEASDSHVDPVAVDLYEVLVRAVDRVRPVANDKEITIELPREQRLHVWAEPDLLLQVFLNLLTNAIHYSPPKSRVCVTWDVLVDRVKVHVKDNGIGIPKESLPRVFERFYRVHKDRSRASGGTGLGLAIVKHIVTALGGEVGVESEEGKGSDFWFTLSRLDARP

SEQ ID NO: 2018 - protein, 429 aa, Artificial
  Substituion in SEQ ID NO 2007
MIPFAIGLGVGLAIGALFALWQMSWFRSLRRYLLDAMDAIVQGRYDVRMYEYRSRPAEIAIFRHFNRMAERIQETLADLSQERDILRHILQNMTTGVIYLRSDGQVQMVNHAAERLFRRPVEQWKDRDHWTVFRNYQLGSAIDHALLFGTPWSGEFQIRDGVTVAVRLVPISAAPRMRNKADGRHDVIMLVNDVSEWRRLERMRSDFVANVSHELKTPIAAIRGFAETLLDGDVDEEAREKFLRTIYEESLRMGNLVSDLLELSKLEASDSHVDPVAVDLYEVLVRAVDRVRPVANEKEITIELPREQRLHVWAEPDLLLQVFLNLLTNAIHYSPPKSRVCVTWDVLVDRVKVHVKDNGIGIPKESLPRVFERFYRVHKDRSRASGGTGLGLAIVKHIVTALGGEVGVESEEGKGSDFWFTLSRLDARP

SEQ ID NO: 2019 - DNA, 1290 bp, Artificial
  Substituion in SEQ ID NO 2008
atgatcccgtttgccatcgggctcggcgtcgggctcgccatcggcgcgctgttcgcgttgtggcagatgagctggtttcgcagcctcaggcgctacctgctcgacgccatggacgccatcgtccagggccgctacgacgtgcgcatgtacgagtaccggagccgccctgccgagatcgccattttccgccacttcaaccgcatggccgagcgcatccaggagacgctggcggatctgtcgcaggagcgagacattctccggcacatcctgcagaacatgaccaccggcgtcatctacctcaggagcgacggccaggtgcagatggtcaatcacgccgccgagcggctgttccgccggcccgtggagcagtggaaggaccgagatcactggaccgtctttcgcaactaccagctcggctcggccatcgatcacgcccttctcttcggcacgccctggtccggggagttccagatccgcgacggcgtcaccgtggccgtgcgcctcgtgcccatctccgcggcgccccgcatgcggaacaaggccgacggtcggcacgacgtgctcatgttggtgaacgacgtctccgagtggcgccgcctcgagcgcatgcggagcgacttcgtcgccaacgtctcgcacgagctgaagacgcccatcgcagcgattcgcgggttcgccgagacgctgcttgacggcgaagtggacgaggaggcgcgcgaaaaattcctgcgcaccatctatgaggagtcgctccgcatgggcaacctcgtgtcggatctgctcgagctctcgaagctggaggcgagcgacagccacgtggacccggtcgccgtcgatctgtacgaggtgctcgtgcgcgccgtcgatcgcgtccggcccgtggcgaacgaaaaggagatcaccatcgaactgccgcgcgaacaacgcctgcacgtctgggccgagccggatctcctgctgcaggtgtttctgaacctgctgacgaacgccatccactactcgccgccgaagagccgcgtctgcgtcacctgggacgtgctggtcgatcgcgtcaaggtgcacgtgaaggacaacggcatcgggatccccaaggagtcgctgccgcgggtgttcgagcggttttaccgcgtgcacaaggaccgcagccgggcctccggcgggacgggccttgggctcgccatcgtcaagcacatcgtcaccgcgctcggcggcgaggtcggcgtcgagagcgaggagggcaagggcagcgacttctggttcacgctctccaggctcgacgcgcggccgtga

SEQ ID NO: 2020 - DNA, 1290 bp, Artificial
  Substituion in SEQ ID NO 2008
atgatcccgtttgccatcgggctcggcgtcgggctcgccatcggcgcgctgttcgcgttgtggcagatgagctggtttcgcagcctcaggcgctacctgctcgacgccatggacgccatcattcagggccgctacgacgtgcgcatgtacgagtaccggagccgccctgccgagatcgccattttccgccacttcaaccgcatggccgagcgcatccaggagacgctggcggatctgtcgcaggagcgagacattctccggcacatcctgcagaacatgaccaccggcgtcatctacctcaggagcgacggccaggtgcagatggtcaatcacgccgccgagcggctgttccgccggcccgtggagcagtggaaggaccgagatcactggaccgtctttcgcaactaccagctcggctcggccatcgatcacgcccttctcttcggcacgccctggtccggggagttccagatccgcgacggcgtcaccgtggccgtgcgcctcgtgcccatctccgcggcgccccgcatgcggaacaaggccgacggtcggcacgacgtgctcatgttggtgaacgacgtctccgagtggcgccgcctcgagcgcatgcggagcgacttcgtcgccaacgtctcgcacgagctgaagacgcccatcgcagcgattcgcgggttcgccgagacgctgcttgacggcgacgtggacgaggaggcgcgcgaaaaattcctgcgcaccatctatgaggagtcgctccgcatgggcaacctcgtgtcggatctgctcgagctctcgaagctggaggcgagcgacagccacgtggacccggtcgccgtcgatctgtacgaggtgctcgtgcgcgccgtcgatcgcgtccggcccgtggcgaacgaaaaggagatcaccatcgaactgccgcgcgaacaacgcctgcacgtctgggccgagccggatctcctgctgcaggtgtttctgaacctgctgacgaacgccatccactactcgccgccgaagagccgcgtctgcgtcacctgggacgtgctggtcgatcgcgtcaaggtgcacgtgaaggacaacggcatcgggatccccaaggagtcgctgccgcgggtgttcgagcggttttaccgcgtgcacaaggaccgcagccgggcctccggcgggacgggccttgggctcgccatcgtcaagcacatcgtcaccgcgctcggcggcgaggtcggcgtcgagagcgaggagggcaagggcagcgacttctggttcacgctctccaggctcgacgcgcggccgtga

SEQ ID NO: 2021 - DNA, 1290 bp, Artificial
  Substituion in SEQ ID NO 2008
atgatcccgtttgccatcgggctcggcgtcgggctcgccatcggcgcgctgttcgcgttgtggcagatgagctggtttcgcagcctcaggcgctacctgctcgacgccatggacgccatcgtccagggccgctacgacgtgcgcatgtacgagtaccggagccgccctgccgagatcgccattttccgccacttcaaccgcatggccgagcgcatccaggagacgctggcggatctgtcgcaggagcgagacattctccggcacatcctgcagaacatgaccaccggcgtcatctacctcaggagcgacggccaggtgcagatggtcaatcacgccgccgagcggctgttccgccggcccgtggagcagtggaaggaccgagatcactggaccgtctttcgcaactaccagctcggctcggccatcgatcacgcccttctcttcggcacgccctggtccggggagttccagatccgcgacggcgtcaccgtggccgtgcgcctcgtgcccatctccgcggcgccccgcatgcggaacaaggccgacggtcggcacgaagtgctcatgttggtgaacgacgtctccgagtggcgccgcctcgagcgcatgcggagcgacttcgtcgccaacgtctcgcacgagctgaagacgcccatcgcagcgattcgcgggttcgccgagacgctgcttgacggcgacgtggacgaggaggcgcgcgaaaaattcctgcgcaccatctatgaggagtcgctccgcatgggcaacctcgtgtcggatctgctcgagctctcgaagctggaggcgagcgacagccacgtggacccggtcgccgtcgatctgtacgaggtgctcgtgcgcgccgtcgatcgcgtccggcccgtggcgaacgaaaaggagatcaccatcgaactgccgcgcgaacaacgcctgcacgtctgggccgagccggatctcctgctgcaggtgtttctgaacctgctgacgaacgccatccactactcgccgccgaagagccgcgtctgcgtcacctgggacgtgctggtcgatcgcgtcaaggtgcacgtgaaggacaacggcatcgggatccccaaggagtcgctgccgcgggtgttcgagcggttttaccgcgtgcacaaggaccgcagccgggcctccggcgggacgggccttgggctcgccatcgtcaagcacatcgtcaccgcgctcggcggcgaggtcggcgtcgagagcgaggagggcaagggcagcgacttctggttcacgctctccaggctcgacgcgcggccgtga

SEQ ID NO: 2022 - DNA, 1290 bp, Artificial
  Substituion in SEQ ID NO 2008
atgatcccgtttgccatcgggctcggcgtcgggctcgccatcggcgcgctgttcgcgttgtggcagatgagctggtttcgcagcctcaggcgctacctgctcgacgccatggacgccatcgtccagggccgctacgacgtgcgcatgtacgagtaccggagccgccctgccgagatcgccattttccgccacttcaaccgcatggccgagcgcatccaggagacgctggcggatctgtcgcaggagcgagacattctccggcacatcctgcagaacatgaccaccggcgtcatctacctcaggagcgacggccaggtgcagatggtcaatcacgccgccgagcggctgttccgccggcccgtggagcagtggaaggaccgagatcactggaccgtctttcgcaactaccagctcggctcggccatcgatcacgcccttctcttcggcacgccctggtccggggagttccagatccgcgacggcgtcaccgtggccgtgcgcctcgtgcccatctccgcggcgccccgcatgcggaacaaggccgacggtcggcacgacgtgctcatgttggtgaacgacgtctccgagtggcgccgcctcgagcgcatgcggagcgacttcgtcgccaacgtctcgcacgagctgaagacgcccatcgcagcgattcgcgggttcgccgagacgctgcttgacggcgacgtggacgaggaggcgcgcgaaaaattcctgcgcaccatctatgaggagtcgctccgcatgggcaacctcgtgtcggatctgctcgagctctcgaagctggaggcgagcgacagccacgtggacccggtcgccgtcgatctgtacgaggtgctcgtgcgcgccgtcgatcgcgtccggcccgtggcgaacgataaggagatcaccatcgaactgccgcgcgaacaacgcctgcacgtctgggccgagccggatctcctgctgcaggtgtttctgaacctgctgacgaacgccatccactactcgccgccgaagagccgcgtctgcgtcacctgggacgtgctggtcgatcgcgtcaaggtgcacgtgaaggacaacggcatcgggatccccaaggagtcgctgccgcgggtgttcgagcggttttaccgcgtgcacaaggaccgcagccgggcctccggcgggacgggccttgggctcgccatcgtcaagcacatcgtcaccgcgctcggcggcgaggtcggcgtcgagagcgaggagggcaagggcagcgacttctggttcacgctctccaggctcgacgcgcggccgtga

SEQ ID NO: 2023 - DNA, 1290 bp, Artificial
  Substituion in SEQ ID NO 2008
atgatcccgtttgccatcgggctcggcgtcgggctcgccatcggcgcgctgttcgcgttgtggcagatgagctggtttcgcagcctcaggcgctacctgctcgacgccatggacgccatcgtccagggccgctacgacgtgcgcatgtacgagtaccggagccgccctgccgagatcgccattttccgccacttcaaccgcatggccgagcgcatccaggagacgctggcggatctgtcgcaggagcgagacattctccggcacatcctgcagaacatgaccaccggcgtcatctacctcaggagcgacggccaggtgcagatggtcaatcacgccgccgagcggctgttccgccggcccgtggagcagtggaaggaccgagatcactggaccgtctttcgcaactaccagctcggctcggccatcgatcacgcccttctcttcggcacgccctggtccggggagttccagatccgcgacggcgtcaccgtggccgtgcgcctcgtgcccatctccgcggcgccccgcatgcggaacaaggccgacggtcggcacgacgtgattatgttggtgaacgacgtctccgagtggcgccgcctcgagcgcatgcggagcgacttcgtcgccaacgtctcgcacgagctgaagacgcccatcgcagcgattcgcgggttcgccgagacgctgcttgacggcgacgtggacgaggaggcgcgcgaaaaattcctgcgcaccatctatgaggagtcgctccgcatgggcaacctcgtgtcggatctgctcgagctctcgaagctggaggcgagcgacagccacgtggacccggtcgccgtcgatctgtacgaggtgctcgtgcgcgccgtcgatcgcgtccggcccgtggcgaacgaaaaggagatcaccatcgaactgccgcgcgaacaacgcctgcacgtctgggccgagccggatctcctgctgcaggtgtttctgaacctgctgacgaacgccatccactactcgccgccgaagagccgcgtctgcgtcacctgggacgtgctggtcgatcgcgtcaaggtgcacgtgaaggacaacggcatcgggatccccaaggagtcgctgccgcgggtgttcgagcggttttaccgcgtgcacaaggaccgcagccgggcctccggcgggacgggccttgggctcgccatcgtcaagcacatcgtcaccgcgctcggcggcgaggtcggcgtcgagagcgaggagggcaagggcagcgacttctggttcacgctctccaggctcgacgcgcggccgtga

SEQ ID NO: 2024 - protein, 163 aa, Alicyclobacillus acidocaldarius
MMMTFGERLAQLRRSKGLSQYALAEQLKMTRGQIANYEQGTREPDIETLKKLADFFDVSIDFLVLGKPNVSDFNGLTNEVKRTLEALSQMSVEKQQEVADFAEYLRSKEEQPVVEYDVREIAANMEKALYAHGDEDLIQHFEEIMRRVIRRYDERASQDQQNR

SEQ ID NO: 2025 - DNA, 492 bp, Alicyclobacillus acidocaldarius
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctgtggtagaatatgacgtgcgagaaattgcagcgaatatggaaaaagcattgtacgcgcacggagacgaagaccttattcaacactttgaggagatcatgagacgtgtcattcgtcgatatgatgaacgtgccagccaagaccagcagaatcggtga

SEQ ID NO: 2026 - protein, 135 aa, Listeria innocua Clip11262
FSKRLSELRKKKGFSQYKLADELGFSRGQVANYEQGTREPDYQTLLKIAEFFNVSTDYLLGRDDNNLADTIAAHIDSNASEEDMKEILAYIEEKRKEHANEEEIDITDIAAKKDADVAKFVEENPDFKAVAARVM

SEQ ID NO: 2027 - protein, 135 aa, Listeria monocytogenes FSL J2-003
FSKRLSELRKKKGFSQYKLADELGFSRGQVANYEQGTREPDYQTLLKIAEFFNVSTDYLLGRDDNNLADTIAAHIDSNATEEDIKEILAYIEEKRKEHANEKEINITEIASKEDEEINKFVDENEDFKVVAARVM

SEQ ID NO: 2028 - protein, 135 aa, Listeria monocytogenes FSL N1-017
FSKRLSELRKKKGFSQYKLADELGFSRGQVANYEQGTREPDYQTLLKIAEFFNVSTDYLLGRDDNNLAETIAAHIDSNASEEDIKEILAYIEEKRKEHVNEEEINITEIASKEDDAVDKFVEENEDFKAVAARVM

SEQ ID NO: 2029 - protein, 135 aa, Listeria monocytogenes 10403S
FSKRLSELRKKKGFSQYKLADELGFSRGQVANYEQGTREPDYQTLLKIAEFFNVSTDYLLGRDDNNLADTIAAHIDSNATEEDIKEILAYIEEKRKEHANEREINITEIASKEDEAVDKFVEENEDFKAVAARVM

SEQ ID NO: 2030 - protein, 95 aa, Desulfotomaculum reducens MI-1
MTQEQLAQQLGFTRGQVSNYEQGSREPDFETLKKIADFFKVTTDYMLGRTDDPTPVDKLIELSALAGQQKFDPMKELPPEAQRSLEDFIDYLMRK

SEQ ID NO: 2031 - protein, 163 aa, Artificial
  Substituion in SEQ ID NO 2024
MMMTFGERLAQLRRSKGLSQYALAEQLKMTRGQIANYEQGTREPDIETLKKLADFFDVSIDFLVLGKPNVSDFNGLTNEVKRTLEAISQMSVEKQQEVADFAEYLRSKEEQPVVEYDVREIAANMEKALYAHGDEDLIQHFEEIMRRVIRRYDERASQDQQNR

SEQ ID NO: 2032 - protein, 163 aa, Artificial
  Substituion in SEQ ID NO 2024
MMMTFGERLAQLRRSKGLSQYALAEQLKMTRGQIANYEQGTREPDIETLKKLADFFDVSIDFLVLGKPNVSDFNGITNEVKRTLEALSQMSVEKQQEVADFAEYLRSKEEQPVVEYDVREIAANMEKALYAHGDEDLIQHFEEIMRRVIRRYDERASQDQQNR

SEQ ID NO: 2033 - protein, 163 aa, Artificial
  Substituion in SEQ ID NO 2024
MMMTFGERLAQLRRSKGLSQYALAEQLKMTRGQIANYEQGTREPDIETLKKLADFFDVSIDFLVLGKPNVSDFNGLTNEVKRTLEALSQMSVEKQQEVADFAEYLRSKEEQPIVEYDVREIAANMEKALYAHGDEDLIQHFEEIMRRVIRRYDERASQDQQNR

SEQ ID NO: 2034 - protein, 163 aa, Artificial
  Substituion in SEQ ID NO 2024
MMMTFGERLAQLRRSKGLSQYALAEQLKMTRGQIANYEQGTREPDIETLKKLADFFDVSIDFLVLGKPNVSDFNGLTNEVKRTLEALSQMSVEKQQEVADFAEYLRSKEEQPVVEYDVREIAANMEKALYAHGDEDLIQHFEEIMRRVIRKYDERASQDQQNR

SEQ ID NO: 2035 - protein, 163 aa, Artificial
  Substituion in SEQ ID NO 2024
MMMTFGERLAQLRRSKGLSQYALAEQLKMTRGQIANYEQGTREPDIETLKKLADFFDVSIDFLVLGKPNVSDFNGLTNEVKRTLEALSQMSVEKQQEVADFAEYLRSKEEQPVVEYDVREIAANMEKALYAHGDEDLIQHFEDIMRRVIRRYDERASQDQQNR

SEQ ID NO: 2036 - DNA, 492 bp, Artificial
  Substituion in SEQ ID NO 2025
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgatttctcaaatgtcagtcgagaagcagcaagaggtcgccgattttgccgaatacctgagatccaaggaagaacagcctgtggtagaatatgacgtgcgagaaattgcagcgaatatggaaaaagcattgtacgcgcacggagacgaagaccttattcaacactttgaggagatcatgagacgtgtcattcgtcgatatgatgaacgtgccagccaagaccagcagaatcggtga

SEQ ID NO: 2037 - DNA, 492 bp, Artificial
  Substituion in SEQ ID NO 2025
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcattactaatgaggttaaaagaacgttggaagcgctatctcaaatgtcagtcgagaagcagcaagaggtcgccgattttgccgaatacctgagatccaaggaagaacagcctgtggtagaatatgacgtgcgagaaattgcagcgaatatggaaaaagcattgtacgcgcacggagacgaagaccttattcaacactttgaggagatcatgagacgtgtcattcgtcgatatgatgaacgtgccagccaagaccagcagaatcggtga

SEQ ID NO: 2038 - DNA, 492 bp, Artificial
  Substituion in SEQ ID NO 2025
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctattgtagaatatgacgtgcgagaaattgcagcgaatatggaaaaagcattgtacgcgcacggagacgaagaccttattcaacactttgaggagatcatgagacgtgtcattcgtcgatatgatgaacgtgccagccaagaccagcagaatcggtga

SEQ ID NO: 2039 - DNA, 492 bp, Artificial
  Substituion in SEQ ID NO 2025
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctgtggtagaatatgacgtgcgagaaattgcagcgaatatggaaaaagcattgtacgcgcacggagacgaagaccttattcaacactttgaggagatcatgagacgtgtcattcgtaaatatgatgaacgtgccagccaagaccagcagaatcggtga

SEQ ID NO: 2040 - DNA, 492 bp, Artificial
  Substituion in SEQ ID NO 2025
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctgtggtagaatatgacgtgcgagaaattgcagcgaatatggaaaaagcattgtacgcgcacggagacgaagaccttattcaacactttgaggatatcatgagacgtgtcattcgtcgatatgatgaacgtgccagccaagaccagcagaatcggtga

SEQ ID NO: 2041 - protein, 383 aa, Alicyclobacillus acidocaldarius
MVEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 2042 - DNA, 1152 bp, Alicyclobacillus acidocaldarius
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 2043 - protein, 376 aa, Bacillus sp. B14905
FVISQENWSLHRKGHQDQQRHMEKVKDAIKNNLPDLVSEESIVMSNGREVIKIPIRSLDEFKIRYNYDNSKHVGQGQGDSNVGDVVARDGSKANQTQGKGKEAGDKPGQDYYEAEVSLEEIQNVLFHELELPNLQQKEKAEIVTEKIEFNDIRKKGLMGNVDKKRTILNALKRNAMHGKAEITPIHNDDLRFKIWDEVVKPESKAVVLAMMDTSGSMGAFEKYCARSFFFWMTKFLRSKYETVEIEFIAHHTEAKVVTEEEFFTKGESGGTICSSAYKKALELIKEKYSPSRYNIYPVHFSDGENISMDNEKCLKLVAELMDVSSMFGYGEVNQHNRFSTLMYTYKKIDDPKFRHHILRKKGDVYDALKSFFKKNE

SEQ ID NO: 2044 - protein, 376 aa, Bacillus halodurans C-125
FVVSQENWTLHRKGYQDQRRHQEKVKEAIRKNLPDLVSEENIIMSNGREVIKIPIRSLDEYKIRYNYDKNKHVGQGDGDSQVGDVIARDPSAGQQGPGKGQGAGDQPGEDYFEAEVSILELEELLFRELELPNLQQKEEDHLVVEHIEFNDIRKKGLMGNIDKRRTILSAIKRNALEGRPGLIPIYNDDLRFKTWNEVVRPESKAVVLAMMDTSGSMGRWEKYMARSFFFWMTRFLRTKYETVDIEFIAHHTEAKVVSEEDFFSKGESGGTICSSAYRKALELINEKYDPARYNIYPFHFSDGDNLTSDNARCLKLVHELMESSSMFGYGEVNQYSRHSTLMNAYKNLKDPRFRSYVLKEKGDVYRAMKTFFKKEE

SEQ ID NO: 2045 - protein, 377 aa, Bacillus pumilus SAFR-032
QFIVSQEDWSLHRKGYDDQQRHQKKVKEAIKNNLPDLVTEESIIMSNGKDVVKIPIRSLDEYKIRYNYDKNKHVGQGDGDSEVGDIVARDGSDSKQGQGKGQSAGDQAGEDYYEAEVSLMDLEEALFRELELPNLKQKELDDIIVEQIEFNDIRKTGLTGNIHKKRTMLSAFKRNAMTGSPSFYPIYPEDIKYKTWNEVTKPESKAVVLAMMDTSGSMGLWEKYMARSFFFWMTRFLRTKYETVDIEFIAHHTEAKVVDEEHFFSRGESGGTICSSVYRKALELIDERYPPSRYNIYPFHFSDGDNLTSDNARCVKLVSEIMKKANLFCYGEVNQYNRHSTLMSAYKHIQDEKFKHYILKQKSDVFLALKKFFQQEE

SEQ ID NO: 2046 - protein, 377 aa, Bacillus sp. NRRL B-14911
QFVISEEDWSLHRKGHDDQQRHQEKVQDAIRNNLPDLITEESIIMSNGREVVKIPIRSLDEYKIRYNYDKNKHVGQGDGDSQVGDVVARDGSSGQKGPGKGQGAGDQPGEDYFEAEVSMMELEEALFKQLELPNLKRKEQEEHLVENIEFNDIRKTGLMGNIDKKRTMMTAFKRNAMTGKPAFYPIYQEDLKFKTWNEIVKPDSKAVVLAMMDTSGSMGLWEKYMARSFFFWMTRFLRTKYETVEIEFIAHHTEAKVVSEEDFFSKGESGGTICSSAYRKALELINEKYNPRRFNIYPFHFSDGDNLTSDNARCVKLVEELIAVSSMFGYGEVNQYNRHSTLMSAYKNIKNEHFRYYILKQKADVFHAMKSFFQNEE

SEQ ID NO: 2047 - protein, 374 aa, Paenibacillus larvae subsp. larvae BRL-230010
FIVSRENWSLHRKGYQDQTRHQQKIKDAIKQNLPDLVTEENIILSNGKQIIKIPIRSLDEYRFRFNYNKSKHVGQGDGDSQVGDVLGIDPYTQQGKGAGAGDQAGEDYYEAEVDMEELQSLLFEELELPYLNPKERLDISTQDIIFNDIRKKGIMSNIDKKRTILENIRRNASSGTPGIHGISPDDLRFKTWDEIEKPHSNALILAMMDTSGSMGSFEKYIARSFFFWMTRFLRSKYEHVDIVFIAHHTEARIVSEEEFFTKGESGGTICSSAYQAALDVIDRSYPPSKYNIYPFHFSDGDNLTSDNERCVKLIQRLMERSNMFGYGEVNQYNRSSTLMQTYRHIQDPKFLYYIIREKGEVYKALKTFFAKPEG

SEQ ID NO: 2048 - protein, 383 aa, Artificial
  Substituion in SEQ ID NO 2041
MVEFTLQREDWSLHRKGHLDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 2049 - protein, 383 aa, Artificial
  Substituion in SEQ ID NO 2041
MVEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQNELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 2050 - protein, 383 aa, Artificial
  Substituion in SEQ ID NO 2041
MVEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVRPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 2051 - protein, 383 aa, Artificial
  Substituion in SEQ ID NO 2041
MVEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDIRYKTWETIVKPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 2052 - protein, 383 aa, Artificial
  Substituion in SEQ ID NO 2041
MIEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 2053 - DNA, 1152 bp, Artificial
  Substituion in SEQ ID NO 2042
gtggtcgaattcacacttcaacgcgaagactggtcactccaccgcaaagggcatttagatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 2054 - DNA, 1152 bp, Artificial
  Substituion in SEQ ID NO 2042
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagaatgagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 2055 - DNA, 1152 bp, Artificial
  Substituion in SEQ ID NO 2042
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtccgtccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 2056 - DNA, 1152 bp, Artificial
  Substituion in SEQ ID NO 2042
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatattcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 2057 - DNA, 1152 bp, Artificial
  Substituion in SEQ ID NO 2042
gtgattgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 2058 - protein, 361 aa, Alicyclobacillus acidocaldarius
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKLRGEKRVAVTYTGDGGTSQGDFYEGMNFAGAMNLPVVFFVQNNQYAISVPRELQTRAQTLAQKAIAAGIPGVQVDGMDVLAVYHVMHEALERARNGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 2059 - DNA, 1086 bp, Alicyclobacillus acidocaldarius
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 2060 - protein, 355 aa, Bacillus halodurans C-125
LEKVEGQFETFQILNEEGEVVNEAAMPDLSDEQLQELMKRMVYTRIWDQRAISLNRQGRLGFYAPVAGQEASMLGSQFALDKEDWILPGYRDIPQIVFHGLPLYQAFLYSRGHFEGGQIPDGVNVLMPQIIIGAQIVQAAGVAMGLKRKGKQNVAITYTGDGGASQGDFYEGMNFAGAYNSPAIFVVQNNRFAISVPVEKQSAAKTIAQKAVAAGIEGIQVDGMDVLAVYAATKQARERALAGDGPTLIETLCYRYGPHTMAGDDPTRYRSSDLDDEWEKKDPLVRFRKFLEGKGLWSEEQENEVVEKAKEDIKAAIKKADAAPKQKVTDLIGFMFEEAPQHLREQLEEYTAKES

SEQ ID NO: 2061 - protein, 349 aa, Geobacillus stearothermophilus
QFPTFQILNEEGEVVNEEAMPELSDEQLKELMRRMVYTRILDQRSISLNRQGRLGFYAPTAGQEASQIASHFALEKEDFILPGYRDVPQIIWHGLPLYQAFLFSRGHFHGNQIPEGVNVLPPQIIIGAQYIQAAGVALGLKMRGKKAVAITYTGDGGTSQGDFYEGINFAGAFKAPAIFVVQNNRFAISTPVEKQTVAKTLAQKAVAAGIPGIQVDGMDPLAVYAAVKAARERAINGEGPTLIETLCFRYGPHTMSGDDPTRYRSKELENEWAKKDPLVRFRKFLEAKGLWSEEEENNVIEQAKEEIKEAIKKADETPKQKVTDLISIMFEELPFNLKEQYEIYKEKES

SEQ ID NO: 2062 - protein, 349 aa, Geobacillus stearothermophilus; identical to SEQ ID NO: 2061

SEQ ID NO: 2063 - protein, 344 aa, Bacillus amyloliquefaciens FZB42
QILNAEGEVVNKDAMPDLSDDQLKELMRRMVYIRILDQRSISLSRQGRLGFYAPTAGQEASQIASHFALEQDDFILPGYRDVPQLIWHGLPLHQAFLFSRGHFKGNQMPEGVNALSPQIIIGAQIIQTAGVALGLKKRGKKAVAITYTGDGGASQGDFYEGMNFAGAFKAPAIFVVQNNRYAISTPVEKQSSAQTIAQKAVAVGITGVQVDGMDALAVYAATAEARQRAINGEGPTLIETLTFRYGPHTMSGDDPTKYRTKEIENEWEQKDPLVRFRKFLENKGLWSEEEENKVIEQAKEEIKQAIKKADGESKPKVTELIENMFEEPTFNLKEQLEIYKAKES

SEQ ID NO: 2064 - protein, 349 aa, Geobacillus kaustophilus HTA426
QFPTFQILNEEGEIVNEEAMPELSDEQLKELMRRMVYTRILDQRSISLNRQGRLGFYAPTAGQEASQIASHFALEKEDFILPGYRDVPQIIWHGLPLYQAFLFSRGHFHGNQIPEGVNVLPPQIIIGAQYIQAAGVALGLKMRGKKAVAITYTGDGGTSQGDFYEGINFAGAFKAPAIFVVQNNRFAISTPVEKQTIAKTLAQKAVAAGIPGIQVDGMDPLAVYAAVKAARERAINGEGPALIETLCFRYGPHTMSGDDPTRYRSKELENEWAKKDPLVRFRKFLEAKGLWSEEEENRVIEQAKEDIKEAIKKADETPKQKVTDLISIMFEELPANLKEQYEIYKEKES

SEQ ID NO: 2065 - protein, 361 aa, Artificial
  Substituion in SEQ ID NO 2058
MTMLSQVVARFELPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKLRGEKRVAVTYTGDGGTSQGDFYEGMNFAGAMNLPVVFFVQNNQYAISVPRELQTRAQTLAQKAIAAGIPGVQVDGMDVLAVYHVMHEALERARNGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 2066 - protein, 361 aa, Artificial
  Substituion in SEQ ID NO 2058
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKIRGEKRVAVTYTGDGGTSQGDFYEGMNFAGAMNLPVVFFVQNNQYAISVPRELQTRAQTLAQKAIAAGIPGVQVDGMDVLAVYHVMHEALERARNGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 2067 - protein, 361 aa, Artificial
  Substituion in SEQ ID NO 2058
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKLRGEKRVAVTYTGDGGTSQGDFYEGMNFAGAMNLPVVFFVQNNQYAISVPRELQTRAQTLAQKAIAAGIPGIQVDGMDVLAVYHVMHEALERARNGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 2068 - protein, 361 aa, Artificial
  Substituion in SEQ ID NO 2058
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQIFLYSRGHQLGGKVPEGVNCMVPQIIIGAQIVQAAGVGLAFKLRGEKRVAVTYTGDGGTSQGDFYEGMNFAGAMNLPVVFFVQNNQYAISVPRELQTRAQTLAQKAIAAGIPGVQVDGMDVLAVYHVMHEALERARNGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 2069 - protein, 361 aa, Artificial
  Substituion in SEQ ID NO 2058
MTMLSQVVARFEIPYVQIVDENGNVVNPDLVPELSDDDLRELMKRMVFTRIWDQRAIRLSRQGRLGFYAPVSGQEASMIGSEFATKKEDFLLPGYRDIPQLYFHGYPLHQLFLYSRGHQLGGKVPEGVNCMVPQIIIGAQIVQAAGVGLAFKLRGEKRVAVTYTGDGGTSQGDFYEGMNFAGAMNLPVVFFVQNNNYAISVPRELQTRAQTLAQKAIAAGIPGVQVDGMDVLAVYHVMHEALERARNGEGPTMIEAVTFRYGPHTMSGDDPTRYRTKDVQEEWEKKDPLIRFRKYLEEKGLWSQEEEEAYIEEAKETVNNALKEADAAEKMTIPGLIDSMFEELTPTLKRQRAEFAGEEAN

SEQ ID NO: 2070 - DNA, 1086 bp, Artificial
  Substituion in SEQ ID NO 2059
gtgaccatgttgagccaggtggttgctcgttttgagttaccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 2071 - DNA, 1086 bp, Artificial
  Substituion in SEQ ID NO 2059
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagattcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 2072 - DNA, 1086 bp, Artificial
  Substituion in SEQ ID NO 2059
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcattcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 2073 - DNA, 1086 bp, Artificial
  Substituion in SEQ ID NO 2059
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagattttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaaccagtacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 2074 - DNA, 1086 bp, Artificial
  Substituion in SEQ ID NO 2059
gtgaccatgttgagccaggtggttgctcgttttgagatcccgtacgtccaaatcgtggacgagaacgggaacgtcgtgaaccctgacctggtcccggagttgtcggacgacgacctgcgcgagctcatgaagcgcatggtcttcacgcgcatctgggatcaacgcgcaattcgcctgtcccggcagggacgcctgggcttttacgcgccggtgtccggccaggaagcgtccatgatcggcagcgagttcgccacgaagaaagaggacttcctgctcccgggctatcgcgacatcccgcagctgtacttccacgggtatccgctgcatcagctcttcctttactcccgcggacatcagcttggcggcaaagttcctgaaggcgtcaactgtatggtgccgcagatcatcatcggagcgcaaatcgtccaggcggcgggcgtcggcctcgcgttcaagctgcgcggtgaaaagcgcgtggcggtcacgtacacgggcgacggcggcacgagccagggcgacttttacgaaggcatgaacttcgcgggcgccatgaatctccccgtggtgttctttgttcagaacaacaattacgccatttctgtgcctcgcgagcttcagactcgtgcgcagacgctcgctcagaaggccatcgcggccggcatccccggcgtgcaagtcgacggcatggacgtgttggccgtgtaccacgtgatgcacgaagcccttgagcgcgcgcgcaacggcgagggcccaaccatgattgaggccgtgaccttccgctacggcccccacacgatgtcgggcgacgatccgacccgttatcgcacgaaggacgtgcaggaagagtgggagaagaaggatccgctcatccgcttccgcaagtacctcgaggaaaagggactttggtctcaagaagaggaagaggcttacatcgaggaggccaaggagacggtcaacaacgccctcaaggaggcggatgcggcggagaagatgaccatcccgggtctcatcgactcgatgttcgaagaactcaccccgacgctcaagcgccagcgggcggaatttgccggcgaggaggcgaactga

SEQ ID NO: 2075 - protein, 334 aa, Alicyclobacillus acidocaldarius
MPARRRTDMAQMTMIQAITHALDLELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 2076 - DNA, 1005 bp, Alicyclobacillus acidocaldarius
ttgccggcgaggaggcgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 2077 - protein, 324 aa, Bacillus coagulans 36D1
MAQLTMIQAITDALRTELKNDENVLVFGEDVGVNGGVFRATEGLQKEFGKDRVIDTPLAESGINGLAIGLALQGFRPVPEIQFFGFVFETMDSIHGQMARYRFRTGGDLKMPITIRAPFGGGVHTPEMHADSLEGLMAQTPGIKVVIPSTPYDAKGLLISAIRDNDPVVFLEHMKLYRSFREEVPEEEYTIPLGKADVKREGKDISIIAYGAMVHESLKAADELEKEGYSAEVVDLRTVSPLDVETIVASVEKTNRAIVVQEAQRQAGVAANVVAEINERAILSLEAPVLRVTAPDTVYPFSQAEGVWIPTYKDILEKAKETLT

SEQ ID NO: 2078 - protein, 324 aa, Geobacillus stearothermophilus
MAQMTMVQAITDALRIELKNDPNVLIFGEDVGVNGGVFRATEGLQAEFGEDRVFDTPLAESGIGGLAIGLALQGFRPVPEIQFFGFVYEVMDSICGQMARIRYRTGGRYHMPITIRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVMN

SEQ ID NO: 2079 - protein, 324 aa, Geobacillus thermodenitrificans NG80-2
MAQMTMVQAITDALRIELKNDPNVLIFGEDVGVNGGVFRATEGLQAEFGEERVFDTPLAESGIGGLAVGLALQGFRPVPEIQFFGFVYEVMDSISGQMARIRYRTGGRYHMPITVRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVMN

SEQ ID NO: 2080 - protein, 323 aa, Geobacillus stearothermophilus
AQMTMVQAITDALRIELKNDPNVLIFGEDVGVNGGVFRATEGLQAEFGEDRVFDTPLAESGIGGLAIGLALQGFRPVPEIQFFGFVYEVMDSICGQMARIRYRTGGRYHMPITIRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVMN

SEQ ID NO: 2081 - protein, 324 aa, Geobacillus kaustophilus HTA426
MAQMTMVQAITDALRIEMRNDPNVLVFGEDVGVNGGVFRVTEGLQAEFGEERVFDTPLAESGIGGLAIGLALQGFRPVPEIQFFGFVYEAMDAICGQMARIRYRTGGRYHVPITIRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVIN

SEQ ID NO: 2082 - protein, 334 aa, Artificial
  Substituion in SEQ ID NO 2075
MPARRRTDMAQMTMIQAITHALDIELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 2083 - protein, 334 aa, Artificial
  Substituion in SEQ ID NO 2075
MPARRRTDMAQMTMIQAITHALDLELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRNEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 2084 - protein, 334 aa, Artificial
  Substituion in SEQ ID NO 2075
MPARRRTDMAQMTMIQAITHALDLELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTIDKVMSL

SEQ ID NO: 2085 - protein, 334 aa, Artificial
  Substituion in SEQ ID NO 2075
MPARKRTDMAQMTMIQAITHALDLELARDERVLVFGEDVGKNGGVFRATEGLQQKYGPNRVFDTPLAESGIIGLANGLAIQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 2086 - protein, 334 aa, Artificial
  Substituion in SEQ ID NO 2075
MPARRRTDMAQMTMIQAITHALDLELARDERVLVFGEDVGKNGGVFRATEGLQQKYGPNRVFDTPLAESGIIGLANGLALQGFRPVPEIQFFGFVFEAFDQIAGQLARTRYRTGGRYTAPVTIRSPFGGGVHTPEMHADSLEGLFVQTPGIKVVIPSTPYDAKGLLLSAIRDPDPVIFLEHMKLYRSFRQEVPEDDYTIPLGVANVVREGKHATVIAYGAMVHVALKAAEQWSKEKGLEAEVIDLRTVNPIDIDTIVASVKKTNRAIVVQEAQRSAGAAAEIVAQINENAIYYLEAPVLRATPPDTVYPFGMIEDEWLPTPEYVLKTLDKVMSL

SEQ ID NO: 2087 - DNA, 1005 bp, Artificial
  Substituion in SEQ ID NO 2076
ttgccggcgaggaggcgaactgacatggcgcagatgacgatgattcaggcgatcacgcacgccctcgatattgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 2088 - DNA, 1005 bp, Artificial
  Substituion in SEQ ID NO 2076
ttgccggcgaggaggcgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgcaatgaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 2089 - DNA, 1005 bp, Artificial
  Substituion in SEQ ID NO 2076
ttgccggcgaggaggcgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgattgataaagtcatgagcttataa

SEQ ID NO: 2090 - DNA, 1005 bp, Artificial
  Substituion in SEQ ID NO 2076
ttgccggcgaggaaacgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgattcaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 2091 - DNA, 1005 bp, Artificial
  Substituion in SEQ ID NO 2076
ttgccggcgaggaggcgaactgacatggcgcagatgacgatgattcaggcgatcacgcacgccctcgatctcgaactggcgcgcgacgagcgcgtgctcgtcttcggcgaggacgtcggcaaaaacggcggcgtcttccgcgcgaccgaaggcctgcagcagaaatacgggcccaaccgcgtgttcgacacgccgctcgcggagagtggcatcatcggactggccaacggccttgcgttacaagggtttcgccccgtacccgaaattcagttttttgggtttgtcttcgaggcgttcgaccagatcgcgggtcagctggcgcgcacgaggtatcgcaccggcggccgctacaccgcgcctgtgaccatccgttctccgttcggcggcggggtgcacacgcccgaaatgcacgcggattccctggaaggcctgtttgttcaaacaccgggcatcaaggtggtgattccgagcacgccctacgacgccaagggactgctgctgtcggccattcgggacccggatccagtcatcttcctggaacacatgaaactgtatcgctcgttccgccaggaagtgccggaggacgattacaccatcccgctcggcgtcgcgaacgtggtccgagagggcaagcatgccaccgtcatcgcctatggggccatggtgcacgtggcgctgaaggccgcggaacagtggtcgaaagaaaagggcctcgaggccgaggtcatcgatcttcgcaccgtcaacccgattgacatcgataccatcgtggcgtcggtcaagaagacgaaccgcgccatcgtcgtgcaggaagctcagcgttcggcgggcgccgcggccgagatcgtcgcgcaaatcaacgaaaacgcgatttactacttggaagcaccggttctccgcgcaacgccgcccgacacggtgtatccgtttggtatgattgaggacgaatggttgccgacacccgagtatgtcctcaagacgctcgataaagtcatgagcttataa

SEQ ID NO: 2092 - protein, 436 aa, Alicyclobacillus acidocaldarius
MAVVEFRLPELGEGLHEGRISKWLVQPGDTVQEDDPIAEVENDKSLVELPSPVSGKVKEIKVPEGTTCVVGDVLLTFEVEGDAPAEAGADEKPTDKSAQKAEADAHQNAKADEAPAAKPAPDAAKADTQESAAHEVLATPAVRKYAREQGVDIRTVKGTGNHGKVTKEDIDRAKSGTQAPQQAAEDKEQRPAQAQQAPAAYGEEYEERVPMPMIRQAIARAMVKSKYTAPHVTLMDEVDVTELVKLRNEVKPLAQERGIKITYLPFIVKALIAALRTKPQLNASYDEEKQELVIKHYYHIGIATDTERGLLVPVVRHADRKNIWTIAQEINDLATRGRAGKLKPEEMKGSTISITNIGSAGGLFFTPIINYPEVAILGVGRITEKPIIKNGEFAVGQMMSLSLSFDHRVIDGALGQQFINDIKRLLENPRLLLLEV

SEQ ID NO: 2093 - DNA, 1311 bp, Alicyclobacillus acidocaldarius
atggccgttgttgaatttcgcctacctgagcttggcgaagggctgcacgaaggccgcatcagcaagtggctcgtccaacccggcgacacggtgcaagaggacgacccgattgcggaagtcgaaaacgacaagtcgctcgtggagcttccctcgccggtgagcggaaaagtgaaggagatcaaggtgccggagggcacgacgtgcgtggtcggagacgtgctgttgacgtttgaggtggaaggggacgcacccgccgaggccggggcggacgaaaagccgaccgacaagagcgcgcagaaggccgaggcagacgcgcatcaaaacgcgaaggcggacgaggcgcccgcagccaagcccgcgcccgacgcggcgaaggcagatacccaggagtccgccgcgcacgaggtgctcgccacacccgcggtccgcaagtacgctcgcgaacaaggtgtggatatccgcaccgtcaagggcaccggcaaccacggcaaggtgaccaaggaggatatcgaccgcgccaaatctggcactcaagctcctcagcaggcggccgaggataaagagcagcggcctgcgcaagcgcagcaggcaccggcggcgtacggcgaggaatatgaggaacgcgtgcccatgccgatgatccgccaggccatcgcccgcgccatggtgaagtcgaaatatacggcgccgcacgtcacgctcatggacgaggtggacgtcacggagcttgtgaaactgcgcaacgaggtcaagcccctcgcgcaggagcgcggcatcaagatcacgtatctgccgttcatcgtgaaggcgctcatcgcggcgcttcgcaccaagccgcagctgaatgcatcctacgacgaggagaagcaggaactcgtcatcaaacactattaccacatcggcatcgcgaccgacaccgagcgcggattgctcgtgcccgtggtgcgacacgcggaccggaagaacatctggaccattgcccaagagatcaacgatctcgccacgcgcgggcgcgccggaaagctcaagcccgaggagatgaagggcagcaccatttccatcacgaatatcggatcggcaggcggcttgttcttcacccccattatcaattaccctgaagttgcgattctgggcgtcggccggatcacggagaagccgatcatcaagaacggcgaattcgctgtgggccagatgatgtccttgtcgctgagcttcgaccaccgcgtgatcgatggcgcgctcggtcagcagttcatcaacgacatcaagcgcttgcttgaaaatccgcgcttgctgctcctggaggtgtga

SEQ ID NO: 2094 - protein, 418 aa, Geobacillus stearothermophilus
EFKLPDIGEGIHEGEIVKWFVKPGDEVNEDDVLCEVQNDKAVVEIPSPVKGKVLEILVPEGTVATVGQTLITLDAPGYENMTFKGQEHEEVKKEEKAETVSKKEMVETAAPSAPAAEAEADPNRRVIAMPSVRKYAREKGVDIRLVQGTGKNGRILKEDIDAFLAGGAKAAAEPTPQAAEEKAAPQAPAAKPVVPEGEFPETREKMSGIRRAIAKAMVHSKHTAPHVTLMDEADVTKLVAHRKKFKAIAAEKGIKLTFLPYVVKALVSALREYPVLNTSIDDATEEIIHKHYYNIGIAADTDRGLLVPVIKHADRKPIFALAKEINELAEKAREGKLMPNEMKGASCTITNIGSAGGQWFTPVINHPEVAILGIGRIAEKPIVRDGEIVAAPMLALSLSFDHRMIDGATAQKALNHIK

SEQ ID NO: 2095 - protein, 418 aa, Geobacillus kaustophilus HTA426
EFKLPDIGEGIHEGEIVKWFVKPGDEVNEDDVLCEVQNDKAVVEIPSPVKGKVLEILVPEGTVATVGQTLITLDAPGYENMTFKGQEHEEVKKEEKAETVSKKEMVEIAAPSAPAAEAEADPNRRVIAMPSVRKYAREKGVDIRLVQGTGKNGRILKEDIDAFLAGGAKAAAEPTPQAAEEKAAPQAPAAKPVVPEGEFPETREKMSGIRRAIAKAMVHSKHTAPHVTLMDEADVTKLVAHRKKFKAIAAEKGIKLTFLPYVVKALVSALREYPVLNTSIDDATEEIIHKHYYNIGIAADTDRGLLVPVIKHADRKPIFALAKEINELAEKAREGKLMPNEMKGASCTITNIGSAGGQWFTPVINHPEVAILGIGRIAEKPIVRDGEIVAAPVLALSLSFDHRMIDGATAQKALNHIK

SEQ ID NO: 2096 - protein, 412 aa, Geobacillus stearothermophilus
EFKLPDIGEGIHEGEIVKWFVKPGDEVNEDDVLCEVQNDKAVVEIPSPVKGKVLEILVPEGTVATVGQTLITLDAPGYENMTFKGQEQEEAKKEEKTETVSKEEKVDAVAPNAPAAEAEAGPNRRVIAMPSVRKYAREKGVDIRLVQGTGKNGRVLKEDIDAFLAGGAKPAPAAAEEKAAPAAAKPATTEGEFPETREKMSGIRRAIAKAMVHSKHTAPHVTLMDEADVTKLVAHRKKFKAIAAEKGIKLTFLPYVVKALVSALREYPVLNTSIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIK

SEQ ID NO: 2097 - protein, 421 aa, Bacillus coagulans 36D1
EFRLPDIGEGIHEGEIVKWFIKPGDKVSEDDVLCEVQNDKSVVEIPSPVEGTVEDILVEEGSVAVVGDVLVKFDAPGYENLKFKGDHGQDQKEEAAESAKPEPAKPEPAKQETAETAKPAEKEAEHGSESADRRVIAMPSVRKYAREKGVDIQLVSGTGKNGRVLREDIDAYVNGPQQPEAETGKTEAQAPASQNAIPEGEFPETREPMSGIRKVIAKAMVNSKQTAPHVTLMDDVDVTALVAHRKKFKEIAAEKGIKLTFLPYVVKALVSTLREYPVLNSSIDDETNEIIHKHYYNIGIAADTERGLLVPVVKHADRKPVFAVSKEINELAEKARDGKLAPNEMKGASITISNIGSAGGQWFTPVINRPEVAILGIGRIAEKPVVKNGEIVAAPVLALSLSFDHRIIDGATAQNALNHIK

SEQ ID NO: 2098 - protein, 420 aa, Geobacillus thermodenitrificans NG80-2
EFKLPDIGEGIHEGEIVKWFVKPGDEVNEDDVLCEVQNDKAVVEIPSPVKGKVLEILVPEGTVATVGQTLITLDAPGYENMTFKGQEHEEEAKKEEKTETVSKEESVGATAPAAAAEAAAEADPNRRVIAMPSVRKYAREKGVDIRLVQGTGKNGRILKEDIDAFLAGGAKAAAQPAPAAEAEEKAAPQAAATPVVPEGEFPETREKMSGIRRAIAKAMVNSKHTAPHVTLMDEVDVTKLVAHRKKFKAIAAEKGIKLTFLPYVVKALVSALREYPTLNTSIDDQTEEIIHKHYYNIGIAADTDRGLLVPVIKHADRKPIFALAQEINELAVKARDGKLAPNEMKGASCTITNIGSAGGQWFTPVINHPEVAILGIGRIAEKPIVRDGEIVAAPVLALSLSFDHRMIDGATAQKALNHVK

SEQ ID NO: 2099 - protein, 436 aa, Artificial
  Substituion in SEQ ID NO 2092
MAVVEFRLPELGEGLHEGRISKWLVQPGDTVQEDDPIAEVENDKSLVELPSPVSGRVKEIKVPEGTTCVVGDVLLTFEVEGDAPAEAGADEKPTDKSAQKAEADAHQNAKADEAPAAKPAPDAAKADTQESAAHEVLATPAVRKYAREQGVDIRTVKGTGNHGKVTKEDIDRAKSGTQAPQQAAEDKEQRPAQAQQAPAAYGEEYEERVPMPMIRQAIARAMVKSKYTAPHVTLMDEVDVTELVKLRNEVKPLAQERGIKITYLPFIVKALIAALRTKPQLNASYDEEKQELVIKHYYHIGIATDTERGLLVPVVRHADRKNIWTIAQEINDLATRGRAGKLKPEEMKGSTISITNIGSAGGLFFTPIINYPEVAILGVGRITEKPIIKNGEFAVGQMMSLSLSFDHRVIDGALGQQFINDIKRLLENPRLLLLEV

SEQ ID NO: 2100 - protein, 436 aa, Artificial
  Substituion in SEQ ID NO 2092
MAVVEFRLPELGEGLHEGRISKWLVQPGDTVQEDDPIAEVENDKSLVELPSPVSGKVKEIKVPEGTTCVVGDVLLTFEVEGDAPAEAGADEKPTDKSAQKAEADAHQNAKADEAPAAKPAPDAAKADTQESAAHEVLATPAVRKYAREQGVDIRTVKGTGNHGKVTKEDIDRAKSGTQAPQQAAEDKEQRPAQAQQAPAAYGEEYEDRVPMPMIRQAIARAMVKSKYTAPHVTLMDEVDVTELVKLRNEVKPLAQERGIKITYLPFIVKALIAALRTKPQLNASYDEEKQELVIKHYYHIGIATDTERGLLVPVVRHADRKNIWTIAQEINDLATRGRAGKLKPEEMKGSTISITNIGSAGGLFFTPIINYPEVAILGVGRITEKPIIKNGEFAVGQMMSLSLSFDHRVIDGALGQQFINDIKRLLENPRLLLLEV

SEQ ID NO: 2101 - protein, 436 aa, Artificial
  Substituion in SEQ ID NO 2092
MAVVEFRLPELGEGLHEGRISKWLVQPGDTVQEDDPIAEVENDKSLVELPSPVSGKVKEIKVPEGTTCVVGDVLLTFEVEGDAPAEAGADEKPTDKSAQKAEADAHQNAKADEAPAAKPAPDAAKADTNESAAHEVLATPAVRKYAREQGVDIRTVKGTGNHGKVTKEDIDRAKSGTQAPQQAAEDKEQRPAQAQQAPAAYGEEYEERVPMPMIRQAIARAMVKSKYTAPHVTLMDEVDVTELVKLRNEVKPLAQERGIKITYLPFIVKALIAALRTKPQLNASYDEEKQELVIKHYYHIGIATDTERGLLVPVVRHADRKNIWTIAQEINDLATRGRAGKLKPEEMKGSTISITNIGSAGGLFFTPIINYPEVAILGVGRITEKPIIKNGEFAVGQMMSLSLSFDHRVIDGALGQQFINDIKRLLENPRLLLLEV

SEQ ID NO: 2102 - protein, 436 aa, Artificial
  Substituion in SEQ ID NO 2092
MAVVEFRLPELGEGLHEGRISKWLVQPGDTVQEDDPIAEVENDKSLVELPSPVSGKVKEIKVPEGTTCVVGDVLLTFEVEGDAPAEAGADEKPTDKSAQKAEADAHQNAKADEAPAAKPAPDAAKADTQESAAHEVLATPAVRKYAREQGVDIRTVKGTGNHGKVTKEDIDRAKSGTQAPQQAAEDKEQRPAQAQQAPAAYGEEYEERVPMPMIRQAIARAMVKSKYTAPHVTLMDEVDVTELVKLRNEVKPLAQERGIKITYLPFIVKALIAALRTKPQLNASYDEEKQELVIKHYYHIGIATDTERGLLVPVVRHADRKNIWTIAQEINDLATRGRAGKLKPEEMKGSTISITNIGSAGGLFFTPIINYPEVAILGVGRITEKPIIKNGEFAVGQMMSLSLSFDHRVIDGALGQQFINDIKRLIENPRLLLLEV

SEQ ID NO: 2103 - protein, 436 aa, Artificial
  Substituion in SEQ ID NO 2092
MAVVEFRLPELGEGLHEGRISKWLVQPGDTVQEDDPIAEVENDKSLVELPSPVSGKVKEIKVPEGTTCVVGDVLLTFEVEGDAPAEAGADEKPTDKSAQKAEADAHQNAKADEAPAAKPAPDAAKADTQESAAHEVLATPAVRKYAREQGVDIKTVKGTGNHGKVTKEDIDRAKSGTQAPQQAAEDKEQRPAQAQQAPAAYGEEYEERVPMPMIRQAIARAMVKSKYTAPHVTLMDEVDVTELVKLRNEVKPLAQERGIKITYLPFIVKALIAALRTKPQLNASYDEEKQELVIKHYYHIGIATDTERGLLVPVVRHADRKNIWTIAQEINDLATRGRAGKLKPEEMKGSTISITNIGSAGGLFFTPIINYPEVAILGVGRITEKPIIKNGEFAVGQMMSLSLSFDHRVIDGALGQQFINDIKRLLENPRLLLLEV

SEQ ID NO: 2104 - DNA, 1311 bp, Artificial
  Substituion in SEQ ID NO 2093
atggccgttgttgaatttcgcctacctgagcttggcgaagggctgcacgaaggccgcatcagcaagtggctcgtccaacccggcgacacggtgcaagaggacgacccgattgcggaagtcgaaaacgacaagtcgctcgtggagcttccctcgccggtgagcggacgtgtgaaggagatcaaggtgccggagggcacgacgtgcgtggtcggagacgtgctgttgacgtttgaggtggaaggggacgcacccgccgaggccggggcggacgaaaagccgaccgacaagagcgcgcagaaggccgaggcagacgcgcatcaaaacgcgaaggcggacgaggcgcccgcagccaagcccgcgcccgacgcggcgaaggcagatacccaggagtccgccgcgcacgaggtgctcgccacacccgcggtccgcaagtacgctcgcgaacaaggtgtggatatccgcaccgtcaagggcaccggcaaccacggcaaggtgaccaaggaggatatcgaccgcgccaaatctggcactcaagctcctcagcaggcggccgaggataaagagcagcggcctgcgcaagcgcagcaggcaccggcggcgtacggcgaggaatatgaggaacgcgtgcccatgccgatgatccgccaggccatcgcccgcgccatggtgaagtcgaaatatacggcgccgcacgtcacgctcatggacgaggtggacgtcacggagcttgtgaaactgcgcaacgaggtcaagcccctcgcgcaggagcgcggcatcaagatcacgtatctgccgttcatcgtgaaggcgctcatcgcggcgcttcgcaccaagccgcagctgaatgcatcctacgacgaggagaagcaggaactcgtcatcaaacactattaccacatcggcatcgcgaccgacaccgagcgcggattgctcgtgcccgtggtgcgacacgcggaccggaagaacatctggaccattgcccaagagatcaacgatctcgccacgcgcgggcgcgccggaaagctcaagcccgaggagatgaagggcagcaccatttccatcacgaatatcggatcggcaggcggcttgttcttcacccccattatcaattaccctgaagttgcgattctgggcgtcggccggatcacggagaagccgatcatcaagaacggcgaattcgctgtgggccagatgatgtccttgtcgctgagcttcgaccaccgcgtgatcgatggcgcgctcggtcagcagttcatcaacgacatcaagcgcttgcttgaaaatccgcgcttgctgctcctggaggtgtga

SEQ ID NO: 2105 - DNA, 1311 bp, Artificial
  Substituion in SEQ ID NO 2093
atggccgttgttgaatttcgcctacctgagcttggcgaagggctgcacgaaggccgcatcagcaagtggctcgtccaacccggcgacacggtgcaagaggacgacccgattgcggaagtcgaaaacgacaagtcgctcgtggagcttccctcgccggtgagcggaaaagtgaaggagatcaaggtgccggagggcacgacgtgcgtggtcggagacgtgctgttgacgtttgaggtggaaggggacgcacccgccgaggccggggcggacgaaaagccgaccgacaagagcgcgcagaaggccgaggcagacgcgcatcaaaacgcgaaggcggacgaggcgcccgcagccaagcccgcgcccgacgcggcgaaggcagatacccaggagtccgccgcgcacgaggtgctcgccacacccgcggtccgcaagtacgctcgcgaacaaggtgtggatatccgcaccgtcaagggcaccggcaaccacggcaaggtgaccaaggaggatatcgaccgcgccaaatctggcactcaagctcctcagcaggcggccgaggataaagagcagcggcctgcgcaagcgcagcaggcaccggcggcgtacggcgaggaatatgaggatcgcgtgcccatgccgatgatccgccaggccatcgcccgcgccatggtgaagtcgaaatatacggcgccgcacgtcacgctcatggacgaggtggacgtcacggagcttgtgaaactgcgcaacgaggtcaagcccctcgcgcaggagcgcggcatcaagatcacgtatctgccgttcatcgtgaaggcgctcatcgcggcgcttcgcaccaagccgcagctgaatgcatcctacgacgaggagaagcaggaactcgtcatcaaacactattaccacatcggcatcgcgaccgacaccgagcgcggattgctcgtgcccgtggtgcgacacgcggaccggaagaacatctggaccattgcccaagagatcaacgatctcgccacgcgcgggcgcgccggaaagctcaagcccgaggagatgaagggcagcaccatttccatcacgaatatcggatcggcaggcggcttgttcttcacccccattatcaattaccctgaagttgcgattctgggcgtcggccggatcacggagaagccgatcatcaagaacggcgaattcgctgtgggccagatgatgtccttgtcgctgagcttcgaccaccgcgtgatcgatggcgcgctcggtcagcagttcatcaacgacatcaagcgcttgcttgaaaatccgcgcttgctgctcctggaggtgtga

SEQ ID NO: 2106 - DNA, 1311 bp, Artificial
  Substituion in SEQ ID NO 2093
atggccgttgttgaatttcgcctacctgagcttggcgaagggctgcacgaaggccgcatcagcaagtggctcgtccaacccggcgacacggtgcaagaggacgacccgattgcggaagtcgaaaacgacaagtcgctcgtggagcttccctcgccggtgagcggaaaagtgaaggagatcaaggtgccggagggcacgacgtgcgtggtcggagacgtgctgttgacgtttgaggtggaaggggacgcacccgccgaggccggggcggacgaaaagccgaccgacaagagcgcgcagaaggccgaggcagacgcgcatcaaaacgcgaaggcggacgaggcgcccgcagccaagcccgcgcccgacgcggcgaaggcagataccaatgagtccgccgcgcacgaggtgctcgccacacccgcggtccgcaagtacgctcgcgaacaaggtgtggatatccgcaccgtcaagggcaccggcaaccacggcaaggtgaccaaggaggatatcgaccgcgccaaatctggcactcaagctcctcagcaggcggccgaggataaagagcagcggcctgcgcaagcgcagcaggcaccggcggcgtacggcgaggaatatgaggaacgcgtgcccatgccgatgatccgccaggccatcgcccgcgccatggtgaagtcgaaatatacggcgccgcacgtcacgctcatggacgaggtggacgtcacggagcttgtgaaactgcgcaacgaggtcaagcccctcgcgcaggagcgcggcatcaagatcacgtatctgccgttcatcgtgaaggcgctcatcgcggcgcttcgcaccaagccgcagctgaatgcatcctacgacgaggagaagcaggaactcgtcatcaaacactattaccacatcggcatcgcgaccgacaccgagcgcggattgctcgtgcccgtggtgcgacacgcggaccggaagaacatctggaccattgcccaagagatcaacgatctcgccacgcgcgggcgcgccggaaagctcaagcccgaggagatgaagggcagcaccatttccatcacgaatatcggatcggcaggcggcttgttcttcacccccattatcaattaccctgaagttgcgattctgggcgtcggccggatcacggagaagccgatcatcaagaacggcgaattcgctgtgggccagatgatgtccttgtcgctgagcttcgaccaccgcgtgatcgatggcgcgctcggtcagcagttcatcaacgacatcaagcgcttgcttgaaaatccgcgcttgctgctcctggaggtgtga

SEQ ID NO: 2107 - DNA, 1311 bp, Artificial
  Substituion in SEQ ID NO 2093
atggccgttgttgaatttcgcctacctgagcttggcgaagggctgcacgaaggccgcatcagcaagtggctcgtccaacccggcgacacggtgcaagaggacgacccgattgcggaagtcgaaaacgacaagtcgctcgtggagcttccctcgccggtgagcggaaaagtgaaggagatcaaggtgccggagggcacgacgtgcgtggtcggagacgtgctgttgacgtttgaggtggaaggggacgcacccgccgaggccggggcggacgaaaagccgaccgacaagagcgcgcagaaggccgaggcagacgcgcatcaaaacgcgaaggcggacgaggcgcccgcagccaagcccgcgcccgacgcggcgaaggcagatacccaggagtccgccgcgcacgaggtgctcgccacacccgcggtccgcaagtacgctcgcgaacaaggtgtggatatccgcaccgtcaagggcaccggcaaccacggcaaggtgaccaaggaggatatcgaccgcgccaaatctggcactcaagctcctcagcaggcggccgaggataaagagcagcggcctgcgcaagcgcagcaggcaccggcggcgtacggcgaggaatatgaggaacgcgtgcccatgccgatgatccgccaggccatcgcccgcgccatggtgaagtcgaaatatacggcgccgcacgtcacgctcatggacgaggtggacgtcacggagcttgtgaaactgcgcaacgaggtcaagcccctcgcgcaggagcgcggcatcaagatcacgtatctgccgttcatcgtgaaggcgctcatcgcggcgcttcgcaccaagccgcagctgaatgcatcctacgacgaggagaagcaggaactcgtcatcaaacactattaccacatcggcatcgcgaccgacaccgagcgcggattgctcgtgcccgtggtgcgacacgcggaccggaagaacatctggaccattgcccaagagatcaacgatctcgccacgcgcgggcgcgccggaaagctcaagcccgaggagatgaagggcagcaccatttccatcacgaatatcggatcggcaggcggcttgttcttcacccccattatcaattaccctgaagttgcgattctgggcgtcggccggatcacggagaagccgatcatcaagaacggcgaattcgctgtgggccagatgatgtccttgtcgctgagcttcgaccaccgcgtgatcgatggcgcgctcggtcagcagttcatcaacgacatcaagcgcttgattgaaaatccgcgcttgctgctcctggaggtgtga

SEQ ID NO: 2108 - DNA, 1311 bp, Artificial
  Substituion in SEQ ID NO 2093
atggccgttgttgaatttcgcctacctgagcttggcgaagggctgcacgaaggccgcatcagcaagtggctcgtccaacccggcgacacggtgcaagaggacgacccgattgcggaagtcgaaaacgacaagtcgctcgtggagcttccctcgccggtgagcggaaaagtgaaggagatcaaggtgccggagggcacgacgtgcgtggtcggagacgtgctgttgacgtttgaggtggaaggggacgcacccgccgaggccggggcggacgaaaagccgaccgacaagagcgcgcagaaggccgaggcagacgcgcatcaaaacgcgaaggcggacgaggcgcccgcagccaagcccgcgcccgacgcggcgaaggcagatacccaggagtccgccgcgcacgaggtgctcgccacacccgcggtccgcaagtacgctcgcgaacaaggtgtggatatcaaaaccgtcaagggcaccggcaaccacggcaaggtgaccaaggaggatatcgaccgcgccaaatctggcactcaagctcctcagcaggcggccgaggataaagagcagcggcctgcgcaagcgcagcaggcaccggcggcgtacggcgaggaatatgaggaacgcgtgcccatgccgatgatccgccaggccatcgcccgcgccatggtgaagtcgaaatatacggcgccgcacgtcacgctcatggacgaggtggacgtcacggagcttgtgaaactgcgcaacgaggtcaagcccctcgcgcaggagcgcggcatcaagatcacgtatctgccgttcatcgtgaaggcgctcatcgcggcgcttcgcaccaagccgcagctgaatgcatcctacgacgaggagaagcaggaactcgtcatcaaacactattaccacatcggcatcgcgaccgacaccgagcgcggattgctcgtgcccgtggtgcgacacgcggaccggaagaacatctggaccattgcccaagagatcaacgatctcgccacgcgcgggcgcgccggaaagctcaagcccgaggagatgaagggcagcaccatttccatcacgaatatcggatcggcaggcggcttgttcttcacccccattatcaattaccctgaagttgcgattctgggcgtcggccggatcacggagaagccgatcatcaagaacggcgaattcgctgtgggccagatgatgtccttgtcgctgagcttcgaccaccgcgtgatcgatggcgcgctcggtcagcagttcatcaacgacatcaagcgcttgcttgaaaatccgcgcttgctgctcctggaggtgtga

SEQ ID NO: 2109 - protein, 252 aa, Alicyclobacillus acidocaldarius
MPHTPSGQTTVRAVERALDILLLFTHSPRAWSLSEIARATGLHKSTVHRLLLALQQKGFVRRESESDRYVLGWSLYGLGANAALHDRWSDAAKPILRRLRDETNETVSLYVRNGLERIRILAVESLQPIRNVASVGERYPLTIGASGKVLLAFSNSAVIEAACHPDRLPNGVRQVDLRQQLEAIRREGYALSRQERDAGAAAIAAPVLNEDGSCLYAIAVSGPVERMTEDKMRDMVTPLKRAAEELSERLAE

SEQ ID NO: 2110 - DNA, 759 bp, Alicyclobacillus acidocaldarius
atgccgcatacgccaagtgggcagaccacggtacgggccgtcgaacgggccctcgacatcctgttgctcttcacacattcgcctcgcgcatggagcttgagcgagatcgcgcgagccacggggcttcacaagagcacggttcaccgcctgctcctggccctccagcagaagggattcgttcgccgtgagtcggagtcggatcgctatgtgctcggatggagcctgtacggcctcggggccaatgcagccctccacgatcgctggtccgacgcggccaaacccattctgcgccgcctgcgcgacgagacgaacgagacggtcagtctctacgtgcgcaacggcctggagcgaattcggatcttggcagtcgagagcctgcagcccattcggaacgtggcatccgtgggtgagcgatatccgctcaccatcggcgcctcgggcaaggtcctgctcgccttctcgaattcggccgtgatcgaggcggcatgccatcccgaccggctgccgaatggcgtccggcaagtggacctccgccaacagctcgaggccattcgccgcgagggctacgcgctctcaaggcaagagcgggacgcgggcgcggcggccatcgcggctcccgtcttgaacgaggacggatcgtgcctgtacgcgattgcggtatcgggacccgtggagcgcatgacggaggacaagatgagggacatggtcacgccgttgaagcgggccgccgaggagttgtccgagcggctggccgaatag

SEQ ID NO: 2111 - protein, 223 aa, Paenibacillus larvae subsp. larvae BRL-230010
TVRSVERALDILLCFRDSSELTLTEISNQAGLHKSTVHRLLASLEGKGFLLRDSSGDKYRLGFSVWELSANLSQGDDISMLLLPEMEWLRDQVGETISIYVRDGKERVRIQAVQSKHAIRRVAPVGARMPLYVGASSKVLVAFGDEALQVELAHDARSSVGLDPTAFLKQLAETREQGFATSMEEREPGAAALSAPILNRSGKLVAALAISGPISRLTPEQMQ

SEQ ID NO: 2112 - protein, 218 aa, Symbiobacterium thermophilum IAM 14863
MERALDVLLCFAGERGGLGVTQIAEKLGLYKSTVHRILAALESRGFVRRDPATGRYHLGLRALELAQVYLSSGDLPTIALGEMLQLRDLAQETVSLYVRDGAERVRVQRAEGPLTVRRVVGLGERLPLYLGASGKVLLAWCPPEERARILDAQLPAGFDRTALEARLAEAREQGWALSLEEREEGVASVAAPVIDRAGRCVAALAISGPVSRFTDDRV

SEQ ID NO: 2113 - protein, 222 aa, Oceanobacillus iheyensis HTE831
MNDSPKGIRTLQRSIDILNCFIEKNSELTLTEISLYTGLAKSTTTRLLSTLEMNNFVEKDEVNAKYRLGKQIYFLGFVAGQTFELNSLAKSTMERLREQTKETVNLYILDGKHRVCVQQFESLQSVKHMISVGQKLPLTVGASGKVFLAYQSKEFIEDAMDTQPLKKSKVDLKNELDLIIKEKYAVSIEERESGTSAAAAPIFNFQNEVVAVLSVSGPASRL

SEQ ID NO: 2114 - protein, 221 aa, Geobacillus thermodenitrificans NG80-2
LRTVQRAIDILYCFTLEEQELSLTEIANKISLAKSTTTRLLATLEQNRLVIKNPETLKYRLGQGLYYLGHIAGKSIEVREIAKPVMERLRNETRETVNLYVLEQGARVCIEQYEGLQSLRHMVKIGERLPLWAGAGGKVLLAYQSPSFQERILAQVPTEERRTRLTAELEMIRQRGSTSSIDEREVGSAAVAAPIFNIHGEVNACLSISGPTHRFTPQAIR

SEQ ID NO: 2115 - protein, 227 aa, Rubrobacter xylanophilus DSM 9941
AAVRVADVLLLFASGPDALGVSEISRRLGLSKAVVHRILRSLASRGLVSHDAESRSYGLGPAAAALGARALAGLELRRVALPVLRRLQRETGETTTLSELVGTARVYLDQVPSLKEIKMTVEVGRPFPLHAGASSKAILAFAPPEVREHVLEGPLEALTPLTVTDRARLEVELGQIRESGTAVSCGERQSGAGSVAAPVIGVDGYAVGSISVCGPVDRFGEETVERM

SEQ ID NO: 2116 - protein, 252 aa, Artificial
  Substituion in SEQ ID NO 2109
MPHTPSGQTTVRAVERALDILLLFTHSPRAWSLSEIARATGLHKSTVHRLLLALQQKGFVRRESESDRYVLGWSLYGLGANAALHDRWSDAAKPILRRLRDETNETVSLYVRNGLERIRILAVESLQPIRNVASVGERYPLTIGASGKVLLAFSNSAVIEAACHPDRLPNGVRQVDLRQQLEAIRREGYALSRQERDAGAAAIAAPVLNEDGSCLYAIAVSGPVERMTEDKMREMVTPLKRAAEELSERLAE

SEQ ID NO: 2117 - protein, 252 aa, Artificial
  Substituion in SEQ ID NO 2109
MPHTPSGQTTVRAVERALDILLLFTHSPRAWSLSEIARATGLHKSTVHRLLLALQQKGFVRRESESDRYVLGWSLYGLGANAALHDRWSDAAKPILRRLRDETNETVSLYVRNGLERIRILAVESLQPIRNVASVGERYPLTIGASGKVLLAFSNSAVIEAACHPDRLPNGVRQVDLRQQLEAIRREGYAISRQERDAGAAAIAAPVLNEDGSCLYAIAVSGPVERMTEDKMRDMVTPLKRAAEELSERLAE

SEQ ID NO: 2118 - protein, 252 aa, Artificial
  Substituion in SEQ ID NO 2109
MPHTPSGQTTVRAVERALDILLLFTHSPRAWSLSEIARATGLHKSTVHRLLLALQQKGFVRRESESDRYVLGWSLYGLGANAALHDRWSDAAKPILRRLRDETNETVSLYVRNGLERIRILAVESLQPIRNVASVGERYPLTIGASGKVLLAFSQSAVIEAACHPDRLPNGVRQVDLRQQLEAIRREGYALSRQERDAGAAAIAAPVLNEDGSCLYAIAVSGPVERMTEDKMRDMVTPLKRAAEELSERLAE

SEQ ID NO: 2119 - protein, 252 aa, Artificial
  Substituion in SEQ ID NO 2109
MPHTPSGQTTVRAVERALDILLLFTHSPRAWSLSEIARATGLHKSTVHRLLLALQQKGFVRRESESDRYVLGWSLYGLGANAALHDRWSDAAKPILRRLRDETNETVSLYVRNGLERIRILAVESIQPIRNVASVGERYPLTIGASGKVLLAFSNSAVIEAACHPDRLPNGVRQVDLRQQLEAIRREGYALSRQERDAGAAAIAAPVLNEDGSCLYAIAVSGPVERMTEDKMRDMVTPLKRAAEELSERLAE

SEQ ID NO: 2120 - protein, 252 aa, Artificial
  Substituion in SEQ ID NO 2109
MPHTPSGQTTVRAVERALDILLLFTHSPRAWSLSEIARATGLHKSTVHRLLLALQQKGFVRRESESDRYVLGWSLYGLGANAALHDRWSDAAKPILRRLRDETNETVSLYVRNGLERIRIIAVESLQPIRNVASVGERYPLTIGASGKVLLAFSNSAVIEAACHPDRLPNGVRQVDLRQQLEAIRREGYALSRQERDAGAAAIAAPVLNEDGSCLYAIAVSGPVERMTEDKMRDMVTPLKRAAEELSERLAE

SEQ ID NO: 2121 - DNA, 759 bp, Artificial
  Substituion in SEQ ID NO 2110
atgccgcatacgccaagtgggcagaccacggtacgggccgtcgaacgggccctcgacatcctgttgctcttcacacattcgcctcgcgcatggagcttgagcgagatcgcgcgagccacggggcttcacaagagcacggttcaccgcctgctcctggccctccagcagaagggattcgttcgccgtgagtcggagtcggatcgctatgtgctcggatggagcctgtacggcctcggggccaatgcagccctccacgatcgctggtccgacgcggccaaacccattctgcgccgcctgcgcgacgagacgaacgagacggtcagtctctacgtgcgcaacggcctggagcgaattcggatcttggcagtcgagagcctgcagcccattcggaacgtggcatccgtgggtgagcgatatccgctcaccatcggcgcctcgggcaaggtcctgctcgccttctcgaattcggccgtgatcgaggcggcatgccatcccgaccggctgccgaatggcgtccggcaagtggacctccgccaacagctcgaggccattcgccgcgagggctacgcgctctcaaggcaagagcgggacgcgggcgcggcggccatcgcggctcccgtcttgaacgaggacggatcgtgcctgtacgcgattgcggtatcgggacccgtggagcgcatgacggaggacaagatgagggaaatggtcacgccgttgaagcgggccgccgaggagttgtccgagcggctggccgaatag

SEQ ID NO: 2122 - DNA, 759 bp, Artificial
  Substituion in SEQ ID NO 2110
atgccgcatacgccaagtgggcagaccacggtacgggccgtcgaacgggccctcgacatcctgttgctcttcacacattcgcctcgcgcatggagcttgagcgagatcgcgcgagccacggggcttcacaagagcacggttcaccgcctgctcctggccctccagcagaagggattcgttcgccgtgagtcggagtcggatcgctatgtgctcggatggagcctgtacggcctcggggccaatgcagccctccacgatcgctggtccgacgcggccaaacccattctgcgccgcctgcgcgacgagacgaacgagacggtcagtctctacgtgcgcaacggcctggagcgaattcggatcttggcagtcgagagcctgcagcccattcggaacgtggcatccgtgggtgagcgatatccgctcaccatcggcgcctcgggcaaggtcctgctcgccttctcgaattcggccgtgatcgaggcggcatgccatcccgaccggctgccgaatggcgtccggcaagtggacctccgccaacagctcgaggccattcgccgcgagggctacgcgatttcaaggcaagagcgggacgcgggcgcggcggccatcgcggctcccgtcttgaacgaggacggatcgtgcctgtacgcgattgcggtatcgggacccgtggagcgcatgacggaggacaagatgagggacatggtcacgccgttgaagcgggccgccgaggagttgtccgagcggctggccgaatag

SEQ ID NO: 2123 - DNA, 759 bp, Artificial
  Substituion in SEQ ID NO 2110
atgccgcatacgccaagtgggcagaccacggtacgggccgtcgaacgggccctcgacatcctgttgctcttcacacattcgcctcgcgcatggagcttgagcgagatcgcgcgagccacggggcttcacaagagcacggttcaccgcctgctcctggccctccagcagaagggattcgttcgccgtgagtcggagtcggatcgctatgtgctcggatggagcctgtacggcctcggggccaatgcagccctccacgatcgctggtccgacgcggccaaacccattctgcgccgcctgcgcgacgagacgaacgagacggtcagtctctacgtgcgcaacggcctggagcgaattcggatcttggcagtcgagagcctgcagcccattcggaacgtggcatccgtgggtgagcgatatccgctcaccatcggcgcctcgggcaaggtcctgctcgccttctcgcaatcggccgtgatcgaggcggcatgccatcccgaccggctgccgaatggcgtccggcaagtggacctccgccaacagctcgaggccattcgccgcgagggctacgcgctctcaaggcaagagcgggacgcgggcgcggcggccatcgcggctcccgtcttgaacgaggacggatcgtgcctgtacgcgattgcggtatcgggacccgtggagcgcatgacggaggacaagatgagggacatggtcacgccgttgaagcgggccgccgaggagttgtccgagcggctggccgaatag

SEQ ID NO: 2124 - DNA, 759 bp, Artificial
  Substituion in SEQ ID NO 2110
atgccgcatacgccaagtgggcagaccacggtacgggccgtcgaacgggccctcgacatcctgttgctcttcacacattcgcctcgcgcatggagcttgagcgagatcgcgcgagccacggggcttcacaagagcacggttcaccgcctgctcctggccctccagcagaagggattcgttcgccgtgagtcggagtcggatcgctatgtgctcggatggagcctgtacggcctcggggccaatgcagccctccacgatcgctggtccgacgcggccaaacccattctgcgccgcctgcgcgacgagacgaacgagacggtcagtctctacgtgcgcaacggcctggagcgaattcggatcttggcagtcgagagcattcagcccattcggaacgtggcatccgtgggtgagcgatatccgctcaccatcggcgcctcgggcaaggtcctgctcgccttctcgaattcggccgtgatcgaggcggcatgccatcccgaccggctgccgaatggcgtccggcaagtggacctccgccaacagctcgaggccattcgccgcgagggctacgcgctctcaaggcaagagcgggacgcgggcgcggcggccatcgcggctcccgtcttgaacgaggacggatcgtgcctgtacgcgattgcggtatcgggacccgtggagcgcatgacggaggacaagatgagggacatggtcacgccgttgaagcgggccgccgaggagttgtccgagcggctggccgaatag

SEQ ID NO: 2125 - DNA, 759 bp, Artificial
  Substituion in SEQ ID NO 2110
atgccgcatacgccaagtgggcagaccacggtacgggccgtcgaacgggccctcgacatcctgttgctcttcacacattcgcctcgcgcatggagcttgagcgagatcgcgcgagccacggggcttcacaagagcacggttcaccgcctgctcctggccctccagcagaagggattcgttcgccgtgagtcggagtcggatcgctatgtgctcggatggagcctgtacggcctcggggccaatgcagccctccacgatcgctggtccgacgcggccaaacccattctgcgccgcctgcgcgacgagacgaacgagacggtcagtctctacgtgcgcaacggcctggagcgaattcggatcattgcagtcgagagcctgcagcccattcggaacgtggcatccgtgggtgagcgatatccgctcaccatcggcgcctcgggcaaggtcctgctcgccttctcgaattcggccgtgatcgaggcggcatgccatcccgaccggctgccgaatggcgtccggcaagtggacctccgccaacagctcgaggccattcgccgcgagggctacgcgctctcaaggcaagagcgggacgcgggcgcggcggccatcgcggctcccgtcttgaacgaggacggatcgtgcctgtacgcgattgcggtatcgggacccgtggagcgcatgacggaggacaagatgagggacatggtcacgccgttgaagcgggccgccgaggagttgtccgagcggctggccgaatag

SEQ ID NO: 2126 - protein, 482 aa, Alicyclobacillus acidocaldarius
MHELAASGDVLRLILDSMYEGIVLVDAKGHIVEINQAYLKLLNMERDRVIGRHVTEVIENTRLHRVVETGIPERGQLQRIRQHDMVVHRIPIWQGGKVVGAIGVLIFESIRDLYEIIERLQEHAPQVPSARPETEQGSEAHQVRWAYRIDDFLGQSRAVLDLRRMARKAAQTPVTVLITGESGTGKEVLAQGIHFESNRANGPFISVNCAAIPDSLLEAELFGYDEGAFTGAKRGGKPGQIELAHMGTLFLDEIGDMPLSMQAKLLRVLEDRQVQRVGGTVKREVNLRLISATNRDLERMVEEGRFREDLYYRLNIIRLHIPPLRERKEDIPLLLAHYLDMTCERLGKPRMHLSSEVVERLLAYDWPGNVRELVHMVEVLVSLCDSAYVRLDDFPPHLHKLLQERSSRSPAITPSRSPACDAVPGPAVGSPGAGARERMMQVERELIEAALRESGGNKSLAAKRLGVHRSTLYDKIKKLGIL

SEQ ID NO: 2127 - DNA, 1449 bp, Alicyclobacillus acidocaldarius
atgcacgaactggcggcatcgggcgacgtcctgcgcctcatccttgactcgatgtacgaggggatcgtgctcgtcgacgcgaagggccacattgtggaaatcaaccaggcgtatctcaaactgttgaatatggaacgagacagggtgatcggccgtcacgtgacggaggtcatcgagaacacgaggttgcatcgggtcgtcgagaccggcatcccggagcgaggacaactgcagcggattcgtcagcacgacatggtagtgcaccgcatcccgatctggcaaggcggcaaggtcgtcggcgcgatcggcgtcctcatctttgaaagcatccgggatctctacgagatcatcgaaaggctgcaggaacacgcgccccaggtaccttcggcgcgcccggagaccgagcaaggatcggaagctcaccaggtgaggtgggcctatcggatcgacgattttcttgggcaaagtcgggccgtcttggacctccgcaggatggcgcgaaaggcggcccagacgcccgtgactgtgctcatcaccggggagagcgggaccggcaaagaggtgttggcgcaaggcattcattttgaaagcaacagggcgaatgggccgtttatcagtgtcaattgcgcagccattcccgacagccttctggaagcggagcttttcggctacgatgagggcgcgttcaccggggccaagcggggtggcaagcctggtcagatcgagctcgcgcacatgggaacgctgtttttggatgagatcggcgacatgccactatcgatgcaggccaagcttctgcgagttttggaagaccggcaggtgcagcgagttgggggaaccgtcaagcgtgaggtcaacctgcgcttgatctcggccaccaatcgcgatctcgagcgaatggtggaggaggggcggtttcgcgaggatctgtactatcggctgaacatcatccggctgcacatcccgcctctcagggagcggaaggaggacattccgctccttcttgcgcactatctggacatgacctgtgaacggctgggcaaaccccgcatgcacctgtcgtccgaggtggtggaacggcttcttgcctatgactggcccggcaacgtacgcgaactggtccacatggtcgaagtgcttgtgagcctatgcgattcggcctacgtcaggctggacgattttccgcctcatctgcacaagctcttgcaagagcgctcctcccgatcgcccgcgatcactccatcccgaagccctgcgtgcgacgcggttcccggtcccgcagttggatcgccgggagccggtgcaagggagcgaatgatgcaggtcgaacgggaactcatcgaggcggctttgcgggagtcggggggcaacaagtccttggccgccaagcgattgggtgtccaccgctcgacgctgtatgacaagataaaaaaattaggaatcttgtga

SEQ ID NO: 2128 - protein, 461 aa, Geobacillus thermodenitrificans NG80-2
HRLAETMKTVLDAAYEGVVVVDGNGMVREINRAYCQFLGIRREDAIGKHVTEVIENTRLHICVQSGIPERGYIQKIYGQPMVVHRIPIWRDGKVIGAVGMLIFQGVSEVYAIFQRLQELSREASRKEKNEAEASKQEAVASAAVGVERIIGRHPTIAAVKQMIRRAARVPSTVLITGESGTGKEVVARAIHEAGAHADGPFVSVNCAAIPEALLEAELFGYEDGAFTGAKKGGKPGKFQLAHGGTLFLDEIGDMPLAMQAKILRVLEEKKVEKVGGLSETEVDVRIIAATNKPLEEMVRDGTFREDLFYRLNIIRIHLPPLRERKTDIPALLAHHMERLCRQFGVVSKSFAKEAMEVLINYSWPGNIRELVNVVEWLISMVEGENIEREHLPAYLSTIHPSVTPMPDGGANIADQWKEIVYQSERERIAAALVAANGNKAEAARRLGIHRSTLYEKLKKYG

SEQ ID NO: 2129 - protein, 462 aa, Geobacillus kaustophilus HTA426
HRLAETMKTVLDAAYEGVVVVDEDGVVREINRAYCQFLGIRREEAIGKHVTEVIENTRLHICVQSGIPERGYIQKIYGQPMVVHRISIWRDGKVIGAIGMLIFQGVSEVYEIFRRLQELSREASRKEKQETEAKPQETAASAPKGIERIIGRHPAIAAVKQMIRRAARVPSTVLITGESGTGKEVVARAIHEAGPHADGPFVSVNCAAIPESLLEAELFGYEDGAFTGAKKGGKPGKFQLAHGGTLFLDEIGDMPLAMQAKILRVLEEKKVEKVGGLSGTEVDVRIIAATNKPLEEMVRNGTFREDLFYRLNIIRIHLPPLRERKTDIPALLAYHMERMCRQFGVALKSFTKEAMEVLVHYSWPGNVRELVNVVEWLISMVEGEKVEREHLPSYLSTVQPAASSLPNGGVKMADRWKEMVYQSERERIAAALVAAGGNKAEAARRLGIHRSTLYEKLKKYGL

SEQ ID NO: 2130 - protein, 456 aa, Bacillus coagulans 36D1
MAQTKNTAEILNAVLESAYEGIAVVDENGILIEFNEAYSRFTGIKREDAIGRHVTEVIENTNLHVTVKTAIPERGVIQYIQGQAMVVHRIPIWKGGRVVGAIGMLIFEGVSELYQIFERLQQDSLSARKEKTGSKKMPDQAGFTQILGTSESISRVKRLARRAARTSATVLITGESGTGKELFAKSIHQLSTYARGLFITVNCGAIPEPLFESELFGYEEGAFTGAKKGGKPGKFELAENGTLFLDEIGELSPAMQTKLLRAIQEKEAERVGGVKKYKTNVRIVAATNRNLEEMVEAGTFRADLYYRLNIIRIHLPPLRERKEDIPGLVSHFLKAFCRRYDLPEKRISSEAVAAMMAYGWKGNVRELANTVERLVTLADGPEISRGDLPEAIHEAQPAKDIYAESLISRAREAGEAQEKALIIRALKNAGGNKTKAAELLGIHRTTLYQKIKKYNL

SEQ ID NO: 2131 - protein, 450 aa, Oceanobacillus iheyensis HTE831
SAEIVEVILESAYEGVAMVDRNGIIVEFNDAYSRFTGVDKKEAIGHPVQEIIENTNLHQTVKTGIAERGVIQYIQGQPMVVHRIPVWRNEELVGAIGMLIFEGVTELYQIYDRYQEKKQKMITEKHSRKEDSNPGQPDNYLEQIIGQSEELTKLKRMTRKVAQTEATVLITGDSGTGKELFAKSIHQLSDYKSGPFVCVNCGAIPEQLFESELFGYEDGSFTGAKRGGKKGKFKLADNGTLFLDEIGEMPLAMQTKLLRVIQEKEYEKVGGLTKQPLKARVVAATNRNLKVMVEEGTFREDLYYRINVIELYIPPLRNRERDIPLLISSYLLTICKKYNMKKKEITPEAMAVLMKYKWYGNIRELINTIEKLVILTENDMIDYHHLPNYMKREEFTIDNRLSPIHQVKQQEHIRESELIRLTLEQTGGNKSKAAQKLGIHRTTLYQKLKK

SEQ ID NO: 2132 - protein, 447 aa, Thermosinus carboxydivorans Nor1
LESAIESMFEGFVAVDKNGYITMMNQAYGEFLGVDAKEVIGRHVTEVIENTRMHIVAQTGKPEIGEVQRIGKHAVVVTRKPIIQDGEVVGAVGKILFKDVKDFKMLARKLNSLQSELEYYKEELRKVHGGKYTIESIVGQSEKMEWLKTIAAKAAKGNSTVLILGESGTGKELFAHAIHNASARRHGPFIKVNCAALPESLLESELFGYDEGAFTGARKGGKPGKIELANGGTFFLDEIGDMTLAMQAKLLRVLQEREIERVGGTKTNKVDVRIIAATNRDLEKMIERGEFRQDLYYRLNIISLHIPPLRERKEDIPLLCTALLKKINVQVQHWVDGVSPEAMELLLAYDWPGNVRELENVLERAVNLMEEDERQILPEHLPPALKKIHKAKDLDDGLKDLAGILCDTEKQAIYKALEATGGNKSKAAKLLGIHRSGFYQKLHKYNI

SEQ ID NO: 2133 - protein, 482 aa, Artificial
  Substituion in SEQ ID NO 2126
MHELAASGDVLRLILDSMYEGIVLVDAKGHIVEINQAYLKLLNMERDRVIGRHVTEVIENTRLHRVVETGIPERGQLQRIRQHDMVVHRIPIWQGGKVVGAIGVLIFESIRDLYEIIERLQEHAPQVPSARPETEQGSEAHQVRWAYRIDDFLGQSRAVLDLRRMARKAAQTPVTVLITGESGTGKEVLAQGIHFESNRANGPFISVNCAAIPDSLLEAELFGYDEGAFTGAKRGGKPGQIELAHMGTLFLDEIGDMPLSMQAKLLRVLEDRQVQRVGGTVKREVNLRLISATNRDLERMVEEGRFREDLYYRLNIIRLHIPPLRERKEDIPLLLAHYLDMTCERLGKPRMHLSSEVIERLLAYDWPGNVRELVHMVEVLVSLCDSAYVRLDDFPPHLHKLLQERSSRSPAITPSRSPACDAVPGPAVGSPGAGARERMMQVERELIEAALRESGGNKSLAAKRLGVHRSTLYDKIKKLGIL

SEQ ID NO: 2134 - protein, 482 aa, Artificial
  Substituion in SEQ ID NO 2126
MHELAASGDVLRLILDSMYEGIVLVDAKGHIVEINQAYLKLLNMERDRVIGRHVTEVIENTRLHRVVETGIPERGQLQRIRQHDMVVHRIPIWQGGKVVGAIGVLIFESLRDLYEIIERLQEHAPQVPSARPETEQGSEAHQVRWAYRIDDFLGQSRAVLDLRRMARKAAQTPVTVLITGESGTGKEVLAQGIHFESNRANGPFISVNCAAIPDSLLEAELFGYDEGAFTGAKRGGKPGQIELAHMGTLFLDEIGDMPLSMQAKLLRVLEDRQVQRVGGTVKREVNLRLISATNRDLERMVEEGRFREDLYYRLNIIRLHIPPLRERKEDIPLLLAHYLDMTCERLGKPRMHLSSEVVERLLAYDWPGNVRELVHMVEVLVSLCDSAYVRLDDFPPHLHKLLQERSSRSPAITPSRSPACDAVPGPAVGSPGAGARERMMQVERELIEAALRESGGNKSLAAKRLGVHRSTLYDKIKKLGIL

SEQ ID NO: 2135 - protein, 482 aa, Artificial
  Substituion in SEQ ID NO 2126
MHELAASGDVLRLILDSMYEGIVLVDAKGHIVEINQAYLKLLNMERDRVIGRHVTEVIENTRLHRVVETGIPERGQLQRIRQHDMVVHRIPIWQGGKVVGAIGVLIFESIRDLYEIIERLQEHAPQVPSARPETEQGSEAHQVRWAYRIDDFLGQSRAVLDLRRMARKAAQTPVTVLITGESGTGKEVLAQGIHFESNRANGPFISVNCAAIPDSLLEAELFGYDEGAFTGAKRGGKPGQIELAHMGTLFLDEIGDMPLSMQAKLLRVLEDRQVQRVGGTVKREVNLRLISATNRDLERMVEEGRFREDLYYRLNIIRLHIPPLRERKEDIPLLLAHYLDMTCERLGKPRMHLSSEVVERLLAYDWPGNVRELVHMVEVLVSLCDSAYVRLDDFPPHLHKLLQERSSRSPAITPSRSPACDAVPGPAVGSPGAGARERMMQVERELIEAALKESGGNKSLAAKRLGVHRSTLYDKIKKLGIL

SEQ ID NO: 2136 - protein, 482 aa, Artificial
  Substituion in SEQ ID NO 2126
MHELAASGDVLRLILDSMYEGIVLVDAKGHIVEINQAYLKLLNMERDRVIGRHVTEVIENTRLHRVVETGIPERGQLQRIRQHDMVVHRIPIWQGGKVVGAIGVLIFESIRDLYEIIERLQEHAPQVPSARPETEQGSEAHQVRWAYRIDDFLGQSRAVLDLRRMARKAAQTPVTVLITGESGTGKEVLAQGIHFESNRAQGPFISVNCAAIPDSLLEAELFGYDEGAFTGAKRGGKPGQIELAHMGTLFLDEIGDMPLSMQAKLLRVLEDRQVQRVGGTVKREVNLRLISATNRDLERMVEEGRFREDLYYRLNIIRLHIPPLRERKEDIPLLLAHYLDMTCERLGKPRMHLSSEVVERLLAYDWPGNVRELVHMVEVLVSLCDSAYVRLDDFPPHLHKLLQERSSRSPAITPSRSPACDAVPGPAVGSPGAGARERMMQVERELIEAALRESGGNKSLAAKRLGVHRSTLYDKIKKLGIL

SEQ ID NO: 2137 - protein, 482 aa, Artificial
  Substituion in SEQ ID NO 2126
MHELAASGDVLRLILDSMYEGIVLVDAKGHIVEINQAYLKLLNMERDRVIGRHVTEVIENTRLHRVVETGIPERGQLQRIRQHDMVVHRIPIWQGGKVVGAIGVLIFESIRDLYEIIERLQEHAPQVPSARPETEQGSEAHQVKWAYRIDDFLGQSRAVLDLRRMARKAAQTPVTVLITGESGTGKEVLAQGIHFESNRANGPFISVNCAAIPDSLLEAELFGYDEGAFTGAKRGGKPGQIELAHMGTLFLDEIGDMPLSMQAKLLRVLEDRQVQRVGGTVKREVNLRLISATNRDLERMVEEGRFREDLYYRLNIIRLHIPPLRERKEDIPLLLAHYLDMTCERLGKPRMHLSSEVVERLLAYDWPGNVRELVHMVEVLVSLCDSAYVRLDDFPPHLHKLLQERSSRSPAITPSRSPACDAVPGPAVGSPGAGARERMMQVERELIEAALRESGGNKSLAAKRLGVHRSTLYDKIKKLGIL

SEQ ID NO: 2138 - DNA, 1449 bp, Artificial
  Substituion in SEQ ID NO 2127
atgcacgaactggcggcatcgggcgacgtcctgcgcctcatccttgactcgatgtacgaggggatcgtgctcgtcgacgcgaagggccacattgtggaaatcaaccaggcgtatctcaaactgttgaatatggaacgagacagggtgatcggccgtcacgtgacggaggtcatcgagaacacgaggttgcatcgggtcgtcgagaccggcatcccggagcgaggacaactgcagcggattcgtcagcacgacatggtagtgcaccgcatcccgatctggcaaggcggcaaggtcgtcggcgcgatcggcgtcctcatctttgaaagcatccgggatctctacgagatcatcgaaaggctgcaggaacacgcgccccaggtaccttcggcgcgcccggagaccgagcaaggatcggaagctcaccaggtgaggtgggcctatcggatcgacgattttcttgggcaaagtcgggccgtcttggacctccgcaggatggcgcgaaaggcggcccagacgcccgtgactgtgctcatcaccggggagagcgggaccggcaaagaggtgttggcgcaaggcattcattttgaaagcaacagggcgaatgggccgtttatcagtgtcaattgcgcagccattcccgacagccttctggaagcggagcttttcggctacgatgagggcgcgttcaccggggccaagcggggtggcaagcctggtcagatcgagctcgcgcacatgggaacgctgtttttggatgagatcggcgacatgccactatcgatgcaggccaagcttctgcgagttttggaagaccggcaggtgcagcgagttgggggaaccgtcaagcgtgaggtcaacctgcgcttgatctcggccaccaatcgcgatctcgagcgaatggtggaggaggggcggtttcgcgaggatctgtactatcggctgaacatcatccggctgcacatcccgcctctcagggagcggaaggaggacattccgctccttcttgcgcactatctggacatgacctgtgaacggctgggcaaaccccgcatgcacctgtcgtccgaggtgattgaacggcttcttgcctatgactggcccggcaacgtacgcgaactggtccacatggtcgaagtgcttgtgagcctatgcgattcggcctacgtcaggctggacgattttccgcctcatctgcacaagctcttgcaagagcgctcctcccgatcgcccgcgatcactccatcccgaagccctgcgtgcgacgcggttcccggtcccgcagttggatcgccgggagccggtgcaagggagcgaatgatgcaggtcgaacgggaactcatcgaggcggctttgcgggagtcggggggcaacaagtccttggccgccaagcgattgggtgtccaccgctcgacgctgtatgacaagataaaaaaattaggaatcttgtga

SEQ ID NO: 2139 - DNA, 1449 bp, Artificial
  Substituion in SEQ ID NO 2127
atgcacgaactggcggcatcgggcgacgtcctgcgcctcatccttgactcgatgtacgaggggatcgtgctcgtcgacgcgaagggccacattgtggaaatcaaccaggcgtatctcaaactgttgaatatggaacgagacagggtgatcggccgtcacgtgacggaggtcatcgagaacacgaggttgcatcgggtcgtcgagaccggcatcccggagcgaggacaactgcagcggattcgtcagcacgacatggtagtgcaccgcatcccgatctggcaaggcggcaaggtcgtcggcgcgatcggcgtcctcatctttgaaagcttacgggatctctacgagatcatcgaaaggctgcaggaacacgcgccccaggtaccttcggcgcgcccggagaccgagcaaggatcggaagctcaccaggtgaggtgggcctatcggatcgacgattttcttgggcaaagtcgggccgtcttggacctccgcaggatggcgcgaaaggcggcccagacgcccgtgactgtgctcatcaccggggagagcgggaccggcaaagaggtgttggcgcaaggcattcattttgaaagcaacagggcgaatgggccgtttatcagtgtcaattgcgcagccattcccgacagccttctggaagcggagcttttcggctacgatgagggcgcgttcaccggggccaagcggggtggcaagcctggtcagatcgagctcgcgcacatgggaacgctgtttttggatgagatcggcgacatgccactatcgatgcaggccaagcttctgcgagttttggaagaccggcaggtgcagcgagttgggggaaccgtcaagcgtgaggtcaacctgcgcttgatctcggccaccaatcgcgatctcgagcgaatggtggaggaggggcggtttcgcgaggatctgtactatcggctgaacatcatccggctgcacatcccgcctctcagggagcggaaggaggacattccgctccttcttgcgcactatctggacatgacctgtgaacggctgggcaaaccccgcatgcacctgtcgtccgaggtggtggaacggcttcttgcctatgactggcccggcaacgtacgcgaactggtccacatggtcgaagtgcttgtgagcctatgcgattcggcctacgtcaggctggacgattttccgcctcatctgcacaagctcttgcaagagcgctcctcccgatcgcccgcgatcactccatcccgaagccctgcgtgcgacgcggttcccggtcccgcagttggatcgccgggagccggtgcaagggagcgaatgatgcaggtcgaacgggaactcatcgaggcggctttgcgggagtcggggggcaacaagtccttggccgccaagcgattgggtgtccaccgctcgacgctgtatgacaagataaaaaaattaggaatcttgtga

SEQ ID NO: 2140 - DNA, 1449 bp, Artificial
  Substituion in SEQ ID NO 2127
atgcacgaactggcggcatcgggcgacgtcctgcgcctcatccttgactcgatgtacgaggggatcgtgctcgtcgacgcgaagggccacattgtggaaatcaaccaggcgtatctcaaactgttgaatatggaacgagacagggtgatcggccgtcacgtgacggaggtcatcgagaacacgaggttgcatcgggtcgtcgagaccggcatcccggagcgaggacaactgcagcggattcgtcagcacgacatggtagtgcaccgcatcccgatctggcaaggcggcaaggtcgtcggcgcgatcggcgtcctcatctttgaaagcatccgggatctctacgagatcatcgaaaggctgcaggaacacgcgccccaggtaccttcggcgcgcccggagaccgagcaaggatcggaagctcaccaggtgaggtgggcctatcggatcgacgattttcttgggcaaagtcgggccgtcttggacctccgcaggatggcgcgaaaggcggcccagacgcccgtgactgtgctcatcaccggggagagcgggaccggcaaagaggtgttggcgcaaggcattcattttgaaagcaacagggcgaatgggccgtttatcagtgtcaattgcgcagccattcccgacagccttctggaagcggagcttttcggctacgatgagggcgcgttcaccggggccaagcggggtggcaagcctggtcagatcgagctcgcgcacatgggaacgctgtttttggatgagatcggcgacatgccactatcgatgcaggccaagcttctgcgagttttggaagaccggcaggtgcagcgagttgggggaaccgtcaagcgtgaggtcaacctgcgcttgatctcggccaccaatcgcgatctcgagcgaatggtggaggaggggcggtttcgcgaggatctgtactatcggctgaacatcatccggctgcacatcccgcctctcagggagcggaaggaggacattccgctccttcttgcgcactatctggacatgacctgtgaacggctgggcaaaccccgcatgcacctgtcgtccgaggtggtggaacggcttcttgcctatgactggcccggcaacgtacgcgaactggtccacatggtcgaagtgcttgtgagcctatgcgattcggcctacgtcaggctggacgattttccgcctcatctgcacaagctcttgcaagagcgctcctcccgatcgcccgcgatcactccatcccgaagccctgcgtgcgacgcggttcccggtcccgcagttggatcgccgggagccggtgcaagggagcgaatgatgcaggtcgaacgggaactcatcgaggcggctttgaaagagtcggggggcaacaagtccttggccgccaagcgattgggtgtccaccgctcgacgctgtatgacaagataaaaaaattaggaatcttgtga

SEQ ID NO: 2141 - DNA, 1449 bp, Artificial
  Substituion in SEQ ID NO 2127
atgcacgaactggcggcatcgggcgacgtcctgcgcctcatccttgactcgatgtacgaggggatcgtgctcgtcgacgcgaagggccacattgtggaaatcaaccaggcgtatctcaaactgttgaatatggaacgagacagggtgatcggccgtcacgtgacggaggtcatcgagaacacgaggttgcatcgggtcgtcgagaccggcatcccggagcgaggacaactgcagcggattcgtcagcacgacatggtagtgcaccgcatcccgatctggcaaggcggcaaggtcgtcggcgcgatcggcgtcctcatctttgaaagcatccgggatctctacgagatcatcgaaaggctgcaggaacacgcgccccaggtaccttcggcgcgcccggagaccgagcaaggatcggaagctcaccaggtgaggtgggcctatcggatcgacgattttcttgggcaaagtcgggccgtcttggacctccgcaggatggcgcgaaaggcggcccagacgcccgtgactgtgctcatcaccggggagagcgggaccggcaaagaggtgttggcgcaaggcattcattttgaaagcaacagggcgcaagggccgtttatcagtgtcaattgcgcagccattcccgacagccttctggaagcggagcttttcggctacgatgagggcgcgttcaccggggccaagcggggtggcaagcctggtcagatcgagctcgcgcacatgggaacgctgtttttggatgagatcggcgacatgccactatcgatgcaggccaagcttctgcgagttttggaagaccggcaggtgcagcgagttgggggaaccgtcaagcgtgaggtcaacctgcgcttgatctcggccaccaatcgcgatctcgagcgaatggtggaggaggggcggtttcgcgaggatctgtactatcggctgaacatcatccggctgcacatcccgcctctcagggagcggaaggaggacattccgctccttcttgcgcactatctggacatgacctgtgaacggctgggcaaaccccgcatgcacctgtcgtccgaggtggtggaacggcttcttgcctatgactggcccggcaacgtacgcgaactggtccacatggtcgaagtgcttgtgagcctatgcgattcggcctacgtcaggctggacgattttccgcctcatctgcacaagctcttgcaagagcgctcctcccgatcgcccgcgatcactccatcccgaagccctgcgtgcgacgcggttcccggtcccgcagttggatcgccgggagccggtgcaagggagcgaatgatgcaggtcgaacgggaactcatcgaggcggctttgcgggagtcggggggcaacaagtccttggccgccaagcgattgggtgtccaccgctcgacgctgtatgacaagataaaaaaattaggaatcttgtga

SEQ ID NO: 2142 - DNA, 1449 bp, Artificial
  Substituion in SEQ ID NO 2127
atgcacgaactggcggcatcgggcgacgtcctgcgcctcatccttgactcgatgtacgaggggatcgtgctcgtcgacgcgaagggccacattgtggaaatcaaccaggcgtatctcaaactgttgaatatggaacgagacagggtgatcggccgtcacgtgacggaggtcatcgagaacacgaggttgcatcgggtcgtcgagaccggcatcccggagcgaggacaactgcagcggattcgtcagcacgacatggtagtgcaccgcatcccgatctggcaaggcggcaaggtcgtcggcgcgatcggcgtcctcatctttgaaagcatccgggatctctacgagatcatcgaaaggctgcaggaacacgcgccccaggtaccttcggcgcgcccggagaccgagcaaggatcggaagctcaccaggtgaaatgggcctatcggatcgacgattttcttgggcaaagtcgggccgtcttggacctccgcaggatggcgcgaaaggcggcccagacgcccgtgactgtgctcatcaccggggagagcgggaccggcaaagaggtgttggcgcaaggcattcattttgaaagcaacagggcgaatgggccgtttatcagtgtcaattgcgcagccattcccgacagccttctggaagcggagcttttcggctacgatgagggcgcgttcaccggggccaagcggggtggcaagcctggtcagatcgagctcgcgcacatgggaacgctgtttttggatgagatcggcgacatgccactatcgatgcaggccaagcttctgcgagttttggaagaccggcaggtgcagcgagttgggggaaccgtcaagcgtgaggtcaacctgcgcttgatctcggccaccaatcgcgatctcgagcgaatggtggaggaggggcggtttcgcgaggatctgtactatcggctgaacatcatccggctgcacatcccgcctctcagggagcggaaggaggacattccgctccttcttgcgcactatctggacatgacctgtgaacggctgggcaaaccccgcatgcacctgtcgtccgaggtggtggaacggcttcttgcctatgactggcccggcaacgtacgcgaactggtccacatggtcgaagtgcttgtgagcctatgcgattcggcctacgtcaggctggacgattttccgcctcatctgcacaagctcttgcaagagcgctcctcccgatcgcccgcgatcactccatcccgaagccctgcgtgcgacgcggttcccggtcccgcagttggatcgccgggagccggtgcaagggagcgaatgatgcaggtcgaacgggaactcatcgaggcggctttgcgggagtcggggggcaacaagtccttggccgccaagcgattgggtgtccaccgctcgacgctgtatgacaagataaaaaaattaggaatcttgtga

SEQ ID NO: 2143 - protein, 179 aa, Alicyclobacillus acidocaldarius
MASVEKSPVRSDAWTAEDDERLAQLVLRHIRTGSTQLKAFEEAAEQLGRTAAACGYRWNGVIRKRYRDEIEAAKAERKALHVKTQTQKAATAPTASMQEVIRFLQTYDEQYQRLREYVSAIEREKSELEARVRALESQLREGGPELPLSPEQLEEDSRTLFAIMERARKLLAENRSAGT

SEQ ID NO: 2144 - DNA, 540 bp, Alicyclobacillus acidocaldarius
ttggcatccgtcgagaaaagcccagtgcgctcggatgcgtggacggctgaggacgatgagcgcctcgcgcagctggtacttcgccacattcgcaccggcagcacccaactgaaggcgttcgaggaggcggccgagcaactcggccggacggccgcggcatgcggataccgctggaacggcgtgattcgcaagcgatatcgggacgagatcgaggcggcgaaagccgagcgcaaagccctccacgtgaagacgcagacgcagaaggcggccaccgctcccacggcgtccatgcaggaagtcattcggttcttgcagacgtacgacgaacagtatcagcggttgcgcgagtacgtctcggccatcgaacgggaaaaatccgaactggaagcgagggtgcgcgcgctcgaatcgcaacttcgcgagggcggaccggagttgccgctgtcaccggagcagcttgaggaagattcgcgcacgctgttcgccatcatggaacgggcgcgcaagctcctagccgagaaccgctccgccgggacgtga

SEQ ID NO: 2145 - protein, 171 aa, Geobacillus thermodenitrificans NG80-2
VRQDAWTKEEDELLANVVLEYIRTGGTQLEAFAEVGRRLSRTAAACGFRWNSYVRKQYKEEIEQAKQERKTRKKETASEKDGRGQPEMEAAVESKLSWAEVLAFLQAEGQKAREIRRTADENRALKNDMEQLQQMVTKLQMEKEALQKQLAAVQEEYKTLLTIMERARKMM

SEQ ID NO: 2146 - protein, 138 aa, Bacillus thuringiensis str. Al Hakam
EMATTRQDAWTDDEDLLLAEVVLRHIREGGTQLSAFKEVGRHLSRTPAACGFRWNSYVRKQYKERIEEAKQLRKVEHYEVKETKVLEPKSITLNDVIDFLQNYKDENSLMVLQQQIESLQTEKESLLERLSVYEEEYR

SEQ ID NO: 2147 - protein, 174 aa, Geobacillus kaustophilus HTA426
VRQDAWTKEEDELLANVVLQYIREGGTQLEAFAEVGRRLSRTAAACGFRWNSCVRKQYKEEIEQAKQERKMRKKETPSTKESEGQEKVEAAVKSHLSWAEVLAFLQAEEQKARDARRTADENRALKNDMEQLQQMVTKLQMEKESLQKQLAAIQEEYKTLLSIMERARKMVTDS

SEQ ID NO: 2148 - protein, 174 aa, Bacillus subtilis subsp. subtilis str. 168
RQDAWTQDEDLLLAEVVLRHIREGGTQLSAFEEVGRALTRTAAACGFRWNSYVRKQYQSGIELAKKQRKELRKQIGVHSVNMPNSMKQTASASSEGKRDLSIQDVIQFLEQFKETPSAQEFQLEREKLKEQIQSLQKELEDLRSENQTLRNQLEMTEEDYKALIDIMDRARKMV

SEQ ID NO: 2149 - protein, 133 aa, Bacillus cereus AH820
RQDAWTDDEDLLLAEVVLRHIREGGTQLSAFKEVGRHLSRTPAACGFRWNSYVRKQYKERIEEAKQLRKVEHYEVKETKVLEPKLITLNDVIDFLQNYKDENSLMVLQQQIESLQTEKESLLERLSVYEEEYR

SEQ ID NO: 2150 - protein, 179 aa, Artificial
  Substituion in SEQ ID NO 2143
MASVEKSPVRSDAWTAEDDERLAQLVLRHIRTGSTQLKAFDEAAEQLGRTAAACGYRWNGVIRKRYRDEIEAAKAERKALHVKTQTQKAATAPTASMQEVIRFLQTYDEQYQRLREYVSAIEREKSELEARVRALESQLREGGPELPLSPEQLEEDSRTLFAIMERARKLLAENRSAGT

SEQ ID NO: 2151 - protein, 179 aa, Artificial
  Substituion in SEQ ID NO 2143
MASVEKSPVRSDAWTAEDDERLAQLVLRHIRTGSTQLKAFEEAAEQLGRTAAACGYRWNGVIRKRYRDEIEAAKAERKALHVKTQTQKAATAPTASMQEVIRFLQTYDEQYQRLREYVSAIEREKSELEARVRALESQLREGGPELPLSPEQLEEDSRTLFAIMERAKKLLAENRSAGT

SEQ ID NO: 2152 - protein, 179 aa, Artificial
  Substituion in SEQ ID NO 2143
MASVEKSPVRSDAWTAEDDERLAQLVLRHIRTGSTQLKAFEEAAEQLGRTAAACGYRWNGVIRKRYRDEIEAAKAERKALHIKTQTQKAATAPTASMQEVIRFLQTYDEQYQRLREYVSAIEREKSELEARVRALESQLREGGPELPLSPEQLEEDSRTLFAIMERARKLLAENRSAGT

SEQ ID NO: 2153 - protein, 179 aa, Artificial
  Substituion in SEQ ID NO 2143
MASVEKSPVRSDAWTAEDDERLAQLVLKHIRTGSTQLKAFEEAAEQLGRTAAACGYRWNGVIRKRYRDEIEAAKAERKALHVKTQTQKAATAPTASMQEVIRFLQTYDEQYQRLREYVSAIEREKSELEARVRALESQLREGGPELPLSPEQLEEDSRTLFAIMERARKLLAENRSAGT

SEQ ID NO: 2154 - protein, 179 aa, Artificial
  Substituion in SEQ ID NO 2143
MASVEKSPVRSDAWTAEDDERLAQLVLRHIRTGSTQLKAFEEAAEQLGRTAAACGYRWNGVIRKRYRDEIEAAKAERKALHVKTQTQKAATAPTASMQEVIRFLQTYDEQYQRLREYVSAIEREKSELEARVRAIESQLREGGPELPLSPEQLEEDSRTLFAIMERARKLLAENRSAGT

SEQ ID NO: 2155 - DNA, 540 bp, Artificial
  Substituion in SEQ ID NO 2144
ttggcatccgtcgagaaaagcccagtgcgctcggatgcgtggacggctgaggacgatgagcgcctcgcgcagctggtacttcgccacattcgcaccggcagcacccaactgaaggcgttcgatgaggcggccgagcaactcggccggacggccgcggcatgcggataccgctggaacggcgtgattcgcaagcgatatcgggacgagatcgaggcggcgaaagccgagcgcaaagccctccacgtgaagacgcagacgcagaaggcggccaccgctcccacggcgtccatgcaggaagtcattcggttcttgcagacgtacgacgaacagtatcagcggttgcgcgagtacgtctcggccatcgaacgggaaaaatccgaactggaagcgagggtgcgcgcgctcgaatcgcaacttcgcgagggcggaccggagttgccgctgtcaccggagcagcttgaggaagattcgcgcacgctgttcgccatcatggaacgggcgcgcaagctcctagccgagaaccgctccgccgggacgtga

SEQ ID NO: 2156 - DNA, 540 bp, Artificial
  Substituion in SEQ ID NO 2144
ttggcatccgtcgagaaaagcccagtgcgctcggatgcgtggacggctgaggacgatgagcgcctcgcgcagctggtacttcgccacattcgcaccggcagcacccaactgaaggcgttcgaggaggcggccgagcaactcggccggacggccgcggcatgcggataccgctggaacggcgtgattcgcaagcgatatcgggacgagatcgaggcggcgaaagccgagcgcaaagccctccacgtgaagacgcagacgcagaaggcggccaccgctcccacggcgtccatgcaggaagtcattcggttcttgcagacgtacgacgaacagtatcagcggttgcgcgagtacgtctcggccatcgaacgggaaaaatccgaactggaagcgagggtgcgcgcgctcgaatcgcaacttcgcgagggcggaccggagttgccgctgtcaccggagcagcttgaggaagattcgcgcacgctgttcgccatcatggaacgggcgaaaaagctcctagccgagaaccgctccgccgggacgtga

SEQ ID NO: 2157 - DNA, 540 bp, Artificial
  Substituion in SEQ ID NO 2144
ttggcatccgtcgagaaaagcccagtgcgctcggatgcgtggacggctgaggacgatgagcgcctcgcgcagctggtacttcgccacattcgcaccggcagcacccaactgaaggcgttcgaggaggcggccgagcaactcggccggacggccgcggcatgcggataccgctggaacggcgtgattcgcaagcgatatcgggacgagatcgaggcggcgaaagccgagcgcaaagccctccacattaagacgcagacgcagaaggcggccaccgctcccacggcgtccatgcaggaagtcattcggttcttgcagacgtacgacgaacagtatcagcggttgcgcgagtacgtctcggccatcgaacgggaaaaatccgaactggaagcgagggtgcgcgcgctcgaatcgcaacttcgcgagggcggaccggagttgccgctgtcaccggagcagcttgaggaagattcgcgcacgctgttcgccatcatggaacgggcgcgcaagctcctagccgagaaccgctccgccgggacgtga

SEQ ID NO: 2158 - DNA, 540 bp, Artificial
  Substituion in SEQ ID NO 2144
ttggcatccgtcgagaaaagcccagtgcgctcggatgcgtggacggctgaggacgatgagcgcctcgcgcagctggtacttaaacacattcgcaccggcagcacccaactgaaggcgttcgaggaggcggccgagcaactcggccggacggccgcggcatgcggataccgctggaacggcgtgattcgcaagcgatatcgggacgagatcgaggcggcgaaagccgagcgcaaagccctccacgtgaagacgcagacgcagaaggcggccaccgctcccacggcgtccatgcaggaagtcattcggttcttgcagacgtacgacgaacagtatcagcggttgcgcgagtacgtctcggccatcgaacgggaaaaatccgaactggaagcgagggtgcgcgcgctcgaatcgcaacttcgcgagggcggaccggagttgccgctgtcaccggagcagcttgaggaagattcgcgcacgctgttcgccatcatggaacgggcgcgcaagctcctagccgagaaccgctccgccgggacgtga

SEQ ID NO: 2159 - DNA, 540 bp, Artificial
  Substituion in SEQ ID NO 2144
ttggcatccgtcgagaaaagcccagtgcgctcggatgcgtggacggctgaggacgatgagcgcctcgcgcagctggtacttcgccacattcgcaccggcagcacccaactgaaggcgttcgaggaggcggccgagcaactcggccggacggccgcggcatgcggataccgctggaacggcgtgattcgcaagcgatatcgggacgagatcgaggcggcgaaagccgagcgcaaagccctccacgtgaagacgcagacgcagaaggcggccaccgctcccacggcgtccatgcaggaagtcattcggttcttgcagacgtacgacgaacagtatcagcggttgcgcgagtacgtctcggccatcgaacgggaaaaatccgaactggaagcgagggtgcgcgcgattgaatcgcaacttcgcgagggcggaccggagttgccgctgtcaccggagcagcttgaggaagattcgcgcacgctgttcgccatcatggaacgggcgcgcaagctcctagccgagaaccgctccgccgggacgtga

SEQ ID NO: 2160 - protein, 243 aa, Alicyclobacillus acidocaldarius
MNALDPEGDATMREASSKLYMEIAEEIRRQIEEGAFRPGDRLPTLRELADRFGVSRATVREALSALRGQGLVEFRHGMGTYVRAASVEMWMQPLDAAILLSYDNVRDLVELQTAVLAQIAYRAAAQRMESDYSVLSHALFELEASPRRGEHRIASELKFFSVLAELAGNRLLENALRVLQEALRSSLRLLNPKLDLGVQACRRVYNAVQTGRPADARDAVYAYGEAILRAVAEKKGRGQSAMM

SEQ ID NO: 2161 - DNA, 732 bp, Alicyclobacillus acidocaldarius
ttgaatgcgctcgacccggagggggatgcgaccatgcgcgaagcttcgagcaaactgtacatggagatcgcggaggagattcgcaggcagatcgaagagggcgcgtttcggcccggcgatcgcctgccgacgcttcgggagctcgcggaccggtttggcgtgagccgcgccaccgtccgcgaggcgttgagcgcgctgcgcggccaggggctcgtcgagttccgccacggcatggggacctacgtgcgggcggcttcggtggagatgtggatgcagccgctggacgcagcgatcctcctcagctacgacaacgtgcgcgatctcgtcgagctccagacggccgtgctggcgcagatcgcgtatcgcgccgcggcccagcgcatggagtccgactactccgtgctgtcacacgcgctgtttgagctcgaggcttcgcctcgccgcggcgagcaccgcattgcgagcgaactcaagttcttcagcgttctcgccgaactcgccggaaaccgcttgctggagaatgcgcttcgcgtgttgcaggaggccctccggtccagccttcgactcctgaatccgaaattggatctcggcgtccaggcatgtcggagggtctacaacgcggttcaaacagggcggccggctgacgctcgcgacgccgtgtatgcgtacggtgaagccatcttgagggcggtggcggagaaaaagggaagagggcaatccgccatgatgtga

SEQ ID NO: 2162 - protein, 184 aa, Symbiobacterium thermophilum IAM 14863
RVSSQRIYQQIVDQITRMVQEGTLRPGDRLPPERQLAEEFGVSRSAVREALSALRMLGLVEARVGEGTFVTQPPDERFISPLALVLTIEQSEAVGRELLELRAALEAESAALAAVRREAEDLAAMEEALGDMERDLQEGRLGAEADWRFHDAVASASGNSLLLQTMRSLSDTMKEALGLYREQL

SEQ ID NO: 2163 - protein, 198 aa, Bacillus subtilis
GELKPGDKLDSVQALAESFQVSRSAVREALSALKAMGLVEMKQGEGTYLKEFELNQISQPLSAALLMKKEDVKQLLEVRKLLEIGVASLAAEKRTEADLERIQDALKEMGSIEADGELGEKADFAFHLALADASQNELLKHLMNHVSSLLLETMRETRKIWLFSKKTSVQRLYEEHERIYNAVAAGNGAQAEAAMLAH

SEQ ID NO: 2164 - protein, 212 aa, Moorella thermoacetica ATCC 39073
TKKIYEEIVQQIKDLIGEGNLKPGDRLPSERELSERLAVSRASVREALSALAAMGVIVIRPGEGTFVQNIRNGAIVEPLAMALLLDRQAAMELLEARQALEGEAAYLAARRAGPEDLEKMEELLKEMEHDLQRGILGEEADLRFHLAIAEAARNSVLARLMHTVSDTMRQALKTSRQRLYTTAGNPEKLFAQHNQIYEAIKAHDPRAARKAI

SEQ ID NO: 2165 - protein, 216 aa, Bacillus amyloliquefaciens FZB42
TKKIYEEVADALLEKIKAGELKPGEKLDSVQALSESFQVSRSAVREALSALKAMGLVDMKQGEGTYIREFEPSHVSQPLSSALLMKKEDVKQLLEVRKLLELGVAAMAAEKRTEDDLQKIRQALLEMKDIDGDEELGEKADFSFHMALAEASQNGLLKHLMNHVSALLLETMRETRKIWLFSKRTSVQRLYEEHERIYSAVAAKDADEAEAAMTAH

SEQ ID NO: 2166 - protein, 173 aa, Bacillus licheniformis ATCC 14580
TKKIYEEVAEALLESIKSGELEPGDKLDSVQALADSFQVSRSAVREALSALKAMGMVEMKQGEGTYVKRFEPEQISIPLSAALLMKKKDVAELLEVRKILEIGAVSSAAQKRTEDDLGRMQEALEDMKLADGNGELGEKADLAFHLALAGASQNDLLKGLMNHVSSLLIETMR

SEQ ID NO: 2167 - protein, 243 aa, Artificial
  Substituion in SEQ ID NO 2160
MNALDPEGDATMREASSKIYMEIAEEIRRQIEEGAFRPGDRLPTLRELADRFGVSRATVREALSALRGQGLVEFRHGMGTYVRAASVEMWMQPLDAAILLSYDNVRDLVELQTAVLAQIAYRAAAQRMESDYSVLSHALFELEASPRRGEHRIASELKFFSVLAELAGNRLLENALRVLQEALRSSLRLLNPKLDLGVQACRRVYNAVQTGRPADARDAVYAYGEAILRAVAEKKGRGQSAMM

SEQ ID NO: 2168 - protein, 243 aa, Artificial
  Substituion in SEQ ID NO 2160
MNALDPEGDATMREASSKLYMEIAEEIRRQIEEGAFRPGDRLPTLRELADRFGVSRATVREALSALRGQGLVEFRHGMGTYVRAASVEMWMQPLDAAILLSYDNVRDLVELQTAVLAQIAYRAAAQRMESDYSVISHALFELEASPRRGEHRIASELKFFSVLAELAGNRLLENALRVLQEALRSSLRLLNPKLDLGVQACRRVYNAVQTGRPADARDAVYAYGEAILRAVAEKKGRGQSAMM

SEQ ID NO: 2169 - protein, 243 aa, Artificial
  Substituion in SEQ ID NO 2160
MNALDPEGDATMREASSKLYMEIAEEIRRQIEEGAFRPGDRLPTLRELADRFGVSRATVREALSALRGQGLVEFRHGMGTYVRAASVEMWMQPLDAAILLSYDNVRDLVELQTAVLAQIAYRAAAQRMESDYSVLSHALFELEASPRRGEHRIASELKFFSVLAELAGNKLLENALRVLQEALRSSLRLLNPKLDLGVQACRRVYNAVQTGRPADARDAVYAYGEAILRAVAEKKGRGQSAMM

SEQ ID NO: 2170 - protein, 243 aa, Artificial
  Substituion in SEQ ID NO 2160
MNALDPEGDATMREASSKLYMEIAEEIRRQIEEGAFRPGDRLPTLRELADRFGVSRATVREALSALRGQGLVEFRHGMGTYVRAASVEMWMQPLDAAILLSYDNVRDLVELQTAVLAQIAYRAAAQRMESDYSVLSHALFDLEASPRRGEHRIASELKFFSVLAELAGNRLLENALRVLQEALRSSLRLLNPKLDLGVQACRRVYNAVQTGRPADARDAVYAYGEAILRAVAEKKGRGQSAMM

SEQ ID NO: 2171 - protein, 243 aa, Artificial
  Substituion in SEQ ID NO 2160
MNALDPEGDATMREASSKLYMEIAEEIRRQIEEGAFRPGDRLPTLRELADRFGVSRATVREALSALRGQGLVEFRHGMGTYVRAASVEMWMQPLDAAILLSYDNVRDLVELQTAVLAQIAYRAAAQRMESDYSVLSHALFELEASPRRGEHRIASELKFFSVLAELAGNRLLENALRVLQDALRSSLRLLNPKLDLGVQACRRVYNAVQTGRPADARDAVYAYGEAILRAVAEKKGRGQSAMM

SEQ ID NO: 2172 - DNA, 732 bp, Artificial
  Substituion in SEQ ID NO 2161
ttgaatgcgctcgacccggagggggatgcgaccatgcgcgaagcttcgagcaaaatttacatggagatcgcggaggagattcgcaggcagatcgaagagggcgcgtttcggcccggcgatcgcctgccgacgcttcgggagctcgcggaccggtttggcgtgagccgcgccaccgtccgcgaggcgttgagcgcgctgcgcggccaggggctcgtcgagttccgccacggcatggggacctacgtgcgggcggcttcggtggagatgtggatgcagccgctggacgcagcgatcctcctcagctacgacaacgtgcgcgatctcgtcgagctccagacggccgtgctggcgcagatcgcgtatcgcgccgcggcccagcgcatggagtccgactactccgtgctgtcacacgcgctgtttgagctcgaggcttcgcctcgccgcggcgagcaccgcattgcgagcgaactcaagttcttcagcgttctcgccgaactcgccggaaaccgcttgctggagaatgcgcttcgcgtgttgcaggaggccctccggtccagccttcgactcctgaatccgaaattggatctcggcgtccaggcatgtcggagggtctacaacgcggttcaaacagggcggccggctgacgctcgcgacgccgtgtatgcgtacggtgaagccatcttgagggcggtggcggagaaaaagggaagagggcaatccgccatgatgtga

SEQ ID NO: 2173 - DNA, 732 bp, Artificial
  Substituion in SEQ ID NO 2161
ttgaatgcgctcgacccggagggggatgcgaccatgcgcgaagcttcgagcaaactgtacatggagatcgcggaggagattcgcaggcagatcgaagagggcgcgtttcggcccggcgatcgcctgccgacgcttcgggagctcgcggaccggtttggcgtgagccgcgccaccgtccgcgaggcgttgagcgcgctgcgcggccaggggctcgtcgagttccgccacggcatggggacctacgtgcgggcggcttcggtggagatgtggatgcagccgctggacgcagcgatcctcctcagctacgacaacgtgcgcgatctcgtcgagctccagacggccgtgctggcgcagatcgcgtatcgcgccgcggcccagcgcatggagtccgactactccgtgatttcacacgcgctgtttgagctcgaggcttcgcctcgccgcggcgagcaccgcattgcgagcgaactcaagttcttcagcgttctcgccgaactcgccggaaaccgcttgctggagaatgcgcttcgcgtgttgcaggaggccctccggtccagccttcgactcctgaatccgaaattggatctcggcgtccaggcatgtcggagggtctacaacgcggttcaaacagggcggccggctgacgctcgcgacgccgtgtatgcgtacggtgaagccatcttgagggcggtggcggagaaaaagggaagagggcaatccgccatgatgtga

SEQ ID NO: 2174 - DNA, 732 bp, Artificial
  Substituion in SEQ ID NO 2161
ttgaatgcgctcgacccggagggggatgcgaccatgcgcgaagcttcgagcaaactgtacatggagatcgcggaggagattcgcaggcagatcgaagagggcgcgtttcggcccggcgatcgcctgccgacgcttcgggagctcgcggaccggtttggcgtgagccgcgccaccgtccgcgaggcgttgagcgcgctgcgcggccaggggctcgtcgagttccgccacggcatggggacctacgtgcgggcggcttcggtggagatgtggatgcagccgctggacgcagcgatcctcctcagctacgacaacgtgcgcgatctcgtcgagctccagacggccgtgctggcgcagatcgcgtatcgcgccgcggcccagcgcatggagtccgactactccgtgctgtcacacgcgctgtttgagctcgaggcttcgcctcgccgcggcgagcaccgcattgcgagcgaactcaagttcttcagcgttctcgccgaactcgccggaaacaaattgctggagaatgcgcttcgcgtgttgcaggaggccctccggtccagccttcgactcctgaatccgaaattggatctcggcgtccaggcatgtcggagggtctacaacgcggttcaaacagggcggccggctgacgctcgcgacgccgtgtatgcgtacggtgaagccatcttgagggcggtggcggagaaaaagggaagagggcaatccgccatgatgtga

SEQ ID NO: 2175 - DNA, 732 bp, Artificial
  Substituion in SEQ ID NO 2161
ttgaatgcgctcgacccggagggggatgcgaccatgcgcgaagcttcgagcaaactgtacatggagatcgcggaggagattcgcaggcagatcgaagagggcgcgtttcggcccggcgatcgcctgccgacgcttcgggagctcgcggaccggtttggcgtgagccgcgccaccgtccgcgaggcgttgagcgcgctgcgcggccaggggctcgtcgagttccgccacggcatggggacctacgtgcgggcggcttcggtggagatgtggatgcagccgctggacgcagcgatcctcctcagctacgacaacgtgcgcgatctcgtcgagctccagacggccgtgctggcgcagatcgcgtatcgcgccgcggcccagcgcatggagtccgactactccgtgctgtcacacgcgctgtttgatctcgaggcttcgcctcgccgcggcgagcaccgcattgcgagcgaactcaagttcttcagcgttctcgccgaactcgccggaaaccgcttgctggagaatgcgcttcgcgtgttgcaggaggccctccggtccagccttcgactcctgaatccgaaattggatctcggcgtccaggcatgtcggagggtctacaacgcggttcaaacagggcggccggctgacgctcgcgacgccgtgtatgcgtacggtgaagccatcttgagggcggtggcggagaaaaagggaagagggcaatccgccatgatgtga

SEQ ID NO: 2176 - DNA, 732 bp, Artificial
  Substituion in SEQ ID NO 2161
ttgaatgcgctcgacccggagggggatgcgaccatgcgcgaagcttcgagcaaactgtacatggagatcgcggaggagattcgcaggcagatcgaagagggcgcgtttcggcccggcgatcgcctgccgacgcttcgggagctcgcggaccggtttggcgtgagccgcgccaccgtccgcgaggcgttgagcgcgctgcgcggccaggggctcgtcgagttccgccacggcatggggacctacgtgcgggcggcttcggtggagatgtggatgcagccgctggacgcagcgatcctcctcagctacgacaacgtgcgcgatctcgtcgagctccagacggccgtgctggcgcagatcgcgtatcgcgccgcggcccagcgcatggagtccgactactccgtgctgtcacacgcgctgtttgagctcgaggcttcgcctcgccgcggcgagcaccgcattgcgagcgaactcaagttcttcagcgttctcgccgaactcgccggaaaccgcttgctggagaatgcgcttcgcgtgttgcaggatgccctccggtccagccttcgactcctgaatccgaaattggatctcggcgtccaggcatgtcggagggtctacaacgcggttcaaacagggcggccggctgacgctcgcgacgccgtgtatgcgtacggtgaagccatcttgagggcggtggcggagaaaaagggaagagggcaatccgccatgatgtga

SEQ ID NO: 2177 - protein, 237 aa, Alicyclobacillus acidocaldarius
MLYYCSGKPPAKRVHRHLWTWPKSHLVAITGAGISVESGLPTVDDMVAGVPLRSLFQPNIWREQPLEAFHAFRVIAREWQRKRPNRAHLALAQAEIPIITQNIDGLHRAAGSTRVIELHGNLRELRCDACGGIFQSELAWREQLPKCPTCGELLRPGFVLEGEEVRHIARALDWVTEARGLLVVGTELQMTPVRELYEVARRRNVPIAWVRDHAEDWVPYLLGQEGGSDSLFCPGEV

SEQ ID NO: 2178 - DNA, 714 bp, Alicyclobacillus acidocaldarius
atgttatactactgttctggcaaaccacctgccaagagggtccatcgacatttgtggacttggccgaagtctcacctggttgccatcacgggagcgggcatcagcgtggaaagtggtttacccacggtcgacgatatggtcgcaggggttccacttcggagcttgtttcagccgaacatatggcgggaacaaccccttgaggcgtttcacgcgtttcgagtcatcgccagggagtggcagcggaagcggccgaaccgggcacatttggcactggctcaagcagagattcccatcatcacgcagaacattgatggtctgcacagggccgcgggaagcacgcgggtcatcgagttgcacggcaatctgcgcgaattgaggtgcgatgcatgcggcggtatttttcagtccgagttggcgtggagggaacaacttccgaagtgtccaacctgcggcgaactgcttcgccccgggttcgtcttggaaggcgaggaggtgcgccacattgcgcgagcgttggactgggtgacggaagcgcgagggctgctcgtcgtgggcacggaactgcaaatgacgccggttcgcgagttgtacgaagtggccagaaggcgaaacgtcccgatcgcgtgggtgcgcgatcatgcggaggattgggttccctatttgctcggacaggagggtggctcggattctcttttttgcccgggtgaagtatag

SEQ ID NO: 2179 - protein, 181 aa, Carboxydothermus hydrogenoformans Z-2901
HAIAFTGAGVSTESGIPDFRGNSGLWEQYPVEKVASRRALMENPAFFLNFYRERFKSYANVKPNRAHEALARMEKAGIIKGIVTQNIDGLHQKAGSKNVIEIHGTLKRVRCDRCGKYYLPEKLDEEEVPRCNCGGVIRPDVVLFGEALPRREWQIALELAERSDLVLVVGSSLVVTPANQI

SEQ ID NO: 2180 - protein, 194 aa, Thermoproteus neutrophilus V24Sta
VVFTGAGVSAESGIPTFRGAGGLWERYRAEDLATPEAFARDPKLVWEWYRWRQTLAYNARPNPAHYAIAQLEEAGLVKAVITQNVDGLHQRAGSRRVVELHGSLWRARCVQCGAVYKLEKPVEETPPRCPRCRGLLRPDVVWFGEPLPREAWEEAVQLASSADVVLVVGTSGAVYPAAAIPQIAKRRGAAVVEV

SEQ ID NO: 2181 - protein, 180 aa, Caldivirga maquilingensis IC-167
HAIAFTGAGISTESGIPDFRGPQGLWRRFDPALASIDYLNTDPKGFWEFYIERFRVLNNARPNKAHLALAELEKLGIIKYVITQNIDNLHQSAGSINVIELHGNYTTVYCMRCKTQYPFTLALRKYEEGENPPRCPKCGGILRPNVVLFGEPVNEINRALEIAALSDVALVVGSSLTVYP

SEQ ID NO: 2182 - protein, 190 aa, Archaeoglobus fulgidus
YLVALTGAGVSAESGIPTFRGKDGLWNRYRPEELANPQAFAKDPEKVWKWYAWRMEKVFNAQPNKAHQAFAELERLGVLKCLITQNVDGLHERAGSRNVIHLHGSLRVVRCTSCNNSFEVESAPKIPPLPKCDKCGSLLRPGVVWAGEMLPPDVLDAAMREVERADVIIVAGTSAVVQPAASLPLIVKQR

SEQ ID NO: 2183 - protein, 190 aa, Archaeoglobus fulgidus
YLVALTGAGVSAESGIPTFRGKDGLWNRYRPEELANPQAFAKDPEKVWKWYAWRMEKVFNAQPNKAHQAFAELERLGVLKCLITQNVDDLHERAGSRNVIHLHGSLRVVRCTSCNNSFEVESAPKIPPLPKCDKCGSLLRPGVVWAGEMLPPDVLDRAMREVERADVIIVAGTSAVVQPAASLPLIVKQR

SEQ ID NO: 2184 - protein, 237 aa, Artificial
  Substituion in SEQ ID NO 2177
MLYYCSGKPPAKRVHRHLWTWPKSHLVAITGAGISVESGLPTVDDMVAGVPLRSLFQPNIWREQPLEAFHAFRVIAREWQRKRPNRAHLALAQAEIPIITQNIDGLHRAAGSTRVIELHGNLRELRCDACGGIFQSELAWREQLPKCPTCGELLRPGFVLEGEEVRHIARALDWVTEAKGLLVVGTELQMTPVRELYEVARRRNVPIAWVRDHAEDWVPYLLGQEGGSDSLFCPGEV

SEQ ID NO: 2185 - protein, 237 aa, Artificial
  Substituion in SEQ ID NO 2177
MLYYCSGKPPAKRVHRHLWTWPKSHLVAITGAGISVESGLPTVDDMVAGVPLRSLFQPNIWREQPLEAFHAFRVIARDWQRKRPNRAHLALAQAEIPIITQNIDGLHRAAGSTRVIELHGNLRELRCDACGGIFQSELAWREQLPKCPTCGELLRPGFVLEGEEVRHIARALDWVTEARGLLVVGTELQMTPVRELYEVARRRNVPIAWVRDHAEDWVPYLLGQEGGSDSLFCPGEV

SEQ ID NO: 2186 - protein, 237 aa, Artificial
  Substituion in SEQ ID NO 2177
MLYYCSGKPPAKRVHRHLWTWPKSHLVAITGAGISVESGLPTVDDMVAGVPLRSLFQPNIWREQPLEAFHAFRVIAREWQRKRPNRAHLALAQAEIPIITQNIDGLHRAAGSTRVIELHGNLRELRCDACGGIFQSELAWREQLPKCPTCGELLRPGFVLDGEEVRHIARALDWVTEARGLLVVGTELQMTPVRELYEVARRRNVPIAWVRDHAEDWVPYLLGQEGGSDSLFCPGEV

SEQ ID NO: 2187 - protein, 237 aa, Artificial
  Substituion in SEQ ID NO 2177
MLYYCSGKPPAKRVHRHLWTWPKSHLVAITGAGISVESGLPTVDDMVAGVPLRSLFQPNIWREQPLEAFHAFRVIAREWQRKRPNRAHLALAQAEIPIITQNIDGLHRAAGSTRVIELHGNLRELRCDACGGIFQSDLAWREQLPKCPTCGELLRPGFVLEGEEVRHIARALDWVTEARGLLVVGTELQMTPVRELYEVARRRNVPIAWVRDHAEDWVPYLLGQEGGSDSLFCPGEV

SEQ ID NO: 2188 - protein, 237 aa, Artificial
  Substituion in SEQ ID NO 2177
MLYYCSGKPPAKRVHRHLWTWPRSHLVAITGAGISVESGLPTVDDMVAGVPLRSLFQPNIWREQPLEAFHAFRVIAREWQRKRPNRAHLALAQAEIPIITQNIDGLHRAAGSTRVIELHGNLRELRCDACGGIFQSELAWREQLPKCPTCGELLRPGFVLEGEEVRHIARALDWVTEARGLLVVGTELQMTPVRELYEVARRRNVPIAWVRDHAEDWVPYLLGQEGGSDSLFCPGEV

SEQ ID NO: 2189 - DNA, 714 bp, Artificial
  Substituion in SEQ ID NO 2178
atgttatactactgttctggcaaaccacctgccaagagggtccatcgacatttgtggacttggccgaagtctcacctggttgccatcacgggagcgggcatcagcgtggaaagtggtttacccacggtcgacgatatggtcgcaggggttccacttcggagcttgtttcagccgaacatatggcgggaacaaccccttgaggcgtttcacgcgtttcgagtcatcgccagggagtggcagcggaagcggccgaaccgggcacatttggcactggctcaagcagagattcccatcatcacgcagaacattgatggtctgcacagggccgcgggaagcacgcgggtcatcgagttgcacggcaatctgcgcgaattgaggtgcgatgcatgcggcggtatttttcagtccgagttggcgtggagggaacaacttccgaagtgtccaacctgcggcgaactgcttcgccccgggttcgtcttggaaggcgaggaggtgcgccacattgcgcgagcgttggactgggtgacggaagcgaaagggctgctcgtcgtgggcacggaactgcaaatgacgccggttcgcgagttgtacgaagtggccagaaggcgaaacgtcccgatcgcgtgggtgcgcgatcatgcggaggattgggttccctatttgctcggacaggagggtggctcggattctcttttttgcccgggtgaagtatag

SEQ ID NO: 2190 - DNA, 714 bp, Artificial
  Substituion in SEQ ID NO 2178
atgttatactactgttctggcaaaccacctgccaagagggtccatcgacatttgtggacttggccgaagtctcacctggttgccatcacgggagcgggcatcagcgtggaaagtggtttacccacggtcgacgatatggtcgcaggggttccacttcggagcttgtttcagccgaacatatggcgggaacaaccccttgaggcgtttcacgcgtttcgagtcatcgccagggattggcagcggaagcggccgaaccgggcacatttggcactggctcaagcagagattcccatcatcacgcagaacattgatggtctgcacagggccgcgggaagcacgcgggtcatcgagttgcacggcaatctgcgcgaattgaggtgcgatgcatgcggcggtatttttcagtccgagttggcgtggagggaacaacttccgaagtgtccaacctgcggcgaactgcttcgccccgggttcgtcttggaaggcgaggaggtgcgccacattgcgcgagcgttggactgggtgacggaagcgcgagggctgctcgtcgtgggcacggaactgcaaatgacgccggttcgcgagttgtacgaagtggccagaaggcgaaacgtcccgatcgcgtgggtgcgcgatcatgcggaggattgggttccctatttgctcggacaggagggtggctcggattctcttttttgcccgggtgaagtatag

SEQ ID NO: 2191 - DNA, 714 bp, Artificial
  Substituion in SEQ ID NO 2178
atgttatactactgttctggcaaaccacctgccaagagggtccatcgacatttgtggacttggccgaagtctcacctggttgccatcacgggagcgggcatcagcgtggaaagtggtttacccacggtcgacgatatggtcgcaggggttccacttcggagcttgtttcagccgaacatatggcgggaacaaccccttgaggcgtttcacgcgtttcgagtcatcgccagggagtggcagcggaagcggccgaaccgggcacatttggcactggctcaagcagagattcccatcatcacgcagaacattgatggtctgcacagggccgcgggaagcacgcgggtcatcgagttgcacggcaatctgcgcgaattgaggtgcgatgcatgcggcggtatttttcagtccgagttggcgtggagggaacaacttccgaagtgtccaacctgcggcgaactgcttcgccccgggttcgtcttggatggcgaggaggtgcgccacattgcgcgagcgttggactgggtgacggaagcgcgagggctgctcgtcgtgggcacggaactgcaaatgacgccggttcgcgagttgtacgaagtggccagaaggcgaaacgtcccgatcgcgtgggtgcgcgatcatgcggaggattgggttccctatttgctcggacaggagggtggctcggattctcttttttgcccgggtgaagtatag

SEQ ID NO: 2192 - DNA, 714 bp, Artificial
  Substituion in SEQ ID NO 2178
atgttatactactgttctggcaaaccacctgccaagagggtccatcgacatttgtggacttggccgaagtctcacctggttgccatcacgggagcgggcatcagcgtggaaagtggtttacccacggtcgacgatatggtcgcaggggttccacttcggagcttgtttcagccgaacatatggcgggaacaaccccttgaggcgtttcacgcgtttcgagtcatcgccagggagtggcagcggaagcggccgaaccgggcacatttggcactggctcaagcagagattcccatcatcacgcagaacattgatggtctgcacagggccgcgggaagcacgcgggtcatcgagttgcacggcaatctgcgcgaattgaggtgcgatgcatgcggcggtatttttcagtccgatttggcgtggagggaacaacttccgaagtgtccaacctgcggcgaactgcttcgccccgggttcgtcttggaaggcgaggaggtgcgccacattgcgcgagcgttggactgggtgacggaagcgcgagggctgctcgtcgtgggcacggaactgcaaatgacgccggttcgcgagttgtacgaagtggccagaaggcgaaacgtcccgatcgcgtgggtgcgcgatcatgcggaggattgggttccctatttgctcggacaggagggtggctcggattctcttttttgcccgggtgaagtatag

SEQ ID NO: 2193 - DNA, 714 bp, Artificial
  Substituion in SEQ ID NO 2178
atgttatactactgttctggcaaaccacctgccaagagggtccatcgacatttgtggacttggccgcgttctcacctggttgccatcacgggagcgggcatcagcgtggaaagtggtttacccacggtcgacgatatggtcgcaggggttccacttcggagcttgtttcagccgaacatatggcgggaacaaccccttgaggcgtttcacgcgtttcgagtcatcgccagggagtggcagcggaagcggccgaaccgggcacatttggcactggctcaagcagagattcccatcatcacgcagaacattgatggtctgcacagggccgcgggaagcacgcgggtcatcgagttgcacggcaatctgcgcgaattgaggtgcgatgcatgcggcggtatttttcagtccgagttggcgtggagggaacaacttccgaagtgtccaacctgcggcgaactgcttcgccccgggttcgtcttggaaggcgaggaggtgcgccacattgcgcgagcgttggactgggtgacggaagcgcgagggctgctcgtcgtgggcacggaactgcaaatgacgccggttcgcgagttgtacgaagtggccagaaggcgaaacgtcccgatcgcgtgggtgcgcgatcatgcggaggattgggttccctatttgctcggacaggagggtggctcggattctcttttttgcccgggtgaagtatag

SEQ ID NO: 2194 - protein, 92 aa, Alicyclobacillus acidocaldarius
MVMKMFEKETIVRLRGGLFARAAAKFVQEATRFKSEVFVERDGKTVNAKSIMGVMSLAIPSGERVIIRASGTDEQAAVHQLTKLIESEELFV

SEQ ID NO: 2195 - DNA, 279 bp, Alicyclobacillus acidocaldarius
ttggtgatgaaaatgtttgagaaagagacgattgtccgcctgcgcggcggtttgtttgcgcgtgcggccgccaagttcgttcaagaggcgacgcgcttcaagtcggaagtgtttgtggagagggacggcaagacggtgaacgccaagagcatcatgggcgtcatgagcctcgccattccgtccggtgagcgcgtcatcattcgggcgagcggcacggatgagcaggccgcggtgcatcagttgacgaagctcatcgagtccgaagaactgttcgtgtga

SEQ ID NO: 2196 - protein, 63 aa, Bacillus sp. SG-1
FVQEANRFSSEVFLERNGKKVNAKSIMGLMSLAVSSGTEITLIADGTDEEQAVKHLTEFVQKE

SEQ ID NO: 2197 - protein, 65 aa, Paenibacillus larvae subsp. larvae BRL-230010
FVQEANKFSSEIFVEKDEKKVNAKSIMGIMSLAISTGTEIYISAEGSDDEQAVNALVSLVSKEEL

SEQ ID NO: 2198 - protein, 84 aa, Bacillus halodurans C-125
MVEKQVEVKLKTGLQARPAALFVQEANRFTSEIFIEKDGKKVNAKSIMGLMSLAIGSGSTITLITEGNDEQEAMEALIAFIEKE

SEQ ID NO: 2199 - protein, 84 aa, Bacillus sp. NRRL B-14911
MVEKQVEVKLRTGLQARPAALFVQEANRFSSDIFLEKDGKKVNAKSIMGLMSLAVSTGSVVNLVADGSDEEEALEELSQYIQQE

SEQ ID NO: 2200 - protein, 84 aa, Bacillus pumilus SAFR-032; identical to SEQ ID NO: 803

SEQ ID NO: 2201 - protein, 92 aa, Artificial
  Substituion in SEQ ID NO 2194
MVMKMFEKETIVRLKGGLFARAAAKFVQEATRFKSEVFVERDGKTVNAKSIMGVMSLAIPSGERVIIRASGTDEQAAVHQLTKLIESEELFV

SEQ ID NO: 2202 - protein, 92 aa, Artificial
  Substituion in SEQ ID NO 2194
MVMKMFEKETIVRLRGGLFARAAAKFVQEATRFKSEVFVERDGKTVNAKSIMGVMSLAIPSGERVIIRASGTDEQAAVHNLTKLIESEELFV

SEQ ID NO: 2203 - protein, 92 aa, Artificial
  Substituion in SEQ ID NO 2194
MVMKMFEKETIVRLRGGLFARAAAKFVQEATRFKSEVFVERDGKTVNAKSIMGVMSLAIPSGERVIIRASGTDEQAAVHQLTKLLESEELFV

SEQ ID NO: 2204 - protein, 92 aa, Artificial
  Substituion in SEQ ID NO 2194
MVMKMFEKETIVRLRGGLFARAAAKFVQEATRFKSEVFVERDGKTVNAKSIMGVMSLAIPSGERVIIRASGTDEQAAVHQLTKLIESEEIFV

SEQ ID NO: 2205 - protein, 92 aa, Artificial
  Substituion in SEQ ID NO 2194
MVMKMFEKETIVRLRGGLFARAAAKFVQEATRFKSEVFVERDGKTVNAKSIMGVMSLAIPSGERVIIRASGTDDQAAVHQLTKLIESEELFV

SEQ ID NO: 2206 - DNA, 279 bp, Artificial
  Substituion in SEQ ID NO 2195
ttggtgatgaaaatgtttgagaaagagacgattgtccgcctgaaaggcggtttgtttgcgcgtgcggccgccaagttcgttcaagaggcgacgcgcttcaagtcggaagtgtttgtggagagggacggcaagacggtgaacgccaagagcatcatgggcgtcatgagcctcgccattccgtccggtgagcgcgtcatcattcgggcgagcggcacggatgagcaggccgcggtgcatcagttgacgaagctcatcgagtccgaagaactgttcgtgtga

SEQ ID NO: 2207 - DNA, 279 bp, Artificial
  Substituion in SEQ ID NO 2195
ttggtgatgaaaatgtttgagaaagagacgattgtccgcctgcgcggcggtttgtttgcgcgtgcggccgccaagttcgttcaagaggcgacgcgcttcaagtcggaagtgtttgtggagagggacggcaagacggtgaacgccaagagcatcatgggcgtcatgagcctcgccattccgtccggtgagcgcgtcatcattcgggcgagcggcacggatgagcaggccgcggtgcataatttgacgaagctcatcgagtccgaagaactgttcgtgtga

SEQ ID NO: 2208 - DNA, 279 bp, Artificial
  Substituion in SEQ ID NO 2195
ttggtgatgaaaatgtttgagaaagagacgattgtccgcctgcgcggcggtttgtttgcgcgtgcggccgccaagttcgttcaagaggcgacgcgcttcaagtcggaagtgtttgtggagagggacggcaagacggtgaacgccaagagcatcatgggcgtcatgagcctcgccattccgtccggtgagcgcgtcatcattcgggcgagcggcacggatgagcaggccgcggtgcatcagttgacgaagctcttagagtccgaagaactgttcgtgtga

SEQ ID NO: 2209 - DNA, 279 bp, Artificial
  Substituion in SEQ ID NO 2195
ttggtgatgaaaatgtttgagaaagagacgattgtccgcctgcgcggcggtttgtttgcgcgtgcggccgccaagttcgttcaagaggcgacgcgcttcaagtcggaagtgtttgtggagagggacggcaagacggtgaacgccaagagcatcatgggcgtcatgagcctcgccattccgtccggtgagcgcgtcatcattcgggcgagcggcacggatgagcaggccgcggtgcatcagttgacgaagctcatcgagtccgaagaaattttcgtgtga

SEQ ID NO: 2210 - DNA, 279 bp, Artificial
  Substituion in SEQ ID NO 2195
ttggtgatgaaaatgtttgagaaagagacgattgtccgcctgcgcggcggtttgtttgcgcgtgcggccgccaagttcgttcaagaggcgacgcgcttcaagtcggaagtgtttgtggagagggacggcaagacggtgaacgccaagagcatcatgggcgtcatgagcctcgccattccgtccggtgagcgcgtcatcattcgggcgagcggcacggatgatcaggccgcggtgcatcagttgacgaagctcatcgagtccgaagaactgttcgtgtga

SEQ ID NO: 2211 - protein, 315 aa, Alicyclobacillus acidocaldarius
MANLRGVSVRQLVRDLDLHVFNEDADLDRMIYTRDINRPGLALAGYLRYHPAERVQILGRTELSFLRGLNEKERALRAFAFCSYQQTPCIIITRGDTPPPVLLEEAASRRIPVLGTPMVTTRLTARISNYLEDKLAPETLQHGVLVDVYGIGILIIGSSGIGKSETGLELIKRGHRLVADDAVVIRQISDDYLVGSAPPLLQNLIEIRGLGVLNAMTLFGAGAVRTHKRISMVVHLEAWRDNHAYDRLGIETETMKILDIELPKVTVPVRPGRNLAVIVEVAAMNFRLKGMGLDAAKQFAAELEQMIAAQSEGSA

SEQ ID NO: 2212 - DNA, 948 bp, Alicyclobacillus acidocaldarius
gtggccaatctgcggggagtgagtgtcaggcagctggtgcgcgatctcgatctgcacgtgttcaatgaggacgcggatctggaccgcatgatctacacgcgcgacatcaaccgcccagggctggcgctcgccggctacctgcgctatcacccggcggagcgcgtgcagatcctgggcagaaccgagctgtcgtttttgcgcggtctcaacgagaaggaaagggccctgcgcgcgtttgccttctgttcgtatcagcagacgccttgcatcatcatcacgcgcggcgacacgccgccgccggtgttgctggaggaagccgcttctcgccgcatcccggtgctcggcacgcccatggtgacgacgcgcctgaccgcgcgcatctccaactacctcgaggacaagctggctccggagaccttacagcacggcgtgctggtcgacgtgtacggcattgggattctcatcatcggctcgagcgggatcggcaagagcgagacggggcttgagctcatcaagcgcggccaccggctcgtggcggacgacgcggtcgtcattcggcagatctccgacgactacctcgtcggcagcgcgccgccattgttgcagaacctcatcgaaattcgcggccttggcgtcctgaacgccatgaccttgtttggcgccggggccgtacggacgcacaagcgcatctcgatggtcgtgcacctcgaggcttggcgcgataaccacgcgtacgatcgcctcggcatcgagacggagaccatgaagatcctggacatcgagctgccgaaggtgacggtgccggtccggcccgggcgcaacctcgccgtcatcgtggaggtcgcggccatgaacttccgcctgaagggcatggggctcgacgcggcgaagcagtttgcggcggaattggagcagatgatcgcggcacagtcggaaggaagcgcctga

SEQ ID NO: 2213 - protein, 302 aa, Paenibacillus larvae subsp. larvae BRL-230010
VKVADLVRTFKLEVISGEEGLKRTITVADLYRPGLEMAGYFNYHPQERVQLLGKTEMSFYETLTGPIRQRRARQLCTSPETPCIIITRGLDIPDEIIEEAAKHHLPVLRSKVATTILASRLTNYLENKLAPSTTIHGVLVDVYGVGMLITGGSGIGKSETALELVKRGHRLVADDAVEIRQTADYVLSGNAPELIRHLLEIRGVGIINVMTLFGAGAVRNEKKISVVVKLETWQQDKQYDRLGLDEETTRIIDTDLPLVTIPVRPGRNLAVIIEVAAMNYRLKRMGYNAALQFTNRLTETIA

SEQ ID NO: 2214 - protein, 300 aa, Geobacillus kaustophilus HTA426
VRTKDIIEQFQLELVSGAEGIYRPITTSDLSRPGIEMAGYFAYYPAERLQLLGRTELSFYETLTPEEKKSRMERLCTDITPGIIVSRGLEVPPELIEASERQSVPVMRSTMKTTRLSSRLTNYLESKLAPTTAVHGVLVDVYGVGVLITGKSGVGKSETALELVKRGHRLVADDCVEIRQEDEDTLVGSAPELIEHLLEIRGLGIINMMTLFGAGAVRTHKRISLVVDLELWDPEKQYDRLGLEEEKVKILDTELPKLTIPVRPGRNLAVIVEVAAMNFRLKRLGVNAAEEFSARLSDAI

SEQ ID NO: 2215 - protein, 302 aa, Geobacillus stearothermophilus
VKVSELVNQFGLEVISGEQGLKRAITVDDLYRPGLEMAGYFEYHPPERVQILGKTELAFFEMLPEKERKDRMERLCSSDETPCIIVTRSWKVPEELIEISSEKQIPVLRSSMATAILSSRITSFLERKLAPTATIHGVLVDVYGVGMLITGSSGIGKSETALELVKRGHRLIADDAVEIRQTSDNQLHGTAPELIRHLLEIRGVGIINVMTLFGAGSIRNNKRISLVVRLEAWQQEKQYDRLGLDEETTRIIDTDVPLVTIPVRPGRNLAVIIEVAAMNFRLKRMGYNAALQFTTKLTETIS

SEQ ID NO: 2216 - protein, 300 aa, Geobacillus thermodenitrificans NG80-2
VRTKDIIEQFQLELVSGAEGIYRPITTSDLSRPGIEMAGYFAYYPAERLQLLGRTELSFYETLTPEEKRARMQRLCTDITPGIIVSRGLDVPPELIEASERQSVPVMRSTMKTTRLSSRLTNYLESKLAPTTAVHGVLVDVYGVGVLITGKSGVGKSETALELVKRGHRLVADDCVEIRQEDEDTLIGSAPELIEHLLEIRGLGIINMMTLFGAGAVLPHKRISLVIDLELWDPEKQYDRLGLEEEKMKILDIELPRLTIPVRPGRNLAVIVEVAAMNFRLKRMGVNAAEEFSARLSDAI

SEQ ID NO: 2217 - protein, 300 aa, Bacillus cereus subsp. cytotoxis NVH 391-98
VRTKDLIEQFQLELVSGEEGIHRPIDTSDLSRPGIEMAGFFTYYPADRVQLLGKTELTFFDTLTNDQKQERMKALCTEETPCIIVTRNQDVPKELLQASRESGVPLLRSSQTTTRLSSRLTNYLEGKLAPTTAVHGVLVDVYGVGVLIIGQSGVGKSETALELVKRGHRLVADDSVEIRQEDEDTLVGSSPDLIEHLLEIRGLGIINVMTLFGAGAVRNYKRITLVINLEIWDQNKNYDRLGLDEEKMKIIDTELTKITLPVRPGRNLAVIIEVAAMNFRLKRMGVNAAQQFSERLMSAI

SEQ ID NO: 2218 - protein, 315 aa, Artificial
  Substituion in SEQ ID NO 2211
MANLRGVSVRQLVRDLDLHVFNEDADLDRMIYTRDINRPGLALAGYLRYHPAERVQILGRTELSFLKGLNEKERALRAFAFCSYQQTPCIIITRGDTPPPVLLEEAASRRIPVLGTPMVTTRLTARISNYLEDKLAPETLQHGVLVDVYGIGILIIGSSGIGKSETGLELIKRGHRLVADDAVVIRQISDDYLVGSAPPLLQNLIEIRGLGVLNAMTLFGAGAVRTHKRISMVVHLEAWRDNHAYDRLGIETETMKILDIELPKVTVPVRPGRNLAVIVEVAAMNFRLKGMGLDAAKQFAAELEQMIAAQSEGSA

SEQ ID NO: 2219 - protein, 315 aa, Artificial
  Substituion in SEQ ID NO 2211
MANLRGVSVRQLVRDLDLHVFNEDADLDRMIYTRDINRPGLALAGYLRYHPAERVQILGRTELSFLRGLNEKERALRAFAFCSYQQTPCIIITRGDTPPPVLLEEAASRRIPILGTPMVTTRLTARISNYLEDKLAPETLQHGVLVDVYGIGILIIGSSGIGKSETGLELIKRGHRLVADDAVVIRQISDDYLVGSAPPLLQNLIEIRGLGVLNAMTLFGAGAVRTHKRISMVVHLEAWRDNHAYDRLGIETETMKILDIELPKVTVPVRPGRNLAVIVEVAAMNFRLKGMGLDAAKQFAAELEQMIAAQSEGSA

SEQ ID NO: 2220 - protein, 315 aa, Artificial
  Substituion in SEQ ID NO 2211
MANLRGVSVRQLVRDLDLHVFNEDADLDRMIYTRDINRPGLALAGYIRYHPAERVQILGRTELSFLRGLNEKERALRAFAFCSYQQTPCIIITRGDTPPPVLLEEAASRRIPVLGTPMVTTRLTARISNYLEDKLAPETLQHGVLVDVYGIGILIIGSSGIGKSETGLELIKRGHRLVADDAVVIRQISDDYLVGSAPPLLQNLIEIRGLGVLNAMTLFGAGAVRTHKRISMVVHLEAWRDNHAYDRLGIETETMKILDIELPKVTVPVRPGRNLAVIVEVAAMNFRLKGMGLDAAKQFAAELEQMIAAQSEGSA

SEQ ID NO: 2221 - protein, 315 aa, Artificial
  Substituion in SEQ ID NO 2211
MANLRGVSVRQLVRDIDLHVFNEDADLDRMIYTRDINRPGLALAGYLRYHPAERVQILGRTELSFLRGLNEKERALRAFAFCSYQQTPCIIITRGDTPPPVLLEEAASRRIPVLGTPMVTTRLTARISNYLEDKLAPETLQHGVLVDVYGIGILIIGSSGIGKSETGLELIKRGHRLVADDAVVIRQISDDYLVGSAPPLLQNLIEIRGLGVLNAMTLFGAGAVRTHKRISMVVHLEAWRDNHAYDRLGIETETMKILDIELPKVTVPVRPGRNLAVIVEVAAMNFRLKGMGLDAAKQFAAELEQMIAAQSEGSA

SEQ ID NO: 2222 - protein, 315 aa, Artificial
  Substituion in SEQ ID NO 2211
MANLRGVSVRQLIRDLDLHVFNEDADLDRMIYTRDINRPGLALAGYLRYHPAERVQILGRTELSFLRGLNEKERALRAFAFCSYQQTPCIIITRGDTPPPVLLEEAASRRIPVLGTPMVTTRLTARISNYLEDKLAPETLQHGVLVDVYGIGILIIGSSGIGKSETGLELIKRGHRLVADDAVVIRQISDDYLVGSAPPLLQNLIEIRGLGVLNAMTLFGAGAVRTHKRISMVVHLEAWRDNHAYDRLGIETETMKILDIELPKVTVPVRPGRNLAVIVEVAAMNFRLKGMGLDAAKQFAAELEQMIAAQSEGSA

SEQ ID NO: 2223 - DNA, 948 bp, Artificial
  Substituion in SEQ ID NO 2212
gtggccaatctgcggggagtgagtgtcaggcagctggtgcgcgatctcgatctgcacgtgttcaatgaggacgcggatctggaccgcatgatctacacgcgcgacatcaaccgcccagggctggcgctcgccggctacctgcgctatcacccggcggagcgcgtgcagatcctgggcagaaccgagctgtcgtttttgaaaggtctcaacgagaaggaaagggccctgcgcgcgtttgccttctgttcgtatcagcagacgccttgcatcatcatcacgcgcggcgacacgccgccgccggtgttgctggaggaagccgcttctcgccgcatcccggtgctcggcacgcccatggtgacgacgcgcctgaccgcgcgcatctccaactacctcgaggacaagctggctccggagaccttacagcacggcgtgctggtcgacgtgtacggcattgggattctcatcatcggctcgagcgggatcggcaagagcgagacggggcttgagctcatcaagcgcggccaccggctcgtggcggacgacgcggtcgtcattcggcagatctccgacgactacctcgtcggcagcgcgccgccattgttgcagaacctcatcgaaattcgcggccttggcgtcctgaacgccatgaccttgtttggcgccggggccgtacggacgcacaagcgcatctcgatggtcgtgcacctcgaggcttggcgcgataaccacgcgtacgatcgcctcggcatcgagacggagaccatgaagatcctggacatcgagctgccgaaggtgacggtgccggtccggcccgggcgcaacctcgccgtcatcgtggaggtcgcggccatgaacttccgcctgaagggcatggggctcgacgcggcgaagcagtttgcggcggaattggagcagatgatcgcggcacagtcggaaggaagcgcctga

SEQ ID NO: 2224 - DNA, 948 bp, Artificial
  Substituion in SEQ ID NO 2212
gtggccaatctgcggggagtgagtgtcaggcagctggtgcgcgatctcgatctgcacgtgttcaatgaggacgcggatctggaccgcatgatctacacgcgcgacatcaaccgcccagggctggcgctcgccggctacctgcgctatcacccggcggagcgcgtgcagatcctgggcagaaccgagctgtcgtttttgcgcggtctcaacgagaaggaaagggccctgcgcgcgtttgccttctgttcgtatcagcagacgccttgcatcatcatcacgcgcggcgacacgccgccgccggtgttgctggaggaagccgcttctcgccgcatcccgattctcggcacgcccatggtgacgacgcgcctgaccgcgcgcatctccaactacctcgaggacaagctggctccggagaccttacagcacggcgtgctggtcgacgtgtacggcattgggattctcatcatcggctcgagcgggatcggcaagagcgagacggggcttgagctcatcaagcgcggccaccggctcgtggcggacgacgcggtcgtcattcggcagatctccgacgactacctcgtcggcagcgcgccgccattgttgcagaacctcatcgaaattcgcggccttggcgtcctgaacgccatgaccttgtttggcgccggggccgtacggacgcacaagcgcatctcgatggtcgtgcacctcgaggcttggcgcgataaccacgcgtacgatcgcctcggcatcgagacggagaccatgaagatcctggacatcgagctgccgaaggtgacggtgccggtccggcccgggcgcaacctcgccgtcatcgtggaggtcgcggccatgaacttccgcctgaagggcatggggctcgacgcggcgaagcagtttgcggcggaattggagcagatgatcgcggcacagtcggaaggaagcgcctga

SEQ ID NO: 2225 - DNA, 948 bp, Artificial
  Substituion in SEQ ID NO 2212
gtggccaatctgcggggagtgagtgtcaggcagctggtgcgcgatctcgatctgcacgtgttcaatgaggacgcggatctggaccgcatgatctacacgcgcgacatcaaccgcccagggctggcgctcgccggctacattcgctatcacccggcggagcgcgtgcagatcctgggcagaaccgagctgtcgtttttgcgcggtctcaacgagaaggaaagggccctgcgcgcgtttgccttctgttcgtatcagcagacgccttgcatcatcatcacgcgcggcgacacgccgccgccggtgttgctggaggaagccgcttctcgccgcatcccggtgctcggcacgcccatggtgacgacgcgcctgaccgcgcgcatctccaactacctcgaggacaagctggctccggagaccttacagcacggcgtgctggtcgacgtgtacggcattgggattctcatcatcggctcgagcgggatcggcaagagcgagacggggcttgagctcatcaagcgcggccaccggctcgtggcggacgacgcggtcgtcattcggcagatctccgacgactacctcgtcggcagcgcgccgccattgttgcagaacctcatcgaaattcgcggccttggcgtcctgaacgccatgaccttgtttggcgccggggccgtacggacgcacaagcgcatctcgatggtcgtgcacctcgaggcttggcgcgataaccacgcgtacgatcgcctcggcatcgagacggagaccatgaagatcctggacatcgagctgccgaaggtgacggtgccggtccggcccgggcgcaacctcgccgtcatcgtggaggtcgcggccatgaacttccgcctgaagggcatggggctcgacgcggcgaagcagtttgcggcggaattggagcagatgatcgcggcacagtcggaaggaagcgcctga

SEQ ID NO: 2226 - DNA, 948 bp, Artificial
  Substituion in SEQ ID NO 2212
gtggccaatctgcggggagtgagtgtcaggcagctggtgcgcgatattgatctgcacgtgttcaatgaggacgcggatctggaccgcatgatctacacgcgcgacatcaaccgcccagggctggcgctcgccggctacctgcgctatcacccggcggagcgcgtgcagatcctgggcagaaccgagctgtcgtttttgcgcggtctcaacgagaaggaaagggccctgcgcgcgtttgccttctgttcgtatcagcagacgccttgcatcatcatcacgcgcggcgacacgccgccgccggtgttgctggaggaagccgcttctcgccgcatcccggtgctcggcacgcccatggtgacgacgcgcctgaccgcgcgcatctccaactacctcgaggacaagctggctccggagaccttacagcacggcgtgctggtcgacgtgtacggcattgggattctcatcatcggctcgagcgggatcggcaagagcgagacggggcttgagctcatcaagcgcggccaccggctcgtggcggacgacgcggtcgtcattcggcagatctccgacgactacctcgtcggcagcgcgccgccattgttgcagaacctcatcgaaattcgcggccttggcgtcctgaacgccatgaccttgtttggcgccggggccgtacggacgcacaagcgcatctcgatggtcgtgcacctcgaggcttggcgcgataaccacgcgtacgatcgcctcggcatcgagacggagaccatgaagatcctggacatcgagctgccgaaggtgacggtgccggtccggcccgggcgcaacctcgccgtcatcgtggaggtcgcggccatgaacttccgcctgaagggcatggggctcgacgcggcgaagcagtttgcggcggaattggagcagatgatcgcggcacagtcggaaggaagcgcctga

SEQ ID NO: 2227 - DNA, 948 bp, Artificial
  Substituion in SEQ ID NO 2212
gtggccaatctgcggggagtgagtgtcaggcagctgattcgcgatctcgatctgcacgtgttcaatgaggacgcggatctggaccgcatgatctacacgcgcgacatcaaccgcccagggctggcgctcgccggctacctgcgctatcacccggcggagcgcgtgcagatcctgggcagaaccgagctgtcgtttttgcgcggtctcaacgagaaggaaagggccctgcgcgcgtttgccttctgttcgtatcagcagacgccttgcatcatcatcacgcgcggcgacacgccgccgccggtgttgctggaggaagccgcttctcgccgcatcccggtgctcggcacgcccatggtgacgacgcgcctgaccgcgcgcatctccaactacctcgaggacaagctggctccggagaccttacagcacggcgtgctggtcgacgtgtacggcattgggattctcatcatcggctcgagcgggatcggcaagagcgagacggggcttgagctcatcaagcgcggccaccggctcgtggcggacgacgcggtcgtcattcggcagatctccgacgactacctcgtcggcagcgcgccgccattgttgcagaacctcatcgaaattcgcggccttggcgtcctgaacgccatgaccttgtttggcgccggggccgtacggacgcacaagcgcatctcgatggtcgtgcacctcgaggcttggcgcgataaccacgcgtacgatcgcctcggcatcgagacggagaccatgaagatcctggacatcgagctgccgaaggtgacggtgccggtccggcccgggcgcaacctcgccgtcatcgtggaggtcgcggccatgaacttccgcctgaagggcatggggctcgacgcggcgaagcagtttgcggcggaattggagcagatgatcgcggcacagtcggaaggaagcgcctga

SEQ ID NO: 2228 - protein, 360 aa, Alicyclobacillus acidocaldarius
MSLRRKIILAFFLTLSIMLVALAFILQAEVHRHFLSVVCPEINSVSPSLTQQIEVHFEQALTQSLLWTVLIFVVATAGVAVLVSRAITQRIFVMQKQALEIARGKWGTTIPVEGHDELSSLANTLNSLSKQLHKQEELRRNLIQDLAHELRTPLTTLRSHIQAFYDGLWEPNRERLYSCLEEIQRFEALVTSVERLYEADVAVHAARRDLSSADVNQVAQSVIQLFEPRCAELGIRLELRTPDVPVWVTARAQHVSQILWNLLDNAVKFTPSGGNIVVEVGHQDGKPFLSVKDSGVGIPAEEIDNIFERFYRVDKSRDRKTGGSGLGLAIVKQLVELSRGFVQVNSRVGRGSTFTVVWPE

SEQ ID NO: 2229 - DNA, 1083 bp, Alicyclobacillus acidocaldarius
ttgagtctgcggagaaagatcatactcgcttttttcctgaccttatccatcatgttggtggccttggcgtttatcctccaagccgaggttcaccgtcactttttgtcggtggtctgtccagaaatcaattcggtctcgccttcgttgacccaacaaatcgaagttcatttcgagcaggcactcacacagagcttgctgtggacggtattgatcttcgtagtggcgacggcaggtgtggcggtgttggtgtcacgggcaatcacgcagcgaatctttgtgatgcagaaacaggcgttggaaatcgcccgcggaaaatgggggacgaccatccctgttgagggtcatgacgaattgtcttcgctcgcgaatacgttgaattctctatcgaaacagctgcacaagcaagaagaactcaggagaaatctcatacaggacctcgcgcatgagcttcgcacacctttgactactctgcgttcgcatatccaagcgttttacgatggactgtgggaaccgaatcgggaacgcttgtacagctgccttgaggagattcagcgatttgaagcgcttgtgacttcggtggagaggctgtatgaggcggatgtagcggtgcacgcggcacggcgggatttatcgtccgccgatgtgaaccaggttgcgcagtccgtcatccagctcttcgagccccggtgtgctgaattgggcatccgactggagttgcgtacaccggatgtcccggtgtgggttacggctcgagcgcagcatgtgtcgcagattttgtggaacctgctggacaatgccgtgaaattcacgccatctggcggcaacattgtggtggaggttgggcaccaagacggcaaaccgtttttgtcagtcaaggacagcggcgtggggatccctgcggaggagatcgataatatattcgagcggttttatcgggtggacaagtctcgggatcgcaaaaccggtggcagcggtcttgggttggcgattgtcaagcaattggtcgaactgtcccggggctttgtgcaggtgaacagtcgggttgggcgagggtcgacgtttacggtagtttggccggaataa

SEQ ID NO: 2230 - protein, 300 aa, Desulfitobacterium hafniense Y51
FVSAIYQSLLFAGALALIIGILLSYWTSRRLISPLQNLTKAAQRVGEGHLDEHVSVMTKDEVGQLAIAFNGMADSLKKQEHLRKQFTADIAHELRTPLTSIRSYIEAFQDGVLPADKENLTIINEEIERLVGLSSDLKDLNVAEMGALKLNFTQVDITELIDKTVNKLIPLIQEKGIAFEWEKPASVFIEGDEYHLTRLFYNLIHNAYKFTESNGRISIQMELRQSDVRISVCDSGIGIPKEDLPFIFERFYRAEKSRSRETGGTGIGLALVQQITQLHRGTLDVESNPGQGSKFTVVLP

SEQ ID NO: 2231 - protein, 315 aa, Carnobacterium sp. AT7
ISYMGPTAYSEHDALFIADMKNNLIIVAIVALILSIFFAALVAKKISGPIVRVKDFTREIAKGDYTSLSPEKTDIKELDELISSVNALSVQLENQQDIRNQLSSDIAHEIRTPLTTLKGSLEAMIDGIWEITDDRLQSCYDEVNRITRLIGSIDKINEIESHQDSLNKTSFDLYALAENISSNFEALFVKKNIYYALNGDPLFITADKDKISQVITNLLSNAVKFTPPEGTITLKIRNEENQALLTIADTGEGIHPKEINRIFERFYMSDLSRNSFLGGQGIGLSIVKSIIKAHNGTITVKSDYGKGSTFTVILP

SEQ ID NO: 2232 - protein, 303 aa, Clostridium kluyveri DSM 555
DLMFLSTLNRILISVGIISLCLALILGVIISGSLSRPILRVIESAEEISKGDYSTRINENSNIIEINNLTSTINNLAETLQNQENLRKRLTADVSHELRTPLTTLQSHMEAILDGIWEPTQDRINSCHGEIMRINRMVNDLEKLAEYEGENLILNKSEFNISEVVKNIMLNFENEYVSKEIDFIFNSRDIFICADKDKISQIIINLISNALKYTRQGGKVLIQVDNKNEYLELIVQDNGQGIPKEDLPYIFERFYRADKSRNRLTGGAGIGLTITKSLVEAHKGKITVESELNKGTTFKVSIP

SEQ ID NO: 2233 - protein, 317 aa, Clostridium cellulolyticum H10
EIGTYGDNYLNEHDIAFINDLYKLLWAVGLFSLILSLLFGTVMSKRLVSPIARVINTAKSISKGFYSDRITEKSNTREINQLTVSINDLAENMEKQETLRRRLTGDVAHELRTPLATLQSHMEAMIDGIWSADSERLKSCHEEIVRISKMVGDLERLAKYESENITLNMDTFDITKLAKRQVQNFETEFLCKGLELELTGPSCLVYADKDKISQVFVNLLSNALKYTPKGGSVELHIQDNNNFIEISVEDNGLGIPEEDLPYIFERFYRADKSRDRLTGGSGIGLTICKSIVLAHGGDIYAQSNPGKGTKFIFTVPK

SEQ ID NO: 2234 - protein, 315 aa, Clostridium phytofermentans ISDg
ISYYGPYFLSENDFKFLSALNTILVSIGSVSLLFAVYIGWMLARKISGPITKTVKMTTEIAEGNYEIRFSEHTGTKELDALVSSINNLASSLEKQEGIRKQLTSDVSHELRTPLTTIGTHIEAMIEGVWEPTTERLKSCYEEINRITNLVKDLEQLAKVENDNLKLNITSVNILEVIDTIKDNFETEIYNKSLDVSVIGTASTILVDKERISQVIINLLSNAIKYTPDFGKIVISLEDYETNLVIQMKDNGIGIPEEELPFIFERFYRADKSRNRRTGGAGIGLAIVKSVVHSHGGKVEVSSKLETGTVFRVILP

SEQ ID NO: 2235 - protein, 360 aa, Artificial
  Substituion in SEQ ID NO 2228
MSLRRKIILAFFLTLSIMLVALAFILQAEVHRHFLSIVCPEINSVSPSLTQQIEVHFEQALTQSLLWTVLIFVVATAGVAVLVSRAITQRIFVMQKQALEIARGKWGTTIPVEGHDELSSLANTLNSLSKQLHKQEELRRNLIQDLAHELRTPLTTLRSHIQAFYDGLWEPNRERLYSCLEEIQRFEALVTSVERLYEADVAVHAARRDLSSADVNQVAQSVIQLFEPRCAELGIRLELRTPDVPVWVTARAQHVSQILWNLLDNAVKFTPSGGNIVVEVGHQDGKPFLSVKDSGVGIPAEEIDNIFERFYRVDKSRDRKTGGSGLGLAIVKQLVELSRGFVQVNSRVGRGSTFTVVWPE

SEQ ID NO: 2236 - protein, 360 aa, Artificial
  Substituion in SEQ ID NO 2228
MSLRRKIILAFFLTLSIMLVALAFILNAEVHRHFLSVVCPEINSVSPSLTQQIEVHFEQALTQSLLWTVLIFVVATAGVAVLVSRAITQRIFVMQKQALEIARGKWGTTIPVEGHDELSSLANTLNSLSKQLHKQEELRRNLIQDLAHELRTPLTTLRSHIQAFYDGLWEPNRERLYSCLEEIQRFEALVTSVERLYEADVAVHAARRDLSSADVNQVAQSVIQLFEPRCAELGIRLELRTPDVPVWVTARAQHVSQILWNLLDNAVKFTPSGGNIVVEVGHQDGKPFLSVKDSGVGIPAEEIDNIFERFYRVDKSRDRKTGGSGLGLAIVKQLVELSRGFVQVNSRVGRGSTFTVVWPE

SEQ ID NO: 2237 - protein, 360 aa, Artificial
  Substituion in SEQ ID NO 2228
MSLRRKIILAFFLTLSIMLVALAFILQAEVHRHFLSVVCPEINSVSPSLTQQIEVHFEQALTQSLLWTVLIFVVATAGVAVLVSRAITQRIFVMQKQALEIARGKWGTTIPVEGHDELSSLANTLNSLSKQLHKQEELRRNLIQDLAHELRTPLTTLRSHIQAFYDGLWEPNRERLYSCLEEIQRFEALVTSVERLYEADVAVHAARRDLSSADVNQVAQSVIQLFEPRCAELGIRLELRTPDVPVWVTARAQHVSQILWNLLDNAVKFTPSGGNIVVEVGHQDGKPFLSVKDSGVGIPAEELDNIFERFYRVDKSRDRKTGGSGLGLAIVKQLVELSRGFVQVNSRVGRGSTFTVVWPE

SEQ ID NO: 2238 - protein, 360 aa, Artificial
  Substituion in SEQ ID NO 2228
MSLRRKIILAFFLTLSIMLVALAFILQAEVHRHFLSVVCPEINSVSPSLTQQIEVHFEQALTQSLLWTVLIFVVATAGVAVLVSRAITQRIFVMQKQALEIARGKWGTTIPVEGHDELSSLANTLNSLSKQLHKQEELRRNLIQDLAHELRTPLTTLRSHIQAFYDGLWEPNRERLYSCLEEIQRFEALVTSVERLYEADVAVHAARRDLSSADVNQVAQSVINLFEPRCAELGIRLELRTPDVPVWVTARAQHVSQILWNLLDNAVKFTPSGGNIVVEVGHQDGKPFLSVKDSGVGIPAEEIDNIFERFYRVDKSRDRKTGGSGLGLAIVKQLVELSRGFVQVNSRVGRGSTFTVVWPE

SEQ ID NO: 2239 - protein, 360 aa, Artificial
  Substituion in SEQ ID NO 2228
MSLRRKIILAFFLTLSIMLVAIAFILQAEVHRHFLSVVCPEINSVSPSLTQQIEVHFEQALTQSLLWTVLIFVVATAGVAVLVSRAITQRIFVMQKQALEIARGKWGTTIPVEGHDELSSLANTLNSLSKQLHKQEELRRNLIQDLAHELRTPLTTLRSHIQAFYDGLWEPNRERLYSCLEEIQRFEALVTSVERLYEADVAVHAARRDLSSADVNQVAQSVIQLFEPRCAELGIRLELRTPDVPVWVTARAQHVSQILWNLLDNAVKFTPSGGNIVVEVGHQDGKPFLSVKDSGVGIPAEEIDNIFERFYRVDKSRDRKTGGSGLGLAIVKQLVELSRGFVQVNSRVGRGSTFTVVWPE

SEQ ID NO: 2240 - DNA, 1083 bp, Artificial
  Substituion in SEQ ID NO 2229
ttgagtctgcggagaaagatcatactcgcttttttcctgaccttatccatcatgttggtggccttggcgtttatcctccaagccgaggttcaccgtcactttttgtcgattgtctgtccagaaatcaattcggtctcgccttcgttgacccaacaaatcgaagttcatttcgagcaggcactcacacagagcttgctgtggacggtattgatcttcgtagtggcgacggcaggtgtggcggtgttggtgtcacgggcaatcacgcagcgaatctttgtgatgcagaaacaggcgttggaaatcgcccgcggaaaatgggggacgaccatccctgttgagggtcatgacgaattgtcttcgctcgcgaatacgttgaattctctatcgaaacagctgcacaagcaagaagaactcaggagaaatctcatacaggacctcgcgcatgagcttcgcacacctttgactactctgcgttcgcatatccaagcgttttacgatggactgtgggaaccgaatcgggaacgcttgtacagctgccttgaggagattcagcgatttgaagcgcttgtgacttcggtggagaggctgtatgaggcggatgtagcggtgcacgcggcacggcgggatttatcgtccgccgatgtgaaccaggttgcgcagtccgtcatccagctcttcgagccccggtgtgctgaattgggcatccgactggagttgcgtacaccggatgtcccggtgtgggttacggctcgagcgcagcatgtgtcgcagattttgtggaacctgctggacaatgccgtgaaattcacgccatctggcggcaacattgtggtggaggttgggcaccaagacggcaaaccgtttttgtcagtcaaggacagcggcgtggggatccctgcggaggagatcgataatatattcgagcggttttatcgggtggacaagtctcgggatcgcaaaaccggtggcagcggtcttgggttggcgattgtcaagcaattggtcgaactgtcccggggctttgtgcaggtgaacagtcgggttgggcgagggtcgacgtttacggtagtttggccggaataa

SEQ ID NO: 2241 - DNA, 1083 bp, Artificial
  Substituion in SEQ ID NO 2229
ttgagtctgcggagaaagatcatactcgcttttttcctgaccttatccatcatgttggtggccttggcgtttatcctcaatgccgaggttcaccgtcactttttgtcggtggtctgtccagaaatcaattcggtctcgccttcgttgacccaacaaatcgaagttcatttcgagcaggcactcacacagagcttgctgtggacggtattgatcttcgtagtggcgacggcaggtgtggcggtgttggtgtcacgggcaatcacgcagcgaatctttgtgatgcagaaacaggcgttggaaatcgcccgcggaaaatgggggacgaccatccctgttgagggtcatgacgaattgtcttcgctcgcgaatacgttgaattctctatcgaaacagctgcacaagcaagaagaactcaggagaaatctcatacaggacctcgcgcatgagcttcgcacacctttgactactctgcgttcgcatatccaagcgttttacgatggactgtgggaaccgaatcgggaacgcttgtacagctgccttgaggagattcagcgatttgaagcgcttgtgacttcggtggagaggctgtatgaggcggatgtagcggtgcacgcggcacggcgggatttatcgtccgccgatgtgaaccaggttgcgcagtccgtcatccagctcttcgagccccggtgtgctgaattgggcatccgactggagttgcgtacaccggatgtcccggtgtgggttacggctcgagcgcagcatgtgtcgcagattttgtggaacctgctggacaatgccgtgaaattcacgccatctggcggcaacattgtggtggaggttgggcaccaagacggcaaaccgtttttgtcagtcaaggacagcggcgtggggatccctgcggaggagatcgataatatattcgagcggttttatcgggtggacaagtctcgggatcgcaaaaccggtggcagcggtcttgggttggcgattgtcaagcaattggtcgaactgtcccggggctttgtgcaggtgaacagtcgggttgggcgagggtcgacgtttacggtagtttggccggaataa

SEQ ID NO: 2242 - DNA, 1083 bp, Artificial
  Substituion in SEQ ID NO 2229
ttgagtctgcggagaaagatcatactcgcttttttcctgaccttatccatcatgttggtggccttggcgtttatcctccaagccgaggttcaccgtcactttttgtcggtggtctgtccagaaatcaattcggtctcgccttcgttgacccaacaaatcgaagttcatttcgagcaggcactcacacagagcttgctgtggacggtattgatcttcgtagtggcgacggcaggtgtggcggtgttggtgtcacgggcaatcacgcagcgaatctttgtgatgcagaaacaggcgttggaaatcgcccgcggaaaatgggggacgaccatccctgttgagggtcatgacgaattgtcttcgctcgcgaatacgttgaattctctatcgaaacagctgcacaagcaagaagaactcaggagaaatctcatacaggacctcgcgcatgagcttcgcacacctttgactactctgcgttcgcatatccaagcgttttacgatggactgtgggaaccgaatcgggaacgcttgtacagctgccttgaggagattcagcgatttgaagcgcttgtgacttcggtggagaggctgtatgaggcggatgtagcggtgcacgcggcacggcgggatttatcgtccgccgatgtgaaccaggttgcgcagtccgtcatccagctcttcgagccccggtgtgctgaattgggcatccgactggagttgcgtacaccggatgtcccggtgtgggttacggctcgagcgcagcatgtgtcgcagattttgtggaacctgctggacaatgccgtgaaattcacgccatctggcggcaacattgtggtggaggttgggcaccaagacggcaaaccgtttttgtcagtcaaggacagcggcgtggggatccctgcggaggagttagataatatattcgagcggttttatcgggtggacaagtctcgggatcgcaaaaccggtggcagcggtcttgggttggcgattgtcaagcaattggtcgaactgtcccggggctttgtgcaggtgaacagtcgggttgggcgagggtcgacgtttacggtagtttggccggaataa

SEQ ID NO: 2243 - DNA, 1083 bp, Artificial
  Substituion in SEQ ID NO 2229
ttgagtctgcggagaaagatcatactcgcttttttcctgaccttatccatcatgttggtggccttggcgtttatcctccaagccgaggttcaccgtcactttttgtcggtggtctgtccagaaatcaattcggtctcgccttcgttgacccaacaaatcgaagttcatttcgagcaggcactcacacagagcttgctgtggacggtattgatcttcgtagtggcgacggcaggtgtggcggtgttggtgtcacgggcaatcacgcagcgaatctttgtgatgcagaaacaggcgttggaaatcgcccgcggaaaatgggggacgaccatccctgttgagggtcatgacgaattgtcttcgctcgcgaatacgttgaattctctatcgaaacagctgcacaagcaagaagaactcaggagaaatctcatacaggacctcgcgcatgagcttcgcacacctttgactactctgcgttcgcatatccaagcgttttacgatggactgtgggaaccgaatcgggaacgcttgtacagctgccttgaggagattcagcgatttgaagcgcttgtgacttcggtggagaggctgtatgaggcggatgtagcggtgcacgcggcacggcgggatttatcgtccgccgatgtgaaccaggttgcgcagtccgtcatcaatctcttcgagccccggtgtgctgaattgggcatccgactggagttgcgtacaccggatgtcccggtgtgggttacggctcgagcgcagcatgtgtcgcagattttgtggaacctgctggacaatgccgtgaaattcacgccatctggcggcaacattgtggtggaggttgggcaccaagacggcaaaccgtttttgtcagtcaaggacagcggcgtggggatccctgcggaggagatcgataatatattcgagcggttttatcgggtggacaagtctcgggatcgcaaaaccggtggcagcggtcttgggttggcgattgtcaagcaattggtcgaactgtcccggggctttgtgcaggtgaacagtcgggttgggcgagggtcgacgtttacggtagtttggccggaataa

SEQ ID NO: 2244 - DNA, 1083 bp, Artificial
  Substituion in SEQ ID NO 2229
ttgagtctgcggagaaagatcatactcgcttttttcctgaccttatccatcatgttggtggccattgcgtttatcctccaagccgaggttcaccgtcactttttgtcggtggtctgtccagaaatcaattcggtctcgccttcgttgacccaacaaatcgaagttcatttcgagcaggcactcacacagagcttgctgtggacggtattgatcttcgtagtggcgacggcaggtgtggcggtgttggtgtcacgggcaatcacgcagcgaatctttgtgatgcagaaacaggcgttggaaatcgcccgcggaaaatgggggacgaccatccctgttgagggtcatgacgaattgtcttcgctcgcgaatacgttgaattctctatcgaaacagctgcacaagcaagaagaactcaggagaaatctcatacaggacctcgcgcatgagcttcgcacacctttgactactctgcgttcgcatatccaagcgttttacgatggactgtgggaaccgaatcgggaacgcttgtacagctgccttgaggagattcagcgatttgaagcgcttgtgacttcggtggagaggctgtatgaggcggatgtagcggtgcacgcggcacggcgggatttatcgtccgccgatgtgaaccaggttgcgcagtccgtcatccagctcttcgagccccggtgtgctgaattgggcatccgactggagttgcgtacaccggatgtcccggtgtgggttacggctcgagcgcagcatgtgtcgcagattttgtggaacctgctggacaatgccgtgaaattcacgccatctggcggcaacattgtggtggaggttgggcaccaagacggcaaaccgtttttgtcagtcaaggacagcggcgtggggatccctgcggaggagatcgataatatattcgagcggttttatcgggtggacaagtctcgggatcgcaaaaccggtggcagcggtcttgggttggcgattgtcaagcaattggtcgaactgtcccggggctttgtgcaggtgaacagtcgggttgggcgagggtcgacgtttacggtagtttggccggaataa

SEQ ID NO: 2245 - protein, 313 aa, Alicyclobacillus acidocaldarius
MRLSSCASSKHNTRCQLQRLGQQPHCTGQCVACSLRHPFALHWNPADVDGRIIASVTLDCEDGMKTADCRQIVTHAGGATMKRHHTILVADDEKKIADVLSLYLEQAGFGVVCVDNGSEVLRRLEGLHPSLIILDLMLPDIPGEEVCMAVRARSAVPILMLTAKHRDEDRLRGLQIGADDYVTKPFNPNEVVARVQAILRRTMLDHPLADRLEYRDGDLVIDALSQVVYKGGINAELTATEYKLLVILSRHPRRVFSREELIERVFGMDFRGDVRTIDAHVKNLRAKIEDDPKSPVYIQTVYGMGYRFGGDGN

SEQ ID NO: 2246 - DNA, 942 bp, Alicyclobacillus acidocaldarius
atgcgcttgtcgtcctgtgcgtcgtccaagcataatacccgctgccagctgcaacggctaggacagcaaccgcactgtacagggcaatgtgttgcttgttcattgcgacacccctttgctttgcattggaatcccgcagacgttgacgggcggatcattgccagtgtaacgctggattgcgaagatggtatgaagacagcagactgccgacaaattgtcacacatgcaggaggcgcaacgatgaaacggcatcacaccattttagttgctgatgatgagaagaagattgcggatgtgttatcgctgtatctggagcaggcgggtttcggcgttgtttgcgtggataatggcagcgaggtcttgcgacgtctcgaaggtcttcatccgtcgctcatcatcctcgacttgatgctgccggatataccaggggaggaggtgtgcatggcggtgcgtgcacgatcagccgttcccattttaatgctgactgctaagcaccgggacgaagatcgattgagaggactgcaaatcggcgctgacgactacgtcacgaagccctttaatccgaacgaggttgtggctcgagtgcaggcaatcttgcgccgaaccatgcttgatcaccctttagcggatcgacttgaatatcgggatggcgacctggtgatcgatgccctttcgcaagtggtatacaagggtgggataaatgctgaactcactgcgacggagtacaaactgttggtgatcttgagccgacatccgcggcgggtgtttagtcgggaggaattgattgaacgagtctttggtatggattttcgtggggatgttcggaccatcgacgcacatgtgaagaatctacgggcgaaaattgaagatgaccctaagagcccagtgtacatccagaccgtctatgggatgggatatcggtttggaggggacggcaattga

SEQ ID NO: 2247 - protein, 226 aa, Thermoanaerobacter tengcongensis MB4
ILVVDDEIKILEVVKSYLEREGFSVITETNGNNVLDTFKKEKPDLVILDLMLPGISGEELCKRLRQFSNVPILMLTAKVQESDKINGFSIGADDYITKPFSPRELVMRVKAILRRTTDDVPLAEVMSFNNDDLVVDLRAHTVRKKGVVVNLTPNEFKILKILIRNPNRVFTREELIEKVMGFDYEGYDRTIDAHIKNLRQKIEDDTKNPVYIKTVYGVGYKFGDGN

SEQ ID NO: 2248 - protein, 226 aa, Thermoanaerobacter sp. X514
IFVVDDEIKILEVVKSYLEHEGFSVITETNGNNVLDTFKKEKPDLVILDLMLPGISGEELCKRLRQFSNVPILMLTAKVQESDKINGFSIGADDYITKPFSPRELVMRVKAILRRTTDDVPLAEVMSFNNDDLVVDLRAHTVRKKGVVVNLTPNEFKILKILIRNPNRVFTREELIEKVMGFDYEGYDRTIDAHIKNLRQKIEDDTKNPVYIKTVYGVGYKFGDGN

SEQ ID NO: 2249 - protein, 226 aa, Thermoanaerobacter pseudethanolicus ATCC 33223
IFVVDDEIKILEVVKSYLEHEGFSVITETNGNNVLNTFKKEKPDLVILDLMLPGISGEELCKRIRQFSNVPILMLTAKVQESDKINGFSIGADDYLTKPFSPRELVMRVKAILRRTSDDVPLAEVMSFNNDDLVVDFKAHTVKKKGVVVNLTPNEFKILKFLIRNPNRVFTREELIEKVMGFDYEGYDRTIDAHIKNLRQKIEDDTKNPVYIKTVYGVGYKFGDGN

SEQ ID NO: 2250 - protein, 225 aa, Clostridium thermocellum ATCC 27405
ILVVDDEKKIVEVVKSYLEHSGYEVYEAFTGKEALYVFEKVPLSLIVLDLMLPDLSGEEICKIIRKKSRVPIIMLTAKAEEEDILKGLNIGADDYITKPFSPKQLVARVTAVLRRTSDDPVPLSNIFSFNNGDLVIDSLKYEVRKGNNVVNLTPNEYKILMTLVKYPGKTFTRDELINMALGDDFDGFDRTVDTHIKNLRQKIETDPKSPKYILTVHGVGYRFEG

SEQ ID NO: 2251 - protein, 226 aa, Clostridium kluyveri DSM 555
ILVVDDEQKIVDVIRAYLEKAGYEVHSAYNGTEAVKLFEKISPALIVLDLMLPDISGEDICKMLRKKSRVPIIMLTAKVDEKTVLEGFNIGADDYVTKPFSPKQLVARVMAHLRRTEEEAIPLSNILSFNNGDLVLNVIKHEVRKNGITVNLTSSEYNILMTLVKYPQKTFTREELVNLALEEDFNGFDRIIDAHVKNLRQKIEDNSREPKYILTVYKVGYRFGGE

SEQ ID NO: 2252 - protein, 313 aa, Artificial
  Substituion in SEQ ID NO 2245
MRLSSCASSKHNTRCQLQRLGQQPHCTGQCVACSLRHPFALHWNPADVDGRIIASVTLDCEDGMKTADCRQIVTHAGGATMKRHHTILVADDEKKIADVLSLYLEQAGFGVVCVDNGSEVLRRLEGLHPSLIILDLMLPDIPGEEVCMAVRARSAVPILMLTAKHRDEDRLRGLQIGADDYVTKPFNPNEVVARVQAILRRTMLDHPLADRLEYRDGDLVIDALSQVVYKGGINAELTATEYKLLVILSRHPRRVFSREELIERVFGMDFKGDVRTIDAHVKNLRAKIEDDPKSPVYIQTVYGMGYRFGGDGN

SEQ ID NO: 2253 - protein, 313 aa, Artificial
  Substituion in SEQ ID NO 2245
MRLSSCASSKHNTRCQLQRLGQQPHCTGQCVACSLRHPFALHWNPADVDGRIIASVTLDCEDGMKTADCRQIVTHAGGATMKRHHTILVADDEKKIADVLSLYLEQAGFGVVCVDNGSEVLRRLEGLHPSLIILDLMLPDIPGEEVCMAVRARSAVPILMLTAKHRDEDRLRGIQIGADDYVTKPFNPNEVVARVQAILRRTMLDHPLADRLEYRDGDLVIDALSQVVYKGGINAELTATEYKLLVILSRHPRRVFSREELIERVFGMDFRGDVRTIDAHVKNLRAKIEDDPKSPVYIQTVYGMGYRFGGDGN

SEQ ID NO: 2254 - protein, 313 aa, Artificial
  Substituion in SEQ ID NO 2245
MRLSSCASSKHNTRCQLQRLGQQPHCTGQCVACSLRHPFALHWNPADVDGRIIASVTLDCEDGMKTADCRQIVTHAGGATMKRHHTILVADDEKKIADVLSLYLEQAGFGVVCVDNGSEVLRRLEGLHPSLIILDLMLPDIPGEEVCMAVRARSAVPILMLTAKHRDEDRLRGLQIGADDYVTKPFNPNEVVARVQAILRRTMLDHPLADRIEYRDGDLVIDALSQVVYKGGINAELTATEYKLLVILSRHPRRVFSREELIERVFGMDFRGDVRTIDAHVKNLRAKIEDDPKSPVYIQTVYGMGYRFGGDGN

SEQ ID NO: 2255 - protein, 313 aa, Artificial
  Substituion in SEQ ID NO 2245
MRLSSCASSKHNTRCQLQRLGQQPHCTGQCVACSLRHPFALHWNPADVDGRIIASVTLDCEDGMKTADCRQIVTHAGGATMKRHHTILVADDEKKIADVLSIYLEQAGFGVVCVDNGSEVLRRLEGLHPSLIILDLMLPDIPGEEVCMAVRARSAVPILMLTAKHRDEDRLRGLQIGADDYVTKPFNPNEVVARVQAILRRTMLDHPLADRLEYRDGDLVIDALSQVVYKGGINAELTATEYKLLVILSRHPRRVFSREELIERVFGMDFRGDVRTIDAHVKNLRAKIEDDPKSPVYIQTVYGMGYRFGGDGN

SEQ ID NO: 2256 - protein, 313 aa, Artificial
  Substituion in SEQ ID NO 2245
MRLSSCASSKHNTRCQLQRLGQQPHCTGQCVACSLRHPFALHWNPADVDGRIIASVTLDCEDGMKTADCRQIITHAGGATMKRHHTILVADDEKKIADVLSLYLEQAGFGVVCVDNGSEVLRRLEGLHPSLIILDLMLPDIPGEEVCMAVRARSAVPILMLTAKHRDEDRLRGLQIGADDYVTKPFNPNEVVARVQAILRRTMLDHPLADRLEYRDGDLVIDALSQVVYKGGINAELTATEYKLLVILSRHPRRVFSREELIERVFGMDFRGDVRTIDAHVKNLRAKIEDDPKSPVYIQTVYGMGYRFGGDGN

SEQ ID NO: 2257 - DNA, 942 bp, Artificial
  Substituion in SEQ ID NO 2246
atgcgcttgtcgtcctgtgcgtcgtccaagcataatacccgctgccagctgcaacggctaggacagcaaccgcactgtacagggcaatgtgttgcttgttcattgcgacacccctttgctttgcattggaatcccgcagacgttgacgggcggatcattgccagtgtaacgctggattgcgaagatggtatgaagacagcagactgccgacaaattgtcacacatgcaggaggcgcaacgatgaaacggcatcacaccattttagttgctgatgatgagaagaagattgcggatgtgttatcgctgtatctggagcaggcgggtttcggcgttgtttgcgtggataatggcagcgaggtcttgcgacgtctcgaaggtcttcatccgtcgctcatcatcctcgacttgatgctgccggatataccaggggaggaggtgtgcatggcggtgcgtgcacgatcagccgttcccattttaatgctgactgctaagcaccgggacgaagatcgattgagaggactgcaaatcggcgctgacgactacgtcacgaagccctttaatccgaacgaggttgtggctcgagtgcaggcaatcttgcgccgaaccatgcttgatcaccctttagcggatcgacttgaatatcgggatggcgacctggtgatcgatgccctttcgcaagtggtatacaagggtgggataaatgctgaactcactgcgacggagtacaaactgttggtgatcttgagccgacatccgcggcgggtgtttagtcgggaggaattgattgaacgagtctttggtatggattttaaaggggatgttcggaccatcgacgcacatgtgaagaatctacgggcgaaaattgaagatgaccctaagagcccagtgtacatccagaccgtctatgggatgggatatcggtttggaggggacggcaattga

SEQ ID NO: 2258 - DNA, 942 bp, Artificial
  Substituion in SEQ ID NO 2246
atgcgcttgtcgtcctgtgcgtcgtccaagcataatacccgctgccagctgcaacggctaggacagcaaccgcactgtacagggcaatgtgttgcttgttcattgcgacacccctttgctttgcattggaatcccgcagacgttgacgggcggatcattgccagtgtaacgctggattgcgaagatggtatgaagacagcagactgccgacaaattgtcacacatgcaggaggcgcaacgatgaaacggcatcacaccattttagttgctgatgatgagaagaagattgcggatgtgttatcgctgtatctggagcaggcgggtttcggcgttgtttgcgtggataatggcagcgaggtcttgcgacgtctcgaaggtcttcatccgtcgctcatcatcctcgacttgatgctgccggatataccaggggaggaggtgtgcatggcggtgcgtgcacgatcagccgttcccattttaatgctgactgctaagcaccgggacgaagatcgattgagaggaattcaaatcggcgctgacgactacgtcacgaagccctttaatccgaacgaggttgtggctcgagtgcaggcaatcttgcgccgaaccatgcttgatcaccctttagcggatcgacttgaatatcgggatggcgacctggtgatcgatgccctttcgcaagtggtatacaagggtgggataaatgctgaactcactgcgacggagtacaaactgttggtgatcttgagccgacatccgcggcgggtgtttagtcgggaggaattgattgaacgagtctttggtatggattttcgtggggatgttcggaccatcgacgcacatgtgaagaatctacgggcgaaaattgaagatgaccctaagagcccagtgtacatccagaccgtctatgggatgggatatcggtttggaggggacggcaattga

SEQ ID NO: 2259 - DNA, 942 bp, Artificial
  Substituion in SEQ ID NO 2246
atgcgcttgtcgtcctgtgcgtcgtccaagcataatacccgctgccagctgcaacggctaggacagcaaccgcactgtacagggcaatgtgttgcttgttcattgcgacacccctttgctttgcattggaatcccgcagacgttgacgggcggatcattgccagtgtaacgctggattgcgaagatggtatgaagacagcagactgccgacaaattgtcacacatgcaggaggcgcaacgatgaaacggcatcacaccattttagttgctgatgatgagaagaagattgcggatgtgttatcgctgtatctggagcaggcgggtttcggcgttgtttgcgtggataatggcagcgaggtcttgcgacgtctcgaaggtcttcatccgtcgctcatcatcctcgacttgatgctgccggatataccaggggaggaggtgtgcatggcggtgcgtgcacgatcagccgttcccattttaatgctgactgctaagcaccgggacgaagatcgattgagaggactgcaaatcggcgctgacgactacgtcacgaagccctttaatccgaacgaggttgtggctcgagtgcaggcaatcttgcgccgaaccatgcttgatcaccctttagcggatcgaattgaatatcgggatggcgacctggtgatcgatgccctttcgcaagtggtatacaagggtgggataaatgctgaactcactgcgacggagtacaaactgttggtgatcttgagccgacatccgcggcgggtgtttagtcgggaggaattgattgaacgagtctttggtatggattttcgtggggatgttcggaccatcgacgcacatgtgaagaatctacgggcgaaaattgaagatgaccctaagagcccagtgtacatccagaccgtctatgggatgggatatcggtttggaggggacggcaattga

SEQ ID NO: 2260 - DNA, 942 bp, Artificial
  Substituion in SEQ ID NO 2246
atgcgcttgtcgtcctgtgcgtcgtccaagcataatacccgctgccagctgcaacggctaggacagcaaccgcactgtacagggcaatgtgttgcttgttcattgcgacacccctttgctttgcattggaatcccgcagacgttgacgggcggatcattgccagtgtaacgctggattgcgaagatggtatgaagacagcagactgccgacaaattgtcacacatgcaggaggcgcaacgatgaaacggcatcacaccattttagttgctgatgatgagaagaagattgcggatgtgttatcgatttatctggagcaggcgggtttcggcgttgtttgcgtggataatggcagcgaggtcttgcgacgtctcgaaggtcttcatccgtcgctcatcatcctcgacttgatgctgccggatataccaggggaggaggtgtgcatggcggtgcgtgcacgatcagccgttcccattttaatgctgactgctaagcaccgggacgaagatcgattgagaggactgcaaatcggcgctgacgactacgtcacgaagccctttaatccgaacgaggttgtggctcgagtgcaggcaatcttgcgccgaaccatgcttgatcaccctttagcggatcgacttgaatatcgggatggcgacctggtgatcgatgccctttcgcaagtggtatacaagggtgggataaatgctgaactcactgcgacggagtacaaactgttggtgatcttgagccgacatccgcggcgggtgtttagtcgggaggaattgattgaacgagtctttggtatggattttcgtggggatgttcggaccatcgacgcacatgtgaagaatctacgggcgaaaattgaagatgaccctaagagcccagtgtacatccagaccgtctatgggatgggatatcggtttggaggggacggcaattga

SEQ ID NO: 2261 - DNA, 942 bp, Artificial
  Substituion in SEQ ID NO 2246
atgcgcttgtcgtcctgtgcgtcgtccaagcataatacccgctgccagctgcaacggctaggacagcaaccgcactgtacagggcaatgtgttgcttgttcattgcgacacccctttgctttgcattggaatcccgcagacgttgacgggcggatcattgccagtgtaacgctggattgcgaagatggtatgaagacagcagactgccgacaaattattacacatgcaggaggcgcaacgatgaaacggcatcacaccattttagttgctgatgatgagaagaagattgcggatgtgttatcgctgtatctggagcaggcgggtttcggcgttgtttgcgtggataatggcagcgaggtcttgcgacgtctcgaaggtcttcatccgtcgctcatcatcctcgacttgatgctgccggatataccaggggaggaggtgtgcatggcggtgcgtgcacgatcagccgttcccattttaatgctgactgctaagcaccgggacgaagatcgattgagaggactgcaaatcggcgctgacgactacgtcacgaagccctttaatccgaacgaggttgtggctcgagtgcaggcaatcttgcgccgaaccatgcttgatcaccctttagcggatcgacttgaatatcgggatggcgacctggtgatcgatgccctttcgcaagtggtatacaagggtgggataaatgctgaactcactgcgacggagtacaaactgttggtgatcttgagccgacatccgcggcgggtgtttagtcgggaggaattgattgaacgagtctttggtatggattttcgtggggatgttcggaccatcgacgcacatgtgaagaatctacgggcgaaaattgaagatgaccctaagagcccagtgtacatccagaccgtctatgggatgggatatcggtttggaggggacggcaattga

SEQ ID NO: 2262 - protein, 268 aa, Alicyclobacillus acidocaldarius
MTDQSLGRSPARLEDTAQASVPERRSRDLRRSFQLKCTISRIFVNALLPCTSLTIGGDFVMDTTLVLSAKRGDQDSFMALYREFHARIRSWIRNYWIPGADREDLMQHAWIGFWEAIRDYDVRGKVPFRAFAKMCVMREIQAALKMARRQKHVSHLTALSLDAECPWIEDAERTVLDVFVDRAAPSVDDMVFGPPPSAGPEELVAWAERHWGLRLTELEREVWRLRVEGHSYAEIQRMLGCGYKAVDNAVQRLRRKAKMLVNNANLQT

SEQ ID NO: 2263 - DNA, 807 bp, Alicyclobacillus acidocaldarius
atgaccgatcaatcattggggcggtcacctgctcgccttgaggacactgcccaggcgtcggtgcccgagcgtcggagtcgcgacctccggcgctcttttcagcttaagtgtaccatatcgaggatattcgtcaatgcgctcttgccctgcacctccctcactatcgggggcgatttcgtgatggacacgacattggtactttcggcaaaacgcggtgaccaggactctttcatggcgctctatcgcgagttccatgccagaatccggagctggattcgaaactactggataccaggagccgaccgcgaggacctgatgcagcacgcgtggatcgggttttgggaggccatacgagactacgatgttcgtggcaaagtgccgtttcgggcgttcgcgaagatgtgcgtcatgcgtgagatccaggcggcactaaagatggcgcggcgacagaagcatgtctcgcacttgacggcgctgtcgcttgatgcggagtgcccatggatcgaggacgcggagcgcacggtgctggacgtgttcgtcgatcgcgcggcaccgagcgtggacgatatggtgtttgggccaccgccaagtgcgggtccagaggaactcgtggcatgggcagagcggcattgggggctgagattgacggagctcgagcgcgaggtgtggcggttgcgggtcgaagggcactcgtacgcggagatccagcggatgttgggatgcggatacaaggcggtggacaatgcggtgcagcggctgaggcggaaggcgaaaatgttggtgaataatgcgaacttgcaaacatga

SEQ ID NO: 2264 - protein, 189 aa, Alkaliphilus oremlandii OhILAs
VLDEVMVEIAKEGDLEALEYLIKKYKNFVRAKARSYFLIGADREDIVQEGMIGLYKAIRDFKPDKLSSFRAFAELCITRQIITAIKTATRQKHIPLNSYVSLNKPIYDEESDRTLLDVISGQKVTDPEELVVSREELGHIEDKIGEILSDLELKVLMLYLEGRSYQEIAGDLERHVKSIDNALQRVKRK

SEQ ID NO: 2265 - protein, 187 aa, Bacillus cereus ATCC 10987
DEAIVELVRKGNTDALEYLIHKYKNFVRAKSRSYFLVGADREDIVQEGMIGLFKAIRDYKEDKLSSFKAFAELCITRQIITAIKTATRQKHIPLNSYVSLDKPIYDEESDRTLLDVISEAKVTDPEEMIISQEEYTDIESKISELLSDLERKVLSLYLDGRSYQEISEQLNRHVKSIDNALQRVKRK

SEQ ID NO: 2266 - protein, 187 aa, Bacillus anthracis str. Ames; identical to SEQ ID NO: 2265

SEQ ID NO: 2267 - protein, 187 aa, Bacillus cereus ATCC 14579; identical to SEQ ID NO: 2265

SEQ ID NO: 2268 - protein, 187 aa, Bacillus cereus subsp. cytotoxis NVH 391-98
DEAIVELVRKGNIDALEYLIHKYKNFVRAKSRSYFLVGADREDIVQEGMIGLFKAIRDYKEDKLSSFKAFAELCITRQIITAIKTATRQKHIPLNSYVSLDKPIYDEESDRTLLDVISEAKVTDPEEMIISQEEYSDIELKISELLSDLERKVLSLYLDGRSYQEISEQLNRHVKSIDNALQRVKRK

SEQ ID NO: 2269 - protein, 268 aa, Artificial
  Substituion in SEQ ID NO 2262
MTDQSLGRSPARLEDTAQASVPERRSRDLRRSFQLKCTISRIFVNALLPCTSLTIGGDFVMDTTLVLSAKRGDQDSFMALYKEFHARIRSWIRNYWIPGADREDLMQHAWIGFWEAIRDYDVRGKVPFRAFAKMCVMREIQAALKMARRQKHVSHLTALSLDAECPWIEDAERTVLDVFVDRAAPSVDDMVFGPPPSAGPEELVAWAERHWGLRLTELEREVWRLRVEGHSYAEIQRMLGCGYKAVDNAVQRLRRKAKMLVNNANLQT

SEQ ID NO: 2270 - protein, 268 aa, Artificial
  Substituion in SEQ ID NO 2262
MTDQSLGRSPARLEDTAQASVPERRSRDLRRSFQLKCTISRIFVNALLPCTSLTIGGDFVMDTTLVLSAKRGDQDSFMALYREFHARIRSWIRNYWIPGADREDLMQHAWIGFWEAIRDYDVRGKVPFRAFAKMCVMREIQAALKMARRQKHVSHLTALSLDAECPWIEDAERTILDVFVDRAAPSVDDMVFGPPPSAGPEELVAWAERHWGLRLTELEREVWRLRVEGHSYAEIQRMLGCGYKAVDNAVQRLRRKAKMLVNNANLQT

SEQ ID NO: 2271 - protein, 268 aa, Artificial
  Substituion in SEQ ID NO 2262
MTDQSLGRSPARLEDTAQASVPERRSRDLRRSFQLKCTISRIFVNALLPCTSLTIGGDFVMDTTLVLSAKRGDQDSFMALYREFHARIRSWIRNYWIPGADREDLMQHAWIGFWEAIRDYDVRGKVPFRAFAKMCVMREIQAALKMARRQKHVSHLTAISLDAECPWIEDAERTVLDVFVDRAAPSVDDMVFGPPPSAGPEELVAWAERHWGLRLTELEREVWRLRVEGHSYAEIQRMLGCGYKAVDNAVQRLRRKAKMLVNNANLQT

SEQ ID NO: 2272 - protein, 268 aa, Artificial
  Substituion in SEQ ID NO 2262
MTDQSLGRSPARLEDTAQASVPERRSRDLRRSFQLKCTISRIFVNALLPCTSLTIGGDFVMDTTLVLSAKRGDQDSFMALYREFHAKIRSWIRNYWIPGADREDLMQHAWIGFWEAIRDYDVRGKVPFRAFAKMCVMREIQAALKMARRQKHVSHLTALSLDAECPWIEDAERTVLDVFVDRAAPSVDDMVFGPPPSAGPEELVAWAERHWGLRLTELEREVWRLRVEGHSYAEIQRMLGCGYKAVDNAVQRLRRKAKMLVNNANLQT

SEQ ID NO: 2273 - protein, 268 aa, Artificial
  Substituion in SEQ ID NO 2262
MTDQSLGRSPARLEDTAQASVPERRSRDLRRSFQLKCTISRIFVNALLPCTSLTIGGDFVMDTTLVLSAKRGDQDSFMALYREFHARIRSWIRNYWIPGADREDLMQHAWIGFWEAIRDYDVRGKVPFRAFAKMCVMREIQAALKMARRQKHVSHLTALSLDAECPWIEDAERTVLDVFVDRAAPSIDDMVFGPPPSAGPEELVAWAERHWGLRLTELEREVWRLRVEGHSYAEIQRMLGCGYKAVDNAVQRLRRKAKMLVNNANLQT

SEQ ID NO: 2274 - DNA, 807 bp, Artificial
  Substituion in SEQ ID NO 2263
atgaccgatcaatcattggggcggtcacctgctcgccttgaggacactgcccaggcgtcggtgcccgagcgtcggagtcgcgacctccggcgctcttttcagcttaagtgtaccatatcgaggatattcgtcaatgcgctcttgccctgcacctccctcactatcgggggcgatttcgtgatggacacgacattggtactttcggcaaaacgcggtgaccaggactctttcatggcgctctataaagagttccatgccagaatccggagctggattcgaaactactggataccaggagccgaccgcgaggacctgatgcagcacgcgtggatcgggttttgggaggccatacgagactacgatgttcgtggcaaagtgccgtttcgggcgttcgcgaagatgtgcgtcatgcgtgagatccaggcggcactaaagatggcgcggcgacagaagcatgtctcgcacttgacggcgctgtcgcttgatgcggagtgcccatggatcgaggacgcggagcgcacggtgctggacgtgttcgtcgatcgcgcggcaccgagcgtggacgatatggtgtttgggccaccgccaagtgcgggtccagaggaactcgtggcatgggcagagcggcattgggggctgagattgacggagctcgagcgcgaggtgtggcggttgcgggtcgaagggcactcgtacgcggagatccagcggatgttgggatgcggatacaaggcggtggacaatgcggtgcagcggctgaggcggaaggcgaaaatgttggtgaataatgcgaacttgcaaacatga

SEQ ID NO: 2275 - DNA, 807 bp, Artificial
  Substituion in SEQ ID NO 2263
atgaccgatcaatcattggggcggtcacctgctcgccttgaggacactgcccaggcgtcggtgcccgagcgtcggagtcgcgacctccggcgctcttttcagcttaagtgtaccatatcgaggatattcgtcaatgcgctcttgccctgcacctccctcactatcgggggcgatttcgtgatggacacgacattggtactttcggcaaaacgcggtgaccaggactctttcatggcgctctatcgcgagttccatgccagaatccggagctggattcgaaactactggataccaggagccgaccgcgaggacctgatgcagcacgcgtggatcgggttttgggaggccatacgagactacgatgttcgtggcaaagtgccgtttcgggcgttcgcgaagatgtgcgtcatgcgtgagatccaggcggcactaaagatggcgcggcgacagaagcatgtctcgcacttgacggcgctgtcgcttgatgcggagtgcccatggatcgaggacgcggagcgcacgattctggacgtgttcgtcgatcgcgcggcaccgagcgtggacgatatggtgtttgggccaccgccaagtgcgggtccagaggaactcgtggcatgggcagagcggcattgggggctgagattgacggagctcgagcgcgaggtgtggcggttgcgggtcgaagggcactcgtacgcggagatccagcggatgttgggatgcggatacaaggcggtggacaatgcggtgcagcggctgaggcggaaggcgaaaatgttggtgaataatgcgaacttgcaaacatga

SEQ ID NO: 2276 - DNA, 807 bp, Artificial
  Substituion in SEQ ID NO 2263
atgaccgatcaatcattggggcggtcacctgctcgccttgaggacactgcccaggcgtcggtgcccgagcgtcggagtcgcgacctccggcgctcttttcagcttaagtgtaccatatcgaggatattcgtcaatgcgctcttgccctgcacctccctcactatcgggggcgatttcgtgatggacacgacattggtactttcggcaaaacgcggtgaccaggactctttcatggcgctctatcgcgagttccatgccagaatccggagctggattcgaaactactggataccaggagccgaccgcgaggacctgatgcagcacgcgtggatcgggttttgggaggccatacgagactacgatgttcgtggcaaagtgccgtttcgggcgttcgcgaagatgtgcgtcatgcgtgagatccaggcggcactaaagatggcgcggcgacagaagcatgtctcgcacttgacggcgatttcgcttgatgcggagtgcccatggatcgaggacgcggagcgcacggtgctggacgtgttcgtcgatcgcgcggcaccgagcgtggacgatatggtgtttgggccaccgccaagtgcgggtccagaggaactcgtggcatgggcagagcggcattgggggctgagattgacggagctcgagcgcgaggtgtggcggttgcgggtcgaagggcactcgtacgcggagatccagcggatgttgggatgcggatacaaggcggtggacaatgcggtgcagcggctgaggcggaaggcgaaaatgttggtgaataatgcgaacttgcaaacatga

SEQ ID NO: 2277 - DNA, 807 bp, Artificial
  Substituion in SEQ ID NO 2263
atgaccgatcaatcattggggcggtcacctgctcgccttgaggacactgcccaggcgtcggtgcccgagcgtcggagtcgcgacctccggcgctcttttcagcttaagtgtaccatatcgaggatattcgtcaatgcgctcttgccctgcacctccctcactatcgggggcgatttcgtgatggacacgacattggtactttcggcaaaacgcggtgaccaggactctttcatggcgctctatcgcgagttccatgccaaaatccggagctggattcgaaactactggataccaggagccgaccgcgaggacctgatgcagcacgcgtggatcgggttttgggaggccatacgagactacgatgttcgtggcaaagtgccgtttcgggcgttcgcgaagatgtgcgtcatgcgtgagatccaggcggcactaaagatggcgcggcgacagaagcatgtctcgcacttgacggcgctgtcgcttgatgcggagtgcccatggatcgaggacgcggagcgcacggtgctggacgtgttcgtcgatcgcgcggcaccgagcgtggacgatatggtgtttgggccaccgccaagtgcgggtccagaggaactcgtggcatgggcagagcggcattgggggctgagattgacggagctcgagcgcgaggtgtggcggttgcgggtcgaagggcactcgtacgcggagatccagcggatgttgggatgcggatacaaggcggtggacaatgcggtgcagcggctgaggcggaaggcgaaaatgttggtgaataatgcgaacttgcaaacatga

SEQ ID NO: 2278 - DNA, 807 bp, Artificial
  Substituion in SEQ ID NO 2263
atgaccgatcaatcattggggcggtcacctgctcgccttgaggacactgcccaggcgtcggtgcccgagcgtcggagtcgcgacctccggcgctcttttcagcttaagtgtaccatatcgaggatattcgtcaatgcgctcttgccctgcacctccctcactatcgggggcgatttcgtgatggacacgacattggtactttcggcaaaacgcggtgaccaggactctttcatggcgctctatcgcgagttccatgccagaatccggagctggattcgaaactactggataccaggagccgaccgcgaggacctgatgcagcacgcgtggatcgggttttgggaggccatacgagactacgatgttcgtggcaaagtgccgtttcgggcgttcgcgaagatgtgcgtcatgcgtgagatccaggcggcactaaagatggcgcggcgacagaagcatgtctcgcacttgacggcgctgtcgcttgatgcggagtgcccatggatcgaggacgcggagcgcacggtgctggacgtgttcgtcgatcgcgcggcaccgagcattgacgatatggtgtttgggccaccgccaagtgcgggtccagaggaactcgtggcatgggcagagcggcattgggggctgagattgacggagctcgagcgcgaggtgtggcggttgcgggtcgaagggcactcgtacgcggagatccagcggatgttgggatgcggatacaaggcggtggacaatgcggtgcagcggctgaggcggaaggcgaaaatgttggtgaataatgcgaacttgcaaacatga

SEQ ID NO: 2279 - protein, 110 aa, Alicyclobacillus acidocaldarius
MCCLTGLERMRDLLEKERELVNKGELVAEVQARVGLPKSQVLQVLNTFCEVTTERLQAGEEVSLPPLGKFQYVMRSARRQRNPQTGEMIDVPEKATVRFRPSGALKGRVN

SEQ ID NO: 2280 - DNA, 333 bp, Alicyclobacillus acidocaldarius
ttgtgttgccttacaggtctcgaacgaatgagagatcttcttgaaaaggagcgagagctcgtgaacaagggtgaactggtggcggaagttcaggcaagggtgggcttacccaagtctcaggtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2281 - protein, 91 aa, Prosthecochloris aestuarii DSM 271
LMSKAELVEKIASQAGLTKADAERAVNSFVSVVTDSLKAGEDVTLVGFGTFSVGERAERQGRNPQTGETITIAARKAVKFKPGKALKEEVD

SEQ ID NO: 2282 - protein, 90 aa, Halorhodospira halophila SL1
MNKADLAEKVAAETGVSKRVATDAVSAVFTGIEESLASGEDVSIPGFGKFAVVARPERQGRNPQTGELIDIPAGMNVRFKPGAPLKRSVD

SEQ ID NO: 2283 - protein, 89 aa, Bacillus phage SPBc2
MNKTELIAKVAEKQGVSKKEGAPSVEKVFDTISEALKSGEKVSIPGFGTFEVRERAARKGRNPQTGEEIDIPATKAPAFKPAKALKDAV

SEQ ID NO: 2284 - protein, 89 aa, Pelodictyon luteolum DSM 273
MSKAELVEKIAAQAKLTKVDAERAVNAFINVVTSSLKGGDDVTLVGFGTFTTGDRAARQGRNPQTGKAITIPAKKVVKFKPGKALKDEV

SEQ ID NO: 2285 - protein, 89 aa, Prosthecochloris vibrioformis DSM 265
MSKAELVEKIAAQANLTKVDAEKSVNAFINVVTSSLKAGDDVTLVGFGTFTTGDRAERQGRNPQTGKTITIPAKTVVKFKPGKALKDEV

SEQ ID NO: 2286 - protein, 110 aa, Artificial
  Substituion in SEQ ID NO 2279
MCCLTGLERMRDLLEKERELVNKGELVAEVQARVGLPKSQVIQVLNTFCEVTTERLQAGEEVSLPPLGKFQYVMRSARRQRNPQTGEMIDVPEKATVRFRPSGALKGRVN

SEQ ID NO: 2287 - protein, 110 aa, Artificial
  Substituion in SEQ ID NO 2279
MCCLTGLERMRDLLEKERELVNKGELVAEVQARVGLPKSQVLQVLNTFCEVTTERLQAGEEVSLPPLGKFQYVMRSARRQRNPQTGDMIDVPEKATVRFRPSGALKGRVN

SEQ ID NO: 2288 - protein, 110 aa, Artificial
  Substituion in SEQ ID NO 2279
MCCLTGLERMRELLEKERELVNKGELVAEVQARVGLPKSQVLQVLNTFCEVTTERLQAGEEVSLPPLGKFQYVMRSARRQRNPQTGEMIDVPEKATVRFRPSGALKGRVN

SEQ ID NO: 2289 - protein, 110 aa, Artificial
  Substituion in SEQ ID NO 2279
MCCLTGLERMRDLIEKERELVNKGELVAEVQARVGLPKSQVLQVLNTFCEVTTERLQAGEEVSLPPLGKFQYVMRSARRQRNPQTGEMIDVPEKATVRFRPSGALKGRVN

SEQ ID NO: 2290 - protein, 110 aa, Artificial
  Substituion in SEQ ID NO 2279
MCCLTGLDRMRDLLEKERELVNKGELVAEVQARVGLPKSQVLQVLNTFCEVTTERLQAGEEVSLPPLGKFQYVMRSARRQRNPQTGEMIDVPEKATVRFRPSGALKGRVN

SEQ ID NO: 2291 - DNA, 333 bp, Artificial
  Substituion in SEQ ID NO 2280
ttgtgttgccttacaggtctcgaacgaatgagagatcttcttgaaaaggagcgagagctcgtgaacaagggtgaactggtggcggaagttcaggcaagggtgggcttacccaagtctcaggtgattcaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2292 - DNA, 333 bp, Artificial
  Substituion in SEQ ID NO 2280
ttgtgttgccttacaggtctcgaacgaatgagagatcttcttgaaaaggagcgagagctcgtgaacaagggtgaactggtggcggaagttcaggcaagggtgggcttacccaagtctcaggtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgatatgatcgacgttcccgaaaaggccacggtgcgctttcggccatccggggctttgaaggggcgtgtgaactga

SEQ ID NO: 2293 - DNA, 333 bp, Artificial
  Substituion in SEQ ID NO 2280
ttgtgttgccttacaggtctcgaacgaatgagagaacttcttgaaaaggagcgagagctcgtgaacaagggtgaactggtggcggaagttcaggcaagggtgggcttacccaagtctcaggtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2294 - DNA, 333 bp, Artificial
  Substituion in SEQ ID NO 2280
ttgtgttgccttacaggtctcgaacgaatgagagatcttattgaaaaggagcgagagctcgtgaacaagggtgaactggtggcggaagttcaggcaagggtgggcttacccaagtctcaggtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2295 - DNA, 333 bp, Artificial
  Substituion in SEQ ID NO 2280
ttgtgttgccttacaggtctcgatcgaatgagagatcttcttgaaaaggagcgagagctcgtgaacaagggtgaactggtggcggaagttcaggcaagggtgggcttacccaagtctcaggtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2296 - protein, 118 aa, Alicyclobacillus acidocaldarius
MAVSAAFAVCAIASHCCRDRCRMGDDETTVLRRKSRMIATGYVRKVDRLGRLVVPNRIRSDLHLAKEDPVEIYVEADSIVLTKYEPKCVFCGEKAEKVFHERAVCGTCLEELKTRSKR

SEQ ID NO: 2297 - DNA, 357 bp, Alicyclobacillus acidocaldarius
gtggcagttagcgcggcatttgccgtttgcgctattgcttctcattgttgtcgtgataggtgtaggatgggtgatgatgagacgacggtactgaggaggaaaagtcgaatgattgcgacaggatacgtgcgtaaagtcgacaggttggggcggcttgtggtgccgaatcggattcgcagcgacctccatcttgccaaagaagatcctgtggagatttacgtcgaagccgatagcatcgtgcttacgaagtacgaacccaagtgcgtgttctgcggggagaaggccgagaaggtctttcacgagcgagctgtctgcgggacgtgcttggaggagttgaagacgaggagtaagagatga

SEQ ID NO: 2298 - protein, 78 aa, Clostridium acetobutylicum ATCC 824
MKSTGVVRRVDELGRIVIPIELRRTLNIAEKDALEIYVDGEQIILKKYEPACIFCGDASDVINYRGKNICKHCLEELK

SEQ ID NO: 2299 - protein, 78 aa, Caldicellulosiruptor saccharolyticus DSM 8903
MKSTGVVRKVDELGRIVLPIELRRTLDIAEKDALEIFVDGDKIILRKYEPACIFCGNAKDVIYYKGKNICKDCMEELK

SEQ ID NO: 2300 - protein, 76 aa, Thermoanaerobacter pseudethanolicus ATCC 33223
STGIVRKVDELGRVVIPIELRRTLNIAERDALEIYVDGEQIVLKKYEPACIFCGNAENVINYKGKNICKNCLEELK

SEQ ID NO: 2301 - protein, 76 aa, Thermoanaerobacter tengcongensis MB4; identical to SEQ ID NO: 2300

SEQ ID NO: 2302 - protein, 78 aa, Alkaliphilus metalliredigens QYMF
MKSTGIVRKVDELGRIVLPIELRRTLTIAEKDSLEIYVDGESIILKKYEPACIFCGNAKDVTVYKTKNVCEDCLEEFR

SEQ ID NO: 2303 - protein, 118 aa, Artificial
  Substituion in SEQ ID NO 2296
MAVSAAFAVCAIASHCCRDRCRMGDDETTVLRRKSRMIATGYVRKVDRLGRLVVPNRIRSDLHLAKEDPVEIYVEADSIVLTKYEPKCVFCGEKAEKVFHERAVCGTCLEEIKTRSKR

SEQ ID NO: 2304 - protein, 118 aa, Artificial
  Substituion in SEQ ID NO 2296
MAVSAAFAVCALASHCCRDRCRMGDDETTVLRRKSRMIATGYVRKVDRLGRLVVPNRIRSDLHLAKEDPVEIYVEADSIVLTKYEPKCVFCGEKAEKVFHERAVCGTCLEELKTRSKR

SEQ ID NO: 2305 - protein, 118 aa, Artificial
  Substituion in SEQ ID NO 2296
MAVSAAFAVCAIASHCCRDRCRMGDDETTVLRRKSRMIATGYVRKVDRLGRLVVPNRIRSDLHLAKEDPVEIYVEAESIVLTKYEPKCVFCGEKAEKVFHERAVCGTCLEELKTRSKR

SEQ ID NO: 2306 - protein, 118 aa, Artificial
  Substituion in SEQ ID NO 2296
MAVSAAFAVCAIASHCCRDRCRMGDDETTVLRRKSRMIATGYVRKVDRLGRLVVPNRIRSDLHLAKEDPVEIYVEADSIVLTKYEPKCVFCGEKAEKVFHERAVCGTCIEELKTRSKR

SEQ ID NO: 2307 - protein, 118 aa, Artificial
  Substituion in SEQ ID NO 2296
MAVSAAFAVCAIASHCCRDRCRMGDDETTVLRRKSRMIATGYVRKVDRLGRLVVPNRIRSDLHLAKEDPVEIYVEADSIVLTKYEPKCVFCGERAEKVFHERAVCGTCLEELKTRSKR

SEQ ID NO: 2308 - DNA, 357 bp, Artificial
  Substituion in SEQ ID NO 2297
gtggcagttagcgcggcatttgccgtttgcgctattgcttctcattgttgtcgtgataggtgtaggatgggtgatgatgagacgacggtactgaggaggaaaagtcgaatgattgcgacaggatacgtgcgtaaagtcgacaggttggggcggcttgtggtgccgaatcggattcgcagcgacctccatcttgccaaagaagatcctgtggagatttacgtcgaagccgatagcatcgtgcttacgaagtacgaacccaagtgcgtgttctgcggggagaaggccgagaaggtctttcacgagcgagctgtctgcgggacgtgcttggaggagattaagacgaggagtaagagatga

SEQ ID NO: 2309 - DNA, 357 bp, Artificial
  Substituion in SEQ ID NO 2297
gtggcagttagcgcggcatttgccgtttgcgctttagcttctcattgttgtcgtgataggtgtaggatgggtgatgatgagacgacggtactgaggaggaaaagtcgaatgattgcgacaggatacgtgcgtaaagtcgacaggttggggcggcttgtggtgccgaatcggattcgcagcgacctccatcttgccaaagaagatcctgtggagatttacgtcgaagccgatagcatcgtgcttacgaagtacgaacccaagtgcgtgttctgcggggagaaggccgagaaggtctttcacgagcgagctgtctgcgggacgtgcttggaggagttgaagacgaggagtaagagatga

SEQ ID NO: 2310 - DNA, 357 bp, Artificial
  Substituion in SEQ ID NO 2297
gtggcagttagcgcggcatttgccgtttgcgctattgcttctcattgttgtcgtgataggtgtaggatgggtgatgatgagacgacggtactgaggaggaaaagtcgaatgattgcgacaggatacgtgcgtaaagtcgacaggttggggcggcttgtggtgccgaatcggattcgcagcgacctccatcttgccaaagaagatcctgtggagatttacgtcgaagccgaaagcatcgtgcttacgaagtacgaacccaagtgcgtgttctgcggggagaaggccgagaaggtctttcacgagcgagctgtctgcgggacgtgcttggaggagttgaagacgaggagtaagagatga

SEQ ID NO: 2311 - DNA, 357 bp, Artificial
  Substituion in SEQ ID NO 2297
gtggcagttagcgcggcatttgccgtttgcgctattgcttctcattgttgtcgtgataggtgtaggatgggtgatgatgagacgacggtactgaggaggaaaagtcgaatgattgcgacaggatacgtgcgtaaagtcgacaggttggggcggcttgtggtgccgaatcggattcgcagcgacctccatcttgccaaagaagatcctgtggagatttacgtcgaagccgatagcatcgtgcttacgaagtacgaacccaagtgcgtgttctgcggggagaaggccgagaaggtctttcacgagcgagctgtctgcgggacgtgcattgaggagttgaagacgaggagtaagagatga

SEQ ID NO: 2312 - DNA, 357 bp, Artificial
  Substituion in SEQ ID NO 2297
gtggcagttagcgcggcatttgccgtttgcgctattgcttctcattgttgtcgtgataggtgtaggatgggtgatgatgagacgacggtactgaggaggaaaagtcgaatgattgcgacaggatacgtgcgtaaagtcgacaggttggggcggcttgtggtgccgaatcggattcgcagcgacctccatcttgccaaagaagatcctgtggagatttacgtcgaagccgatagcatcgtgcttacgaagtacgaacccaagtgcgtgttctgcggggagcgtgccgagaaggtctttcacgagcgagctgtctgcgggacgtgcttggaggagttgaagacgaggagtaagagatga

SEQ ID NO: 2313 - protein, 375 aa, Alicyclobacillus acidocaldarius
MFRTILFDVDGVMLSEERYFDASALTVHELLTSQRFLGLSSVSPAFSPAPAEDAIRAIRRDVFRYDAVLEGLKNIGVNANWDMVYFVFVAEWVAALERAREASEEAVDRARSVLREGFSEASLRAIGGLLREALPGYVIAWKGYDALYEGASSRSDLMERAREALARYAPEADAHALWQVGQETFQEWYLGDAYTGKETGKAGFLTSEYPIVDPAAFAALLADLKAAGVTLGIATGRPEIETRVPLEHFGWLSYFDPARVTNASDVVAAEERVPHARPLSKPHPFSYLRSLMGEADVEKLLTVELPIPGIRGEVLVVGDSIADKLAADRLGASFAAVLTGLEGQAARPKFERLGADYILNHVLELRRVLSLASVE

SEQ ID NO: 2314 - DNA, 1128 bp, Alicyclobacillus acidocaldarius
atgttcaggacgattttgttcgatgtggacggcgtcatgctgagcgaggagcgttattttgacgcgtcggcgctcaccgtgcacgaactcttgacgagccaacgatttctcggcctgtcctccgtttcgccggccttctccccggcgcctgccgaggacgccatccgcgccatccgccgcgacgtgtttcgctacgatgcggtgctcgagggcttgaagaacatcggcgtgaatgccaactgggacatggtgtacttcgtgttcgtcgcggagtgggtcgcggcgctcgagcgcgcgcgggaggcgtccgaggaggccgtcgatcgcgcccggtccgttctccgggagggcttttcggaggcctcgcttcgtgccatcggggggctgctgcgggaggcgctgcccgggtacgtgatcgcctggaagggatacgacgcgctgtacgaaggggcttcgtcgcggtcggatttgatggagcgggcgcgggaggcgctcgctcggtacgcgcctgaggctgacgcgcacgcgctttggcaggtcgggcaggagacgtttcaggagtggtatctcggggacgcgtacaccggcaaggagacgggtaaggcgggctttctcacgagcgagtacccgattgtcgatccggccgcgtttgccgcactgctcgcggatctcaaggcggcgggcgtgacgttgggtattgcgaccggccggccggagattgagacgcgcgtgccgcttgagcacttcggctggctgtcgtatttcgatccggcccgcgtcacgaatgcctcagacgtggtggcggcggaggagcgcgtgccgcacgcccggccgctgtcgaagccgcacccgttctcgtacctgcgttcgctgatgggcgaagcggacgtcgagaaactccttacggtggagcttcccatcccgggcatccgcggcgaggtgctcgtggtaggcgattccatcgccgacaagctcgcggcggacaggctcggcgcgtcgtttgccgccgtcctgacgggcctcgagggtcaggcggcgaggccgaagttcgagcggcttggggctgattacatcctgaaccacgtgctggagctgcggcgggtgttgagccttgcgtccgtggagtga

SEQ ID NO: 2315 - protein, 374 aa, Bacillus coagulans 36D1
MIQTVLFDVDGVLLSEERYFDASGLTVWELIHSGHYLGLAPEQFKTTLTDEEIRRIRADVFQHDEVLRFLKSRGMNANWDMIYLTFTCQLLHLLSQIKEKEAGRIRGWLASEIGDVTLHEMREVLAHYPVETDYSIFLNWFAKRPETKQDLLKVLDQLAYEIFGLTDTQLGKKGALWSVCEHASQEWYVGDQNIVASTGKPSVQTGKKGFLDEEIPLAEPEKIGALFSFLAEKGLKLGVGTGRPQLETYGPFRALGWLPLFHEEHIVTADDVLKAEEELGGHTPLAKPNPFTYLLALKGKNTPARDCTECSLPLENGQEILIVGDSLADLLAAQKIGAQFAGILTGLSGKEAKAEFEEHGADYIFENVADLKNI

SEQ ID NO: 2316 - protein, 372 aa, Staphylococcus epidermidis ATCC 12228
KAILFDVDGVFLSEERCFDVSAITVAELLSSPDFLNCDIDIHFDGNLTENDINKIRRNVFNNDRILNQLKSLGLNSNWDMLFIVFSIHLIDKAKQLKPSLRDQLLDELLFTKETLKEIAKDLTDKTINYSLPYDVIASFRNGKDAIYEDLEVYAKNQLELNNTSLFKLKSALWTLAKDIYQEWYLGKALFNQVEYKKDIQDFKKGFIYDEVILKPIEEIQLLLQNLIEAGYQIAIATGRPRTETIIPFQSLGLKSYFKDEHIVTASEVLLAEKQFPQYQPLGKPNPFSYIATLNGNYNDQYERYATKQEDIVNKDEVYIVGDSLADLLSAKKIGATFIGTLTGLKGKAAHSELVANGADHVVEDITKIRKIL

SEQ ID NO: 2317 - protein, 372 aa, Staphylococcus aureus subsp. aureus MW2
KKILFDVDGVFLSEERCFDVSALTVYELLMDKCYLGLHSHIDWETLTDNDIQDIRNRIFQKDKILNKLKSLGLNSNWDMLFIVFSIHLIDILKKLSHDEIEAFMYQDEPVELKLQNISTNLADCFNLNEQLPLQFLDNVKVGKNNIYAALEEFATTELHVSDATLFSLKGALWTLAQEVYQEWYLGSKLYEDVEKKIARTTFKTGYIYQEIILRPVDEVKVLLNDLKGAGFELGIATGRPYTETVVPFENLGLLPYFEADFIATASDVLEAENMYPQARPLGKPNPFSYIAALYGNNRDKYESYINKQDNIVNKDDVFIVGDSLADLLSAQKIGATFIGTLTGLKGKDAAGELEAHHADYVINHLGELRGVL

SEQ ID NO: 2318 - protein, 372 aa, Staphylococcus aureus subsp. aureus str. Newman
KKILFDVDGVFLSEERCFDVSALTVYELLMDKCYLGLHSHIDWETLTDNDIQDIRNRIFQKDKILNKLKSLGLNSNWDMLFIVFSIHLIDILKKLSHDEIEAFMYQDEPVELKLQNISTNLADCFNLNEQLPLQFLDNVKVGKNNIYAALEEFATTELHVSDATLFSLKGALWTLAQEVYQEWYLGSKLYEDVEKKIARTTFKTGYIYQEIILRPVDEVKVLLNDLKGAGFELGIATGRPYTETVVPFENLGLLPYFEADFIATASDVLEAENMYPQARPLGKPNPFSYIAALYGNNRDKYESYSNKQDNIVNKDDVFIVGDSLADLLSAQKIGATFIGTLTGLKGKDAAGELEAHHADYVINHLGELRGVL

SEQ ID NO: 2319 - protein, 372 aa, Staphylococcus aureus subsp. aureus Mu50
KKILFDVDGIFLSEERCFDVSALTVYELLMDKCYLGLHSHIDWETLTDNDIQDIRNRIFQKDKILNKLKSLGLNSNWDMLFIVFSIHLIDILKKLSHDEIEAFMYQDEPVELKLQNISTNLADCFNLNEQLPLQFLDNVKVGKNNIYAALEEFATTELHVSDATLFSLKGALWTLAQEVYQEWYLGSKLYEDVEKKIARTTFKTGYIYQEIILRPVDEVKVLLNDLKGAGFELGIATGRPYTETVVPFENLGLLPYFEADFIATASDVLEAENMYPQARPLGKPNPFSYIAALYGNNRDKYESYINKQDNIVNKDDVFIVGDSLADLLSAQKIGATFIGTLTGLKGKDAAGELEAHHADYVINHLGELRGVL

SEQ ID NO: 2320 - protein, 375 aa, Artificial
  Substituion in SEQ ID NO 2313
MFRTILFDVDGVMLSEERYFDASALTVHELLTSQRFLGLSSVSPAFSPAPAEDAIRAIRRDVFRYDAVLEGLKNIGVNANWDMVYFVFVAEWVAALERAREASEEAVDRARSVLREGFSEASLRAIGGLLREALPGYVIAWKGYDALYEGASSRSDLMERAREALARYAPEADAHALWQVGQETFQEWYLGDAYTGKETGKAGFLTSEYPIVDPAAFAALLADLKAAGVTLGIATGRPEIETRVPLEHFGWISYFDPARVTNASDVVAAEERVPHARPLSKPHPFSYLRSLMGEADVEKLLTVELPIPGIRGEVLVVGDSIADKLAADRLGASFAAVLTGLEGQAARPKFERLGADYILNHVLELRRVLSLASVE

SEQ ID NO: 2321 - protein, 375 aa, Artificial
  Substituion in SEQ ID NO 2313
MFRTILFDVDGVMLSEERYFDASALTVHELLTSQRFLGLSSVSPAFSPAPAEDAIRAIRRDVFRYDAVLEGLKNIGVNANWDMVYFVFVAEWVAALERAREASEEAVDRARSVLREGFSEASLRAIGGLLREALPGYVIAWKGYDALYEGASSRSDLMERAREALARYAPEADAHALWQVGQETFQEWYLGDAYTGRETGKAGFLTSEYPIVDPAAFAALLADLKAAGVTLGIATGRPEIETRVPLEHFGWLSYFDPARVTNASDVVAAEERVPHARPLSKPHPFSYLRSLMGEADVEKLLTVELPIPGIRGEVLVVGDSIADKLAADRLGASFAAVLTGLEGQAARPKFERLGADYILNHVLELRRVLSLASVE

SEQ ID NO: 2322 - protein, 375 aa, Artificial
  Substituion in SEQ ID NO 2313
MFRTILFDVDGVMLSEERYFDASALTVHELLTSQRFLGLSSVSPAFSPAPAEDAIRAIRRDVFRYDAVLEGLKNIGVNANWDMVYFVFVAEWVAALERAREASEEAVDRARSVLREGFSEASLRAIGGLLREALPGYVIAWKGYDALYEGASSRSDLMERAREALARYAPEADAHALWQVGQETFQEWYLGDAYTGKETGKAGFLTSEYPIVDPAAFAALLADLKAAGVTLGIATGRPEIETRVPLEHFGWLSYFDPARVTNASDVVAAEERVPHARPLSKPHPFSYLRSLMGEADVEKLLTVELPIPGIRGEVLVVGDSIADKLAADRLGASFAAVLTGLEGQAARPKFERLGADYILNHVIELRRVLSLASVE

SEQ ID NO: 2323 - protein, 375 aa, Artificial
  Substituion in SEQ ID NO 2313
MFRTILFDVDGVMLSEERYFDASALTVHELLTSQRFLGLSSVSPAFSPAPAEDAIRAIRRDVFRYDAVLEGLKNIGVNANWDMVYFVFVAEWVAALERAREASEEAVDRARSVLREGFSEASLRAIGGLLREALPGYVIAWKGYDALYEGASSRSDLMERAREALARYAPEADAHALWQVGQETFQEWYLGDAYTGKETGKAGFLTSEYPIVDPAAFAALLADLKAAGVTLGIATGRPEIETRVPLEHFGWLSYFDPARVTNASDVVAAEERVPHARPLSKPHPFSYLRSLMGEADVEKLLTVELPIPGIRGEVLVVGDSIADKLAADRLGASFAAVLTGLEGQAARPKFERLGADYILNHVLELRRVLSLASIE

SEQ ID NO: 2324 - protein, 375 aa, Artificial
  Substituion in SEQ ID NO 2313
MFRTILFDVDGVMLSEERYFDASALTVHELLTSQRFLGLSSVSPAFSPAPAEDAIRAIRRDVFRYDAVLEGLKNIGVNANWDMVYFVFVAEWVAALERAREASEEAVDRARSVLREGFSEASLRAIGGLLREALPGYVIAWKGYDALYEGASSRSDLMERAREALARYAPEADAHALWQVGQETFQEWYLGDAYTGKETGKAGFLTSEYPIVDPAAFAALLADLKAAGVTLGIATGRPEIETRVPLEHFGWLSYFDPARVTNASDVVAAEERVPHARPLSKPHPFSYLRSLMGEADVDKLLTVELPIPGIRGEVLVVGDSIADKLAADRLGASFAAVLTGLEGQAARPKFERLGADYILNHVLELRRVLSLASVE

SEQ ID NO: 2325 - DNA, 1128 bp, Artificial
  Substituion in SEQ ID NO 2314
atgttcaggacgattttgttcgatgtggacggcgtcatgctgagcgaggagcgttattttgacgcgtcggcgctcaccgtgcacgaactcttgacgagccaacgatttctcggcctgtcctccgtttcgccggccttctccccggcgcctgccgaggacgccatccgcgccatccgccgcgacgtgtttcgctacgatgcggtgctcgagggcttgaagaacatcggcgtgaatgccaactgggacatggtgtacttcgtgttcgtcgcggagtgggtcgcggcgctcgagcgcgcgcgggaggcgtccgaggaggccgtcgatcgcgcccggtccgttctccgggagggcttttcggaggcctcgcttcgtgccatcggggggctgctgcgggaggcgctgcccgggtacgtgatcgcctggaagggatacgacgcgctgtacgaaggggcttcgtcgcggtcggatttgatggagcgggcgcgggaggcgctcgctcggtacgcgcctgaggctgacgcgcacgcgctttggcaggtcgggcaggagacgtttcaggagtggtatctcggggacgcgtacaccggcaaggagacgggtaaggcgggctttctcacgagcgagtacccgattgtcgatccggccgcgtttgccgcactgctcgcggatctcaaggcggcgggcgtgacgttgggtattgcgaccggccggccggagattgagacgcgcgtgccgcttgagcacttcggctggatttcgtatttcgatccggcccgcgtcacgaatgcctcagacgtggtggcggcggaggagcgcgtgccgcacgcccggccgctgtcgaagccgcacccgttctcgtacctgcgttcgctgatgggcgaagcggacgtcgagaaactccttacggtggagcttcccatcccgggcatccgcggcgaggtgctcgtggtaggcgattccatcgccgacaagctcgcggcggacaggctcggcgcgtcgtttgccgccgtcctgacgggcctcgagggtcaggcggcgaggccgaagttcgagcggcttggggctgattacatcctgaaccacgtgctggagctgcggcgggtgttgagccttgcgtccgtggagtga

SEQ ID NO: 2326 - DNA, 1128 bp, Artificial
  Substituion in SEQ ID NO 2314
atgttcaggacgattttgttcgatgtggacggcgtcatgctgagcgaggagcgttattttgacgcgtcggcgctcaccgtgcacgaactcttgacgagccaacgatttctcggcctgtcctccgtttcgccggccttctccccggcgcctgccgaggacgccatccgcgccatccgccgcgacgtgtttcgctacgatgcggtgctcgagggcttgaagaacatcggcgtgaatgccaactgggacatggtgtacttcgtgttcgtcgcggagtgggtcgcggcgctcgagcgcgcgcgggaggcgtccgaggaggccgtcgatcgcgcccggtccgttctccgggagggcttttcggaggcctcgcttcgtgccatcggggggctgctgcgggaggcgctgcccgggtacgtgatcgcctggaagggatacgacgcgctgtacgaaggggcttcgtcgcggtcggatttgatggagcgggcgcgggaggcgctcgctcggtacgcgcctgaggctgacgcgcacgcgctttggcaggtcgggcaggagacgtttcaggagtggtatctcggggacgcgtacaccggccgtgagacgggtaaggcgggctttctcacgagcgagtacccgattgtcgatccggccgcgtttgccgcactgctcgcggatctcaaggcggcgggcgtgacgttgggtattgcgaccggccggccggagattgagacgcgcgtgccgcttgagcacttcggctggctgtcgtatttcgatccggcccgcgtcacgaatgcctcagacgtggtggcggcggaggagcgcgtgccgcacgcccggccgctgtcgaagccgcacccgttctcgtacctgcgttcgctgatgggcgaagcggacgtcgagaaactccttacggtggagcttcccatcccgggcatccgcggcgaggtgctcgtggtaggcgattccatcgccgacaagctcgcggcggacaggctcggcgcgtcgtttgccgccgtcctgacgggcctcgagggtcaggcggcgaggccgaagttcgagcggcttggggctgattacatcctgaaccacgtgctggagctgcggcgggtgttgagccttgcgtccgtggagtga

SEQ ID NO: 2327 - DNA, 1128 bp, Artificial
  Substituion in SEQ ID NO 2314
atgttcaggacgattttgttcgatgtggacggcgtcatgctgagcgaggagcgttattttgacgcgtcggcgctcaccgtgcacgaactcttgacgagccaacgatttctcggcctgtcctccgtttcgccggccttctccccggcgcctgccgaggacgccatccgcgccatccgccgcgacgtgtttcgctacgatgcggtgctcgagggcttgaagaacatcggcgtgaatgccaactgggacatggtgtacttcgtgttcgtcgcggagtgggtcgcggcgctcgagcgcgcgcgggaggcgtccgaggaggccgtcgatcgcgcccggtccgttctccgggagggcttttcggaggcctcgcttcgtgccatcggggggctgctgcgggaggcgctgcccgggtacgtgatcgcctggaagggatacgacgcgctgtacgaaggggcttcgtcgcggtcggatttgatggagcgggcgcgggaggcgctcgctcggtacgcgcctgaggctgacgcgcacgcgctttggcaggtcgggcaggagacgtttcaggagtggtatctcggggacgcgtacaccggcaaggagacgggtaaggcgggctttctcacgagcgagtacccgattgtcgatccggccgcgtttgccgcactgctcgcggatctcaaggcggcgggcgtgacgttgggtattgcgaccggccggccggagattgagacgcgcgtgccgcttgagcacttcggctggctgtcgtatttcgatccggcccgcgtcacgaatgcctcagacgtggtggcggcggaggagcgcgtgccgcacgcccggccgctgtcgaagccgcacccgttctcgtacctgcgttcgctgatgggcgaagcggacgtcgagaaactccttacggtggagcttcccatcccgggcatccgcggcgaggtgctcgtggtaggcgattccatcgccgacaagctcgcggcggacaggctcggcgcgtcgtttgccgccgtcctgacgggcctcgagggtcaggcggcgaggccgaagttcgagcggcttggggctgattacatcctgaaccacgtgattgagctgcggcgggtgttgagccttgcgtccgtggagtga

SEQ ID NO: 2328 - DNA, 1128 bp, Artificial
  Substituion in SEQ ID NO 2314
atgttcaggacgattttgttcgatgtggacggcgtcatgctgagcgaggagcgttattttgacgcgtcggcgctcaccgtgcacgaactcttgacgagccaacgatttctcggcctgtcctccgtttcgccggccttctccccggcgcctgccgaggacgccatccgcgccatccgccgcgacgtgtttcgctacgatgcggtgctcgagggcttgaagaacatcggcgtgaatgccaactgggacatggtgtacttcgtgttcgtcgcggagtgggtcgcggcgctcgagcgcgcgcgggaggcgtccgaggaggccgtcgatcgcgcccggtccgttctccgggagggcttttcggaggcctcgcttcgtgccatcggggggctgctgcgggaggcgctgcccgggtacgtgatcgcctggaagggatacgacgcgctgtacgaaggggcttcgtcgcggtcggatttgatggagcgggcgcgggaggcgctcgctcggtacgcgcctgaggctgacgcgcacgcgctttggcaggtcgggcaggagacgtttcaggagtggtatctcggggacgcgtacaccggcaaggagacgggtaaggcgggctttctcacgagcgagtacccgattgtcgatccggccgcgtttgccgcactgctcgcggatctcaaggcggcgggcgtgacgttgggtattgcgaccggccggccggagattgagacgcgcgtgccgcttgagcacttcggctggctgtcgtatttcgatccggcccgcgtcacgaatgcctcagacgtggtggcggcggaggagcgcgtgccgcacgcccggccgctgtcgaagccgcacccgttctcgtacctgcgttcgctgatgggcgaagcggacgtcgagaaactccttacggtggagcttcccatcccgggcatccgcggcgaggtgctcgtggtaggcgattccatcgccgacaagctcgcggcggacaggctcggcgcgtcgtttgccgccgtcctgacgggcctcgagggtcaggcggcgaggccgaagttcgagcggcttggggctgattacatcctgaaccacgtgctggagctgcggcgggtgttgagccttgcgtccattgagtga

SEQ ID NO: 2329 - DNA, 1128 bp, Artificial
  Substituion in SEQ ID NO 2314
atgttcaggacgattttgttcgatgtggacggcgtcatgctgagcgaggagcgttattttgacgcgtcggcgctcaccgtgcacgaactcttgacgagccaacgatttctcggcctgtcctccgtttcgccggccttctccccggcgcctgccgaggacgccatccgcgccatccgccgcgacgtgtttcgctacgatgcggtgctcgagggcttgaagaacatcggcgtgaatgccaactgggacatggtgtacttcgtgttcgtcgcggagtgggtcgcggcgctcgagcgcgcgcgggaggcgtccgaggaggccgtcgatcgcgcccggtccgttctccgggagggcttttcggaggcctcgcttcgtgccatcggggggctgctgcgggaggcgctgcccgggtacgtgatcgcctggaagggatacgacgcgctgtacgaaggggcttcgtcgcggtcggatttgatggagcgggcgcgggaggcgctcgctcggtacgcgcctgaggctgacgcgcacgcgctttggcaggtcgggcaggagacgtttcaggagtggtatctcggggacgcgtacaccggcaaggagacgggtaaggcgggctttctcacgagcgagtacccgattgtcgatccggccgcgtttgccgcactgctcgcggatctcaaggcggcgggcgtgacgttgggtattgcgaccggccggccggagattgagacgcgcgtgccgcttgagcacttcggctggctgtcgtatttcgatccggcccgcgtcacgaatgcctcagacgtggtggcggcggaggagcgcgtgccgcacgcccggccgctgtcgaagccgcacccgttctcgtacctgcgttcgctgatgggcgaagcggacgtcgataaactccttacggtggagcttcccatcccgggcatccgcggcgaggtgctcgtggtaggcgattccatcgccgacaagctcgcggcggacaggctcggcgcgtcgtttgccgccgtcctgacgggcctcgagggtcaggcggcgaggccgaagttcgagcggcttggggctgattacatcctgaaccacgtgctggagctgcggcgggtgttgagccttgcgtccgtggagtga

SEQ ID NO: 2330 - protein, 242 aa, Alicyclobacillus acidocaldarius
MGLRGGGDVIAGVTYGVAKKTLGEQAYEVIREEILSLRLHPGQTVYESDFTRMLNMSRTPVREAVRALAMERLIEVLPQRGMKVALISERQVEETRFVRESLELSVIRRVAEDVAQDASVRARLEREMARSLQDQREAAEAGDALQFMHADDAFHQIFLQHFDNETLTAIVAQMRGHLNRVRMLSLFEPERMKRLVGEHERVAEAVLSGNADRSAEAMHHHLAKLMEDLPGIKARHPAFFGP

SEQ ID NO: 2331 - DNA, 729 bp, Alicyclobacillus acidocaldarius
gtgggactgcgaggaggtggagacgtgatcgcgggtgtgacctacggtgtggccaaaaagacgctcggagaacaggcgtacgaggtcatccgcgaggagatcttgtcgcttcggctgcatccggggcagacggtgtacgagtcggacttcacgcgcatgttgaacatgagccgcacgccggtgcgcgaagcggtgcgcgcgcttgcgatggagcggctcattgaggtgctgccccagcggggcatgaaggtggctttgatttcggagcggcaggtggaagagacccgattcgtccgggagagcctggagctttcggtcatccgccgcgtcgcggaggacgtcgcgcaggatgcgtcggtccgcgcccggctggagagggagatggcgagatcgctccaagatcagcgggaggcggccgaagcgggggacgcgcttcaatttatgcacgcggacgatgcgtttcaccagatttttctgcagcacttcgacaatgagacgctcacggccatcgtggcgcagatgcgtgggcatctcaaccgggtgcggatgttgtcgctgttcgagcccgagcggatgaagcggctcgtcggggagcacgagcgcgtcgccgaggccgtgctttcgggcaatgccgaccggtccgcggaggcgatgcatcatcacctggcgaagctgatggaggatctgccagggatcaaagcccggcatccggcgttctttggcccctga

SEQ ID NO: 2332 - protein, 210 aa, Saccharophagus degradans 2-40
QIFEYLRDAIVSMELRPGQMIAETSLAEQFGVSRTPVREALIKLSNIGFVEVLPQRGTYVTKFSTQKILEARFIREALEVAVAADLASNVTEELVEACQAIIEAQSKAADEDDSITFQKLDDEFHQMLAQHTQYARVGSLIEAEKAHMDRVRNLSLQEAGQFKRVLAQHKAIVKAIKAGDANKAQEAMSTHMREVYKILTVIPAEHPEYF

SEQ ID NO: 2333 - protein, 215 aa, Sinorhizobium meliloti 1021
ETAAAQVERDLRESIIRLELAPGMRLSEQEIATRMGVSRQPVREALIALGKSKLVDIRPNRGTVVVRISARQMMEARFVREAIEVAVARRASETFDSWTRRKIDTILARQKAANEAHDHNAFRREDEQFHIAIAEGAGCGLAWNAVSDIKAHMDRVCNLQLRHPDSMKKLIAEHEAIITAIDARDADAAAAAMRSHLNGILADLPQIEADNPDLF

SEQ ID NO: 2334 - protein, 215 aa, Sinorhizobium medicae WSM419
ETTAAQVERDLRESIIRLELAPGSRLSEQEIATRMGVSRQPVREALIALGKSKLVDIRPNRGTVVVRISARQMMEARFVREAIEVAVAQRASEAFDSWTRGRIDTILSRQRAAEEINDHNAFRREDEQFHIAIAEGAGCGLAWNAIADIKAHMDRVCNFQLRHPDLMKNLIAEHEAIIIAIDARNAEAAANAMRRHLNGILSDLPQIEADNPDLF

SEQ ID NO: 2335 - protein, 213 aa, Rhodobacter sphaeroides ATCC 17025
IRRRIVSLNYPPGLMIFENAVAAEFGVSRTPVHQAFMRLSHEGLLDVLPQRGARVSFLSRSTIIHAQYVRECLEAAAFFDAARIWDAADAAHLQRERRAQDLIEAQREAVARGDYLRFTELDVAFHTEILGVLGNDLLLACVSQMRNQLNRLRLLELREAHHEKRMIADHEALLAAVSAGRADEARRRLITHLKTLEDFREEIFGRHPDLFRP

SEQ ID NO: 2336 - protein, 226 aa, Burkholderia phytofirmans PsJN
DLTASVSFDSHEPIGKQIFRALRQAIFVGQLVPGTPLSEKEVSDMFQVSRQPVREAFIKLVEAGVLQVLPQRGTFVKRISPRQVREGRFIREAIETAVVKKAAVSISDEQLQALADNLRDQKIAAKANDTAAFLALDEAFHYAIAQAIDCTAAWETIQDIKAQMDRVRYLSLPDVSPLDLLIKQHAKILAGLRAHDASAAEEAMRNHLREILMSLGPIAARNPAWF

SEQ ID NO: 2337 - protein, 242 aa, Artificial
  Substituion in SEQ ID NO 2330
MGLRGGGDVIAGVTYGVAKKTIGEQAYEVIREEILSLRLHPGQTVYESDFTRMLNMSRTPVREAVRALAMERLIEVLPQRGMKVALISERQVEETRFVRESLELSVIRRVAEDVAQDASVRARLEREMARSLQDQREAAEAGDALQFMHADDAFHQIFLQHFDNETLTAIVAQMRGHLNRVRMLSLFEPERMKRLVGEHERVAEAVLSGNADRSAEAMHHHLAKLMEDLPGIKARHPAFFGP

SEQ ID NO: 2338 - protein, 242 aa, Artificial
  Substituion in SEQ ID NO 2330
MGLRGGGDVIAGVTYGVAKKTLGEQAYEVIREEILSLRLHPGQTVYESDFTRMLNMSRTPVREAVRALAMERLIEVLPQRGMKVALISERQVEETRFVRESLELSVIKRVAEDVAQDASVRARLEREMARSLQDQREAAEAGDALQFMHADDAFHQIFLQHFDNETLTAIVAQMRGHLNRVRMLSLFEPERMKRLVGEHERVAEAVLSGNADRSAEAMHHHLAKLMEDLPGIKARHPAFFGP

SEQ ID NO: 2339 - protein, 242 aa, Artificial
  Substituion in SEQ ID NO 2330
MGLRGGGDVIAGVTYGVAKKTLGEQAYEVIREEILSLRLHPGQTVYESDFTRMLNMSRTPVREAVRALAMERLIEILPQRGMKVALISERQVEETRFVRESLELSVIRRVAEDVAQDASVRARLEREMARSLQDQREAAEAGDALQFMHADDAFHQIFLQHFDNETLTAIVAQMRGHLNRVRMLSLFEPERMKRLVGEHERVAEAVLSGNADRSAEAMHHHLAKLMEDLPGIKARHPAFFGP

SEQ ID NO: 2340 - protein, 242 aa, Artificial
  Substituion in SEQ ID NO 2330
MGLRGGGDVIAGVTYGVAKKTLGEQAYEVIREEILSLRLHPGQTVYESDFTRMLNMSRTPVREAVRALAMERLIDVLPQRGMKVALISERQVEETRFVRESLELSVIRRVAEDVAQDASVRARLEREMARSLQDQREAAEAGDALQFMHADDAFHQIFLQHFDNETLTAIVAQMRGHLNRVRMLSLFEPERMKRLVGEHERVAEAVLSGNADRSAEAMHHHLAKLMEDLPGIKARHPAFFGP

SEQ ID NO: 2341 - protein, 242 aa, Artificial
  Substituion in SEQ ID NO 2330
MGLRGGGDVIAGVTYGVAKKTLGEQAYEVIREEILSLRLHPGQTVYESDFTRMLNMSRTPVREAVRALAMERLIEVLPQRGMKVALISERQVEETRFVRESLELSVIRRVAEDVAQDASVRARLEREMARSLQDQREAAEAGDALQFMHADDAFHQIFLQHFDNETLTAIVAQMRGHLNRVRMLSLFEPDRMKRLVGEHERVAEAVLSGNADRSAEAMHHHLAKLMEDLPGIKARHPAFFGP

SEQ ID NO: 2342 - DNA, 729 bp, Artificial
  Substituion in SEQ ID NO 2331
gtgggactgcgaggaggtggagacgtgatcgcgggtgtgacctacggtgtggccaaaaagacgattggagaacaggcgtacgaggtcatccgcgaggagatcttgtcgcttcggctgcatccggggcagacggtgtacgagtcggacttcacgcgcatgttgaacatgagccgcacgccggtgcgcgaagcggtgcgcgcgcttgcgatggagcggctcattgaggtgctgccccagcggggcatgaaggtggctttgatttcggagcggcaggtggaagagacccgattcgtccgggagagcctggagctttcggtcatccgccgcgtcgcggaggacgtcgcgcaggatgcgtcggtccgcgcccggctggagagggagatggcgagatcgctccaagatcagcgggaggcggccgaagcgggggacgcgcttcaatttatgcacgcggacgatgcgtttcaccagatttttctgcagcacttcgacaatgagacgctcacggccatcgtggcgcagatgcgtgggcatctcaaccgggtgcggatgttgtcgctgttcgagcccgagcggatgaagcggctcgtcggggagcacgagcgcgtcgccgaggccgtgctttcgggcaatgccgaccggtccgcggaggcgatgcatcatcacctggcgaagctgatggaggatctgccagggatcaaagcccggcatccggcgttctttggcccctga

SEQ ID NO: 2343 - DNA, 729 bp, Artificial
  Substituion in SEQ ID NO 2331
gtgggactgcgaggaggtggagacgtgatcgcgggtgtgacctacggtgtggccaaaaagacgctcggagaacaggcgtacgaggtcatccgcgaggagatcttgtcgcttcggctgcatccggggcagacggtgtacgagtcggacttcacgcgcatgttgaacatgagccgcacgccggtgcgcgaagcggtgcgcgcgcttgcgatggagcggctcattgaggtgctgccccagcggggcatgaaggtggctttgatttcggagcggcaggtggaagagacccgattcgtccgggagagcctggagctttcggtcatcaaacgcgtcgcggaggacgtcgcgcaggatgcgtcggtccgcgcccggctggagagggagatggcgagatcgctccaagatcagcgggaggcggccgaagcgggggacgcgcttcaatttatgcacgcggacgatgcgtttcaccagatttttctgcagcacttcgacaatgagacgctcacggccatcgtggcgcagatgcgtgggcatctcaaccgggtgcggatgttgtcgctgttcgagcccgagcggatgaagcggctcgtcggggagcacgagcgcgtcgccgaggccgtgctttcgggcaatgccgaccggtccgcggaggcgatgcatcatcacctggcgaagctgatggaggatctgccagggatcaaagcccggcatccggcgttctttggcccctga

SEQ ID NO: 2344 - DNA, 729 bp, Artificial
  Substituion in SEQ ID NO 2331
gtgggactgcgaggaggtggagacgtgatcgcgggtgtgacctacggtgtggccaaaaagacgctcggagaacaggcgtacgaggtcatccgcgaggagatcttgtcgcttcggctgcatccggggcagacggtgtacgagtcggacttcacgcgcatgttgaacatgagccgcacgccggtgcgcgaagcggtgcgcgcgcttgcgatggagcggctcattgagattctgccccagcggggcatgaaggtggctttgatttcggagcggcaggtggaagagacccgattcgtccgggagagcctggagctttcggtcatccgccgcgtcgcggaggacgtcgcgcaggatgcgtcggtccgcgcccggctggagagggagatggcgagatcgctccaagatcagcgggaggcggccgaagcgggggacgcgcttcaatttatgcacgcggacgatgcgtttcaccagatttttctgcagcacttcgacaatgagacgctcacggccatcgtggcgcagatgcgtgggcatctcaaccgggtgcggatgttgtcgctgttcgagcccgagcggatgaagcggctcgtcggggagcacgagcgcgtcgccgaggccgtgctttcgggcaatgccgaccggtccgcggaggcgatgcatcatcacctggcgaagctgatggaggatctgccagggatcaaagcccggcatccggcgttctttggcccctga

SEQ ID NO: 2345 - DNA, 729 bp, Artificial
  Substituion in SEQ ID NO 2331
gtgggactgcgaggaggtggagacgtgatcgcgggtgtgacctacggtgtggccaaaaagacgctcggagaacaggcgtacgaggtcatccgcgaggagatcttgtcgcttcggctgcatccggggcagacggtgtacgagtcggacttcacgcgcatgttgaacatgagccgcacgccggtgcgcgaagcggtgcgcgcgcttgcgatggagcggctcattgatgtgctgccccagcggggcatgaaggtggctttgatttcggagcggcaggtggaagagacccgattcgtccgggagagcctggagctttcggtcatccgccgcgtcgcggaggacgtcgcgcaggatgcgtcggtccgcgcccggctggagagggagatggcgagatcgctccaagatcagcgggaggcggccgaagcgggggacgcgcttcaatttatgcacgcggacgatgcgtttcaccagatttttctgcagcacttcgacaatgagacgctcacggccatcgtggcgcagatgcgtgggcatctcaaccgggtgcggatgttgtcgctgttcgagcccgagcggatgaagcggctcgtcggggagcacgagcgcgtcgccgaggccgtgctttcgggcaatgccgaccggtccgcggaggcgatgcatcatcacctggcgaagctgatggaggatctgccagggatcaaagcccggcatccggcgttctttggcccctga

SEQ ID NO: 2346 - DNA, 729 bp, Artificial
  Substituion in SEQ ID NO 2331
gtgggactgcgaggaggtggagacgtgatcgcgggtgtgacctacggtgtggccaaaaagacgctcggagaacaggcgtacgaggtcatccgcgaggagatcttgtcgcttcggctgcatccggggcagacggtgtacgagtcggacttcacgcgcatgttgaacatgagccgcacgccggtgcgcgaagcggtgcgcgcgcttgcgatggagcggctcattgaggtgctgccccagcggggcatgaaggtggctttgatttcggagcggcaggtggaagagacccgattcgtccgggagagcctggagctttcggtcatccgccgcgtcgcggaggacgtcgcgcaggatgcgtcggtccgcgcccggctggagagggagatggcgagatcgctccaagatcagcgggaggcggccgaagcgggggacgcgcttcaatttatgcacgcggacgatgcgtttcaccagatttttctgcagcacttcgacaatgagacgctcacggccatcgtggcgcagatgcgtgggcatctcaaccgggtgcggatgttgtcgctgttcgagcccgatcggatgaagcggctcgtcggggagcacgagcgcgtcgccgaggccgtgctttcgggcaatgccgaccggtccgcggaggcgatgcatcatcacctggcgaagctgatggaggatctgccagggatcaaagcccggcatccggcgttctttggcccctga

SEQ ID NO: 2347 - protein, 171 aa, Alicyclobacillus acidocaldarius
MAYTGVRQKMRRWKMDRDKAWTVEAVAERLGITPRTLHYYEEKGLIPEVPRTPGGHRVYDEDTIERIEHILRLKEALGYSLQEIRSILSTEDQLKAYRARIAEGHEPEHNVQMLSESVRLLEDVVRHIDEKMLRLGSMREHYMDRLARIRARLEREEAATRTVGFPDQEGE

SEQ ID NO: 2348 - DNA, 516 bp, Alicyclobacillus acidocaldarius
ttggcgtacactggggtgcggcagaagatgaggaggtggaagatggatcgcgacaaagcatggactgtggaggccgtggcggaaagattgggcatcacgccgcgcacactccattattatgaagagaagggtctcattcctgaggttccgcgaacaccgggcggacaccgagtctatgacgaagacaccattgaacgcatcgaacacattcttcgcctcaaggaagccctgggctattcgctgcaagagattcggtccattctctccacagaagaccagttgaaggcatatcgggcgcgcatcgcagaaggtcacgagcccgaacacaacgtgcaaatgctttcggaatcggtgcgcttgcttgaggacgtggttcgccacatcgacgaaaagatgttgagacttgggtccatgcgcgagcattacatggaccgattggcgcgcattcgggcccggcttgagcgcgaagaggccgcgacaaggacggttggatttccagaccaagagggtgagtga

SEQ ID NO: 2349 - protein, 118 aa, Bacillus subtilis subsp. subtilis str. 168
IDQVAKRSGLTKRTIRFYEEIGLIPAPKRTDGGVRLYSEDDMEELEKVISTKEVLGFSLQELQHFMETSRQLELNKEGYLLSLDPKERKEKLEEIQETLNHQLDLIDEKIRTFQSFKE

SEQ ID NO: 2350 - protein, 125 aa, Bacillus amyloliquefaciens FZB42
IDQVAKRSGLTKRTIRFYEEIGLIPAPKRTEGGVRLYSEDDMEELEKVTSTKEVLGFSLQELQQFMEMSRQLELNKEGYLLSLDPKERKEKLEEIQQALNHQLEMIDEKISTFQHFKTRLNGMKE

SEQ ID NO: 2351 - protein, 124 aa, Bacillus licheniformis ATCC 14580
DVEWMKIDQMAKRSGLTKRTIRFYEEIGLLSSPKRTEGGVRLYSEDDLEELERVISAKEVLGFSLQELQQFMETGKHLEMNKEGYLLSLDKRERKEKLEDIQRMLNEQMRMIDEKIEKFQSFKK

SEQ ID NO: 2352 - protein, 118 aa, Bacillus licheniformis ATCC 14580
IDQMAKRSGLTKRTIRFYEEIGLLSSPKRTEGGVRLYSEDDLEELERVISAKEVLGFSLQELQQFMETGKHLEMNKEGYLLSLDKRERKEKLEDIQRMLNEQMRMIDEKIEKFQSFKK

SEQ ID NO: 2353 - protein, 135 aa, Frankia alni ACN14a
GVRDKDQMKKAARELCGIGQAAQELGVSVRALRYYQEVGLLTPSGRTSGGNRLYADSDLARVRRIRELQTLLGFNLDEIGTILAYEDRLAQVRVEFHAASDDGDRLRLLSEGETAYVKLRAEIDEKISRLAAFRD

SEQ ID NO: 2354 - protein, 171 aa, Artificial
  Substituion in SEQ ID NO 2347
MAYTGVRQRMRRWKMDRDKAWTVEAVAERLGITPRTLHYYEEKGLIPEVPRTPGGHRVYDEDTIERIEHILRLKEALGYSLQEIRSILSTEDQLKAYRARIAEGHEPEHNVQMLSESVRLLEDVVRHIDEKMLRLGSMREHYMDRLARIRARLEREEAATRTVGFPDQEGE

SEQ ID NO: 2355 - protein, 171 aa, Artificial
  Substituion in SEQ ID NO 2347
MAYTGVRQKMRRWKMDRDKAWTIEAVAERLGITPRTLHYYEEKGLIPEVPRTPGGHRVYDEDTIERIEHILRLKEALGYSLQEIRSILSTEDQLKAYRARIAEGHEPEHNVQMLSESVRLLEDVVRHIDEKMLRLGSMREHYMDRLARIRARLEREEAATRTVGFPDQEGE

SEQ ID NO: 2356 - protein, 171 aa, Artificial
  Substituion in SEQ ID NO 2347
MAYTGVRQKMRRWKMDRDKAWTVEAVAERLGITPRTLHYYEEKGLIPEVPRTPGGHRVYDEDTIERIEHILRLKEALGYSLQEIRSILSTEDQLKAYRARIAEGHEPEHNVQMLSESVRLLEDVVRHIDEKMLRLGSMREHYMDRLARLRARLEREEAATRTVGFPDQEGE

SEQ ID NO: 2357 - protein, 171 aa, Artificial
  Substituion in SEQ ID NO 2347
MAYTGVRQKMRRWKMERDKAWTVEAVAERLGITPRTLHYYEEKGLIPEVPRTPGGHRVYDEDTIERIEHILRLKEALGYSLQEIRSILSTEDQLKAYRARIAEGHEPEHNVQMLSESVRLLEDVVRHIDEKMLRLGSMREHYMDRLARIRARLEREEAATRTVGFPDQEGE

SEQ ID NO: 2358 - protein, 171 aa, Artificial
  Substituion in SEQ ID NO 2347
MAYTGVRQKMRRWKMDRDKAWTVEAVAERLGITPRTLHYYEEKGLIPEVPRTPGGHRVYDEDTIERIEHILRLKEALGYSLQELRSILSTEDQLKAYRARIAEGHEPEHNVQMLSESVRLLEDVVRHIDEKMLRLGSMREHYMDRLARIRARLEREEAATRTVGFPDQEGE

SEQ ID NO: 2359 - DNA, 516 bp, Artificial
  Substituion in SEQ ID NO 2348
ttggcgtacactggggtgcggcagcgtatgaggaggtggaagatggatcgcgacaaagcatggactgtggaggccgtggcggaaagattgggcatcacgccgcgcacactccattattatgaagagaagggtctcattcctgaggttccgcgaacaccgggcggacaccgagtctatgacgaagacaccattgaacgcatcgaacacattcttcgcctcaaggaagccctgggctattcgctgcaagagattcggtccattctctccacagaagaccagttgaaggcatatcgggcgcgcatcgcagaaggtcacgagcccgaacacaacgtgcaaatgctttcggaatcggtgcgcttgcttgaggacgtggttcgccacatcgacgaaaagatgttgagacttgggtccatgcgcgagcattacatggaccgattggcgcgcattcgggcccggcttgagcgcgaagaggccgcgacaaggacggttggatttccagaccaagagggtgagtga

SEQ ID NO: 2360 - DNA, 516 bp, Artificial
  Substituion in SEQ ID NO 2348
ttggcgtacactggggtgcggcagaagatgaggaggtggaagatggatcgcgacaaagcatggactattgaggccgtggcggaaagattgggcatcacgccgcgcacactccattattatgaagagaagggtctcattcctgaggttccgcgaacaccgggcggacaccgagtctatgacgaagacaccattgaacgcatcgaacacattcttcgcctcaaggaagccctgggctattcgctgcaagagattcggtccattctctccacagaagaccagttgaaggcatatcgggcgcgcatcgcagaaggtcacgagcccgaacacaacgtgcaaatgctttcggaatcggtgcgcttgcttgaggacgtggttcgccacatcgacgaaaagatgttgagacttgggtccatgcgcgagcattacatggaccgattggcgcgcattcgggcccggcttgagcgcgaagaggccgcgacaaggacggttggatttccagaccaagagggtgagtga

SEQ ID NO: 2361 - DNA, 516 bp, Artificial
  Substituion in SEQ ID NO 2348
ttggcgtacactggggtgcggcagaagatgaggaggtggaagatggatcgcgacaaagcatggactgtggaggccgtggcggaaagattgggcatcacgccgcgcacactccattattatgaagagaagggtctcattcctgaggttccgcgaacaccgggcggacaccgagtctatgacgaagacaccattgaacgcatcgaacacattcttcgcctcaaggaagccctgggctattcgctgcaagagattcggtccattctctccacagaagaccagttgaaggcatatcgggcgcgcatcgcagaaggtcacgagcccgaacacaacgtgcaaatgctttcggaatcggtgcgcttgcttgaggacgtggttcgccacatcgacgaaaagatgttgagacttgggtccatgcgcgagcattacatggaccgattggcgcgcttacgggcccggcttgagcgcgaagaggccgcgacaaggacggttggatttccagaccaagagggtgagtga

SEQ ID NO: 2362 - DNA, 516 bp, Artificial
  Substituion in SEQ ID NO 2348
ttggcgtacactggggtgcggcagaagatgaggaggtggaagatggaacgcgacaaagcatggactgtggaggccgtggcggaaagattgggcatcacgccgcgcacactccattattatgaagagaagggtctcattcctgaggttccgcgaacaccgggcggacaccgagtctatgacgaagacaccattgaacgcatcgaacacattcttcgcctcaaggaagccctgggctattcgctgcaagagattcggtccattctctccacagaagaccagttgaaggcatatcgggcgcgcatcgcagaaggtcacgagcccgaacacaacgtgcaaatgctttcggaatcggtgcgcttgcttgaggacgtggttcgccacatcgacgaaaagatgttgagacttgggtccatgcgcgagcattacatggaccgattggcgcgcattcgggcccggcttgagcgcgaagaggccgcgacaaggacggttggatttccagaccaagagggtgagtga

SEQ ID NO: 2363 - DNA, 516 bp, Artificial
  Substituion in SEQ ID NO 2348
ttggcgtacactggggtgcggcagaagatgaggaggtggaagatggatcgcgacaaagcatggactgtggaggccgtggcggaaagattgggcatcacgccgcgcacactccattattatgaagagaagggtctcattcctgaggttccgcgaacaccgggcggacaccgagtctatgacgaagacaccattgaacgcatcgaacacattcttcgcctcaaggaagccctgggctattcgctgcaagagttacggtccattctctccacagaagaccagttgaaggcatatcgggcgcgcatcgcagaaggtcacgagcccgaacacaacgtgcaaatgctttcggaatcggtgcgcttgcttgaggacgtggttcgccacatcgacgaaaagatgttgagacttgggtccatgcgcgagcattacatggaccgattggcgcgcattcgggcccggcttgagcgcgaagaggccgcgacaaggacggttggatttccagaccaagagggtgagtga

SEQ ID NO: 2364 - protein, 78 aa, Alicyclobacillus acidocaldarius
MADNGVGIPKVHHPHVFERFYRVDEARSRAKGGAGLGLAICKAIVEAHGGRMEWESEPGEGAVFTVTLPVAGPDGDGA

SEQ ID NO: 2365 - DNA, 237 bp, Alicyclobacillus acidocaldarius
gtggcggacaacggcgtcggcattcccaaggtgcatcatccccacgtgtttgagcgattctatcgcgtcgacgaggcgcgatcgcgcgcgaaaggcggcgcgggcctcgggctcgccatctgcaaggcgattgtggaggcgcacggcggtcgcatggagtgggagagcgagcccggcgaaggtgccgtattcacggtgacgttacccgtcgcggggccggatggagatggagcatag

SEQ ID NO: 2366 - protein, 71 aa, Thermus thermophilus HB27
DDGEGIPEEHLPHLFERFYRVDKARDRERGGSGLGLAIVKAILEAHGGEVWVESQVGKGTAFSFSLPASGP

SEQ ID NO: 2367 - protein, 71 aa, Thermus thermophilus HB8; identical to SEQ ID NO: 2366

SEQ ID NO: 2368 - protein, 73 aa, Geobacillus thermodenitrificans NG80-2
ISDTGPGIPKHDQPRIFERFYKVDKSRHRAAGGSGLGLAIAKQIVDMHHGTISVQSEPGEGATFTVELPIRGP

SEQ ID NO: 2369 - protein, 72 aa, Salinispora tropica CNB-440
VADTGPGIPAQHLPHIFERFYRVDTARDRGNGGSGIGLAIVRAVVSAHGGRVRAENVPGGGAMVKVVLPPAG

SEQ ID NO: 2370 - protein, 69 aa, Geobacter bemidjiensis Bem
DSGIGIPEKDLPRLFERFYRVDEARSRDNGGTGLGLSIVKHIVQAHGGTLEVKSEQGKGSVFSFTLPIA

SEQ ID NO: 2371 - protein, 78 aa, Artificial
  Substituion in SEQ ID NO 2364
MADNGVGIPKVHHPHVFERFYRVDEARSRAKGGAGLGLAICKAIVEAHGGRMEWESEPGDGAVFTVTLPVAGPDGDGA

SEQ ID NO: 2372 - protein, 78 aa, Artificial
  Substituion in SEQ ID NO 2364
MADNGVGIPKVHHPHVFERFYRVDDARSRAKGGAGLGLAICKAIVEAHGGRMEWESEPGEGAVFTVTLPVAGPDGDGA

SEQ ID NO: 2373 - protein, 78 aa, Artificial
  Substituion in SEQ ID NO 2364
MADNGVGIPKVHHPHVFERFYRVDEARSRAKGGAGLGLAICKAIVEAHGGRMEWESDPGEGAVFTVTLPVAGPDGDGA

SEQ ID NO: 2374 - protein, 78 aa, Artificial
  Substituion in SEQ ID NO 2364
MADNGVGIPKVHHPHVFERFYKVDEARSRAKGGAGLGLAICKAIVEAHGGRMEWESEPGEGAVFTVTLPVAGPDGDGA

SEQ ID NO: 2375 - protein, 78 aa, Artificial
  Substituion in SEQ ID NO 2364
MADNGVGIPKIHHPHVFERFYRVDEARSRAKGGAGLGLAICKAIVEAHGGRMEWESEPGEGAVFTVTLPVAGPDGDGA

SEQ ID NO: 2376 - DNA, 237 bp, Artificial
  Substituion in SEQ ID NO 2365
gtggcggacaacggcgtcggcattcccaaggtgcatcatccccacgtgtttgagcgattctatcgcgtcgacgaggcgcgatcgcgcgcgaaaggcggcgcgggcctcgggctcgccatctgcaaggcgattgtggaggcgcacggcggtcgcatggagtgggagagcgagcccggcgatggtgccgtattcacggtgacgttacccgtcgcggggccggatggagatggagcatag

SEQ ID NO: 2377 - DNA, 237 bp, Artificial
  Substituion in SEQ ID NO 2365
gtggcggacaacggcgtcggcattcccaaggtgcatcatccccacgtgtttgagcgattctatcgcgtcgacgatgcgcgatcgcgcgcgaaaggcggcgcgggcctcgggctcgccatctgcaaggcgattgtggaggcgcacggcggtcgcatggagtgggagagcgagcccggcgaaggtgccgtattcacggtgacgttacccgtcgcggggccggatggagatggagcatag

SEQ ID NO: 2378 - DNA, 237 bp, Artificial
  Substituion in SEQ ID NO 2365
gtggcggacaacggcgtcggcattcccaaggtgcatcatccccacgtgtttgagcgattctatcgcgtcgacgaggcgcgatcgcgcgcgaaaggcggcgcgggcctcgggctcgccatctgcaaggcgattgtggaggcgcacggcggtcgcatggagtgggagagcgatcccggcgaaggtgccgtattcacggtgacgttacccgtcgcggggccggatggagatggagcatag

SEQ ID NO: 2379 - DNA, 237 bp, Artificial
  Substituion in SEQ ID NO 2365
gtggcggacaacggcgtcggcattcccaaggtgcatcatccccacgtgtttgagcgattctataaagtcgacgaggcgcgatcgcgcgcgaaaggcggcgcgggcctcgggctcgccatctgcaaggcgattgtggaggcgcacggcggtcgcatggagtgggagagcgagcccggcgaaggtgccgtattcacggtgacgttacccgtcgcggggccggatggagatggagcatag

SEQ ID NO: 2380 - DNA, 237 bp, Artificial
  Substituion in SEQ ID NO 2365
gtggcggacaacggcgtcggcattcccaagattcatcatccccacgtgtttgagcgattctatcgcgtcgacgaggcgcgatcgcgcgcgaaaggcggcgcgggcctcgggctcgccatctgcaaggcgattgtggaggcgcacggcggtcgcatggagtgggagagcgagcccggcgaaggtgccgtattcacggtgacgttacccgtcgcggggccggatggagatggagcatag

SEQ ID NO: 2381 - protein, 183 aa, Alicyclobacillus acidocaldarius
MNPFEGRRVLPAVRSLKDFEELMQGPHPVVVLLETNLTALPSLMRMANKAGKRLILHADLIQGLKHDEAGTQFLCQMIRPYGIISTHASVIATAKKQGVIAIQRVFLIDSHSLRTSYRVLQQAKPDFLEVLPGVVPQLIAEIREQTGLPVLAGGFVRTKEDVERAVAAGATAVTTSVKALWQL

SEQ ID NO: 2382 - DNA, 552 bp, Alicyclobacillus acidocaldarius
atgaatccgttcgagggccggcgcgtgctgcccgccgtgcgcagcctgaaggacttcgaggagctcatgcaggggccgcatccggtcgtggtgctcttggagacgaatctcactgcgctgccgagcttgatgcgcatggcgaacaaggccggcaagcggctcatcctccatgcggatctgatccaggggctgaagcacgacgaggcgggcacccagtttttgtgccagatgatccggccatatggcatcatctctacgcatgcgagcgtgatcgcgacggcgaagaagcagggcgtgatcgccatccagcgcgtgtttctcatcgattcgcacagcctgcgcacaagctatcgcgtgttgcagcaggcgaagccggacttcctggaagttctgcctggcgtggtgccgcagctcattgcggagattcgtgagcagacgggcctgcccgtgctcgcggggggatttgtgcggacgaaggaggacgtggagcgggccgtcgcggccggcgcgacggcggtgaccacctccgtgaaggcgctgtggcagctgtga

SEQ ID NO: 2383 - protein, 179 aa, Bacillus pumilus SAFR-032
FHDQPILPAVRNMKQFEEFLKSPFTYGVLLDVHLGRLKGIMNEANAHHKKMFVHVDLIHGIKHDEYGTEFICQEMKPAGIISTRSSVIVKAKQKKVYAIQRMFLLDTSAMEKSMEFVGKHRPDFIEVLPGVVPNLITEVRERAGIPIFAGGFIRTKEDVERALEAGATAVTTSNTTLWK

SEQ ID NO: 2384 - protein, 176 aa, Bacillus coagulans 36D1
QRILPASVNMKEFERFLKSDYEIGIFLELHISQLKYVAAMAKAEGKKMIYHVDLIQGLKSDDYATEYLCQEYQPFGLISTKANVIQKAKQKGVVSIQRMFLIDSHALEKSYKLIERTKPDYIEVLPGIAPWMITEVKERLGIPIFAGGLIRTREDVEKALKAGAEGITTSDTELWE

SEQ ID NO: 2385 - protein, 182 aa, Bacillus subtilis subsp. subtilis str. 168
MMSFHNQPILPAIRNMKQFDEFLNSSFSYGVILDIHLGQLKGVIKEAQKHGKNMMVHVDLIQGIKHDEYGAEFICQDIKPAGIISTRSNVIAKAKQKKIYAIQRLFLLDTSAMEKSMEFIGKHKPDFIEVLPGIVPSLIQEIKEKTGIPIFAGGFIRTEEDVEQALKAGAVAVTTSNTKLWK

SEQ ID NO: 2386 - protein, 179 aa, Bacillus cereus ATCC 14579
FHEQKILPAVRQIKDLEKLLHSSYEYIVILDIHVGQLKSVISLAKQYCKKVFLHVDLIHGLQSDGHATEYLCQEFRPYGLLSTKASVIMKAKQKGVVAIQRIFLIDSSAMEKSCNLLDKTKPDYIEVLPGALTDVIAEVKERTGVPILAGGFIRTVEDVERALNAGATAITTSKRELWK

SEQ ID NO: 2387 - protein, 179 aa, Bacillus weihenstephanensis KBAB4
FHEQKILPAVRQIKDLEKLLHSSYEYIVILDIHVGQLKSVVSLAKQHNKKVFLHVDLIHGLQSDGHATEFLCQEYKPYGLLSTKASVIMKAKQKGVVSIQRIFLIDSSAMEKSCNLLEKTKPDYIEVLPGALTGVIAEVKERTGVPILAGGFIRTVEDVERALNAGATAITTSKKELWK

SEQ ID NO: 2388 - protein, 183 aa, Artificial
  Substituion in SEQ ID NO 2381
MNPFEGRRVLPAVRSLKDFEELMQGPHPVVVLLETNLTALPSLMRMAQKAGKRLILHADLIQGLKHDEAGTQFLCQMIRPYGIISTHASVIATAKKQGVIAIQRVFLIDSHSLRTSYRVLQQAKPDFLEVLPGVVPQLIAEIREQTGLPVLAGGFVRTKEDVERAVAAGATAVTTSVKALWQL

SEQ ID NO: 2389 - protein, 183 aa, Artificial
  Substituion in SEQ ID NO 2381
MNPFEGRRVLPAVRSLKDFEELMQGPHPVVVLLETNLTALPSLMRMANKAGKRLILHADLIQGLKHDEAGTQFLCQMIRPYGIISTHASVIATAKKNGVIAIQRVFLIDSHSLRTSYRVLQQAKPDFLEVLPGVVPQLIAEIREQTGLPVLAGGFVRTKEDVERAVAAGATAVTTSVKALWQL

SEQ ID NO: 2390 - protein, 183 aa, Artificial
  Substituion in SEQ ID NO 2381
MNPFEGRRVLPAVRSLKDFEELMQGPHPVVVLLETNLTALPSLMRMANKAGKRLILHADLIQGLKHDEAGTQFLCQMIRPYGIISTHASVIATAKKQGVIAIQRVFLIDSHSLRTSYRVLQNAKPDFLEVLPGVVPQLIAEIREQTGLPVLAGGFVRTKEDVERAVAAGATAVTTSVKALWQL

SEQ ID NO: 2391 - protein, 183 aa, Artificial
  Substituion in SEQ ID NO 2381
MNPFEGRRVLPAVRSLKDFEELMQGPHPVVVLLETNLTALPSLMRMANKAGKRLILHADLIQGLKHDEAGTQFLCQMIKPYGIISTHASVIATAKKQGVIAIQRVFLIDSHSLRTSYRVLQQAKPDFLEVLPGVVPQLIAEIREQTGLPVLAGGFVRTKEDVERAVAAGATAVTTSVKALWQL

SEQ ID NO: 2392 - protein, 183 aa, Artificial
  Substituion in SEQ ID NO 2381
MNPFEGRRVLPAVRSLKDFEELMQGPHPVVVLLETNLTALPSLMRMANKAGKRLILHADLIQGLKHDEAGTQFLCQMLRPYGIISTHASVIATAKKQGVIAIQRVFLIDSHSLRTSYRVLQQAKPDFLEVLPGVVPQLIAEIREQTGLPVLAGGFVRTKEDVERAVAAGATAVTTSVKALWQL

SEQ ID NO: 2393 - DNA, 552 bp, Artificial
  Substituion in SEQ ID NO 2382
atgaatccgttcgagggccggcgcgtgctgcccgccgtgcgcagcctgaaggacttcgaggagctcatgcaggggccgcatccggtcgtggtgctcttggagacgaatctcactgcgctgccgagcttgatgcgcatggcgcaaaaggccggcaagcggctcatcctccatgcggatctgatccaggggctgaagcacgacgaggcgggcacccagtttttgtgccagatgatccggccatatggcatcatctctacgcatgcgagcgtgatcgcgacggcgaagaagcagggcgtgatcgccatccagcgcgtgtttctcatcgattcgcacagcctgcgcacaagctatcgcgtgttgcagcaggcgaagccggacttcctggaagttctgcctggcgtggtgccgcagctcattgcggagattcgtgagcagacgggcctgcccgtgctcgcggggggatttgtgcggacgaaggaggacgtggagcgggccgtcgcggccggcgcgacggcggtgaccacctccgtgaaggcgctgtggcagctgtga

SEQ ID NO: 2394 - DNA, 552 bp, Artificial
  Substituion in SEQ ID NO 2382
atgaatccgttcgagggccggcgcgtgctgcccgccgtgcgcagcctgaaggacttcgaggagctcatgcaggggccgcatccggtcgtggtgctcttggagacgaatctcactgcgctgccgagcttgatgcgcatggcgaacaaggccggcaagcggctcatcctccatgcggatctgatccaggggctgaagcacgacgaggcgggcacccagtttttgtgccagatgatccggccatatggcatcatctctacgcatgcgagcgtgatcgcgacggcgaagaagaatggcgtgatcgccatccagcgcgtgtttctcatcgattcgcacagcctgcgcacaagctatcgcgtgttgcagcaggcgaagccggacttcctggaagttctgcctggcgtggtgccgcagctcattgcggagattcgtgagcagacgggcctgcccgtgctcgcggggggatttgtgcggacgaaggaggacgtggagcgggccgtcgcggccggcgcgacggcggtgaccacctccgtgaaggcgctgtggcagctgtga

SEQ ID NO: 2395 - DNA, 552 bp, Artificial
  Substituion in SEQ ID NO 2382
atgaatccgttcgagggccggcgcgtgctgcccgccgtgcgcagcctgaaggacttcgaggagctcatgcaggggccgcatccggtcgtggtgctcttggagacgaatctcactgcgctgccgagcttgatgcgcatggcgaacaaggccggcaagcggctcatcctccatgcggatctgatccaggggctgaagcacgacgaggcgggcacccagtttttgtgccagatgatccggccatatggcatcatctctacgcatgcgagcgtgatcgcgacggcgaagaagcagggcgtgatcgccatccagcgcgtgtttctcatcgattcgcacagcctgcgcacaagctatcgcgtgttgcagaatgcgaagccggacttcctggaagttctgcctggcgtggtgccgcagctcattgcggagattcgtgagcagacgggcctgcccgtgctcgcggggggatttgtgcggacgaaggaggacgtggagcgggccgtcgcggccggcgcgacggcggtgaccacctccgtgaaggcgctgtggcagctgtga

SEQ ID NO: 2396 - DNA, 552 bp, Artificial
  Substituion in SEQ ID NO 2382
atgaatccgttcgagggccggcgcgtgctgcccgccgtgcgcagcctgaaggacttcgaggagctcatgcaggggccgcatccggtcgtggtgctcttggagacgaatctcactgcgctgccgagcttgatgcgcatggcgaacaaggccggcaagcggctcatcctccatgcggatctgatccaggggctgaagcacgacgaggcgggcacccagtttttgtgccagatgatcaaaccatatggcatcatctctacgcatgcgagcgtgatcgcgacggcgaagaagcagggcgtgatcgccatccagcgcgtgtttctcatcgattcgcacagcctgcgcacaagctatcgcgtgttgcagcaggcgaagccggacttcctggaagttctgcctggcgtggtgccgcagctcattgcggagattcgtgagcagacgggcctgcccgtgctcgcggggggatttgtgcggacgaaggaggacgtggagcgggccgtcgcggccggcgcgacggcggtgaccacctccgtgaaggcgctgtggcagctgtga

SEQ ID NO: 2397 - DNA, 552 bp, Artificial
  Substituion in SEQ ID NO 2382
atgaatccgttcgagggccggcgcgtgctgcccgccgtgcgcagcctgaaggacttcgaggagctcatgcaggggccgcatccggtcgtggtgctcttggagacgaatctcactgcgctgccgagcttgatgcgcatggcgaacaaggccggcaagcggctcatcctccatgcggatctgatccaggggctgaagcacgacgaggcgggcacccagtttttgtgccagatgttacggccatatggcatcatctctacgcatgcgagcgtgatcgcgacggcgaagaagcagggcgtgatcgccatccagcgcgtgtttctcatcgattcgcacagcctgcgcacaagctatcgcgtgttgcagcaggcgaagccggacttcctggaagttctgcctggcgtggtgccgcagctcattgcggagattcgtgagcagacgggcctgcccgtgctcgcggggggatttgtgcggacgaaggaggacgtggagcgggccgtcgcggccggcgcgacggcggtgaccacctccgtgaaggcgctgtggcagctgtga

SEQ ID NO: 2398 - protein, 416 aa, Alicyclobacillus acidocaldarius
MGVRLRGGRADGGRAHQAVARQVPRGRVSVSHPHRARVGLSPGGERVKERAASRGSDDDFRARHQRWQWREALDRLLWMSCWSFVLLSASYGVVRLMGRALGWRPVPYGQLMIIGGVGVVMLALVALLWNALGFDRDDRLFFRILDSLSEIGRGNFSARAMLEVRRGFPDHPMNQLVLHVREMAEGLERIEQMRQEFVANVSHEMQTPLTSILGFVKALKSDGLSEGERRHYLDIIEAESERLSRLADNLLKLTSLESGHHPVTLTRFRLDRQLREVAIACEPLWTEKGLFLDMQVEPVELEGDEDLLGQVWMNLLSNAIKFTEPGGRIQVRLEKEETGVCVSVADTGIGIRPEDVSRVFTRFFKADRSRGKPGNGLGLAIAKRIVEMHRGDISVESEPGRGSTFKVHLPYTQGGR

SEQ ID NO: 2399 - DNA, 1251 bp, Alicyclobacillus acidocaldarius
gtgggggtacgactacgcgggggacgagcggacggtggacgtgcacatcaagcggttgcgcgtcaagttccccgaggacgtgtatccgtttcgcatccgcaccgtgcgcgggttgggctatcgcctggaggtgaacgcgtgaaggagcgagccgcctcgcgggggtctgacgacgacttccgcgcccgtcatcagcgctggcagtggcgcgaagcgttggacaggctcctctggatgtcgtgttggtcgtttgtgttgctgagcgcctcgtacggcgtggtgcgcctcatggggcgtgcactcggctggcggcccgtgccgtacggccaactgatgatcatcggcggcgtgggtgtggtgatgctcgcgctcgtcgcgcttctctggaacgcgcttggcttcgatcgcgatgatcgcctctttttccgcattctcgactccttgagcgagattggccgcgggaatttcagcgcccgcgccatgctggaggtccggcgtggctttccggatcaccccatgaaccagctggtgctgcacgttcgcgagatggcggaagggctcgagcgcatcgaacagatgcgccaggagtttgtggcgaacgtgtcgcacgagatgcagacgccgctcacgtccatcctcggcttcgtgaaggcgctcaaatcggacggactgtcggaaggcgagcggcgccactatctcgacatcatcgaggcggagagcgagcggttgtcccgcctggcggacaacctgctcaagctcacctcgctcgaatcgggccatcacccggtgacgctgacgcgcttccgtctcgaccgccaactgcgcgaggtggcgattgcgtgcgagccgctgtggacggagaaaggtctcttcctcgacatgcaggtggagcccgtcgagttggagggcgacgaggacctcctcggccaggtgtggatgaacctcttgtcaaacgccatcaagttcacggagccgggcggccgaattcaagtgcgcctcgagaaggaagaaacaggcgtctgcgtgtcggttgcggacacgggcatcggcatccgtccggaggatgtgagccgcgtgttcactcgcttcttcaaggcggaccggtcgcgcggcaagccgggcaatgggctgggcctcgccatcgccaagcgcattgtggagatgcaccgcggggacatctcggtcgaaagcgagccaggtcgtgggtcgacattcaaggtgcacctaccgtatactcagggtggaagatga

SEQ ID NO: 2400 - protein, 264 aa, Geobacillus thermodenitrificans NG80-2
AINRIAKGDFRVNLQVDWGGRHHPFAELVTRINDMAANLQAMEDMRQEFISNVSHEIGSPLTSIRGFARALKNENLSQEQRMHYLDIIETECVRLSKLSENLLRLAMLDSERYPLHPTSYRLDTQLQTLILHCEPQWAEKDVDMCAVMEKVSITADEDLLSQVWLNLIHNAIKFTPKGGTITVQVQRRGEQAIVTISDTGPGIPKHDQPRIFERFYKVDKSRHRAAGGSGLGLAIAKQIVDMHHGTISVQSEPGEGATFTVELP

SEQ ID NO: 2401 - protein, 264 aa, Geobacillus kaustophilus HTA426
AINRIAKGDFRVNLQADWGGRNHPFAELVTRINDMAANLQAMEEMRQEFISNVSHEIGSPLTSIRGFARALKNEDLSREQRLHYLDIIETECVRLSKLSENLLRLAMLDSDHYPFHPTSYRLDTQLQTLILHCEPQWAEKELNMCVLFEKVIITADEDLLSQVWLNLIHNAIKFTPKGGTITIQLQRRGEQAIVTVSDTGPGINEHDQLRIFERFYKADKSRHRAAGGSGLGLSIAKKIVDIHHGIISVQSQPGEGATFTVELP

SEQ ID NO: 2402 - protein, 263 aa, Alkaliphilus metalliredigens QYMF
ALESIAKGNFNVRLDDKFKKDESFSRLVKSVNMMASGLDQMEKMRQEFISNVSHEIQSPLASIQGFAQLLQNDELSPEERKHYLSIIETESKRLSKLSDSLLKLAILESDSMRFEPKAYRLDKQLRNLILACEPQWREKRINMEAFLDEVTITADEDMMSQVWINLIYNSIKFTPEGGSVRVDLNQHGKTIVCKISDTGIGIPEEDQKHIFERFYKADKSRERSKKGGGLGLSITKKIIDMHYGDISVQSKSGTGTTFTVSLP

SEQ ID NO: 2403 - protein, 263 aa, Bacillus sp. B14905
ALRQMAKGDFNIQLDVKGNKEDQFGQLIHGINHMAVELGELERMRQEFISNVSHEIQSPLTSINGFAKALKNIHLPEEKRQHYLEIIELESNRLSKISDNLLKLTSLESQHHPFETTTYRLDKQLRNVILALEPNWVAKQLDFDLHLDNITITADEDLLNQVWMNLLTNSIKFTSDRGAITLTMTQHLDTITIIVQDTGIGLSEEQQMHIFERFYKADQSRTAANGGSGLGLAIVKKIIDMHHGTIAVESKLGKFTAFLITLP

SEQ ID NO: 2404 - protein, 262 aa, Bacillus thuringiensis serovar israelensis ATCC 35646
IQKIAKGDFSVKIRNEEKYDGEIGVLVKSINDMTDELNTMEKMRQEFVSNVSHEIQSPLTSIKGFARALQDDNLSEEKRKHYLTIIETETTRLSKLSQNLLKLTLLESEEYTPERVSYRLDQQLKQIVLNSEPLWAEKEIELDLDLEKVHVTADQESMSQVWINLIHNSIKFTPSGGTITIQLKEHETVVEVRICDSGIGISEEQKQHIFERFYKADSSRNRASGGSGLGLAIVKKVLDLHQGEIKVESEEGKGTEFIVRIP

SEQ ID NO: 2405 - protein, 416 aa, Artificial
  Substituion in SEQ ID NO 2398
MGVRLRGGRADGGRAHQAVARQVPRGRVSVSHPHRARVGLSPGGERVKERAASRGSDDDFRARHQRWQWREALDRLLWMSCWSFVLLSASYGVVRLMGRALGWRPVPYGQLMIIGGVGVVMLALVALLWNALGFERDDRLFFRILDSLSEIGRGNFSARAMLEVRRGFPDHPMNQLVLHVREMAEGLERIEQMRQEFVANVSHEMQTPLTSILGFVKALKSDGLSEGERRHYLDIIEAESERLSRLADNLLKLTSLESGHHPVTLTRFRLDRQLREVAIACEPLWTEKGLFLDMQVEPVELEGDEDLLGQVWMNLLSNAIKFTEPGGRIQVRLEKEETGVCVSVADTGIGIRPEDVSRVFTRFFKADRSRGKPGNGLGLAIAKRIVEMHRGDISVESEPGRGSTFKVHLPYTQGGR

SEQ ID NO: 2406 - protein, 416 aa, Artificial
  Substituion in SEQ ID NO 2398
MGVRLRGGRADGGRAHQAVARQVPRGRVSVSHPHRARVGLSPGGERVKERAASRGSDDDFRARHQRWQWREALDRLLWMSCWSFVLLSASYGVVRLMGRALGWRPVPYGQLMIIGGVGVVMLALVALLWNALGFDRDDRLFFRILDSLSEIGRGNFSARAMLEVRRGFPDHPMNQLVLHVREMAEGLERIEQMRQEFVANVSHEMQTPLTSILGFVKALKSDGLSEGERRHYLDIIEAESERLSRLADNLLKLTSLESGHHPVTLTRFRLDRQLREVAIACEPLWTEKGLFLDMQVEPVELEGDDDLLGQVWMNLLSNAIKFTEPGGRIQVRLEKEETGVCVSVADTGIGIRPEDVSRVFTRFFKADRSRGKPGNGLGLAIAKRIVEMHRGDISVESEPGRGSTFKVHLPYTQGGR

SEQ ID NO: 2407 - protein, 416 aa, Artificial
  Substituion in SEQ ID NO 2398
MGVRLRGGRADGGRAHQAVARQVPRGRVSVSHPHRARVGLSPGGERVKERAASRGSDDDFRARHQRWQWREALDRLLWMSCWSFVLLSASYGVVRLMGRAIGWRPVPYGQLMIIGGVGVVMLALVALLWNALGFDRDDRLFFRILDSLSEIGRGNFSARAMLEVRRGFPDHPMNQLVLHVREMAEGLERIEQMRQEFVANVSHEMQTPLTSILGFVKALKSDGLSEGERRHYLDIIEAESERLSRLADNLLKLTSLESGHHPVTLTRFRLDRQLREVAIACEPLWTEKGLFLDMQVEPVELEGDEDLLGQVWMNLLSNAIKFTEPGGRIQVRLEKEETGVCVSVADTGIGIRPEDVSRVFTRFFKADRSRGKPGNGLGLAIAKRIVEMHRGDISVESEPGRGSTFKVHLPYTQGGR

SEQ ID NO: 2408 - protein, 416 aa, Artificial
  Substituion in SEQ ID NO 2398
MGVRLRGGRADGGRAHQAVARQVPRGRVSVSHPHRARVGLSPGGERVKERAASRGSDDDFRARHQRWQWREALDRLLWMSCWSFVLLSASYGVVRLMGRALGWRPVPYGQLMIIGGVGVVMLALVALLWNALGFDRDDRLFFRILDSLSEIGRGNFSARAMLEVRRGFPDHPMNQLVLHVREMAEGLERIEQMRQEFVANVSHEMQTPLTSILGFVKALKSDGLSEGERRHYLDIIEAESERLSRLADNLLKLTSLESGHHPVTLTRFRLDRQLREVAIACEPLWTEKGLFLDMQVEPVELEGDEDLLGQVWMNLLSNAIKFTEPGGRIQVRLEKEETGVCVSVADTGIGIRPDDVSRVFTRFFKADRSRGKPGNGLGLAIAKRIVEMHRGDISVESEPGRGSTFKVHLPYTQGGR

SEQ ID NO: 2409 - protein, 416 aa, Artificial
  Substituion in SEQ ID NO 2398
MGVRLRGGRADGGRAHQAVARQVPRGRVSVSHPHRARVGLSPGGERVKERAASRGSDDDFRARHQRWQWREALDRLLWMSCWSFVLLSASYGVVRLMGRALGWRPVPYGQLMIIGGVGVVMLALVALLWNALGFDRDDRLFFRLLDSLSEIGRGNFSARAMLEVRRGFPDHPMNQLVLHVREMAEGLERIEQMRQEFVANVSHEMQTPLTSILGFVKALKSDGLSEGERRHYLDIIEAESERLSRLADNLLKLTSLESGHHPVTLTRFRLDRQLREVAIACEPLWTEKGLFLDMQVEPVELEGDEDLLGQVWMNLLSNAIKFTEPGGRIQVRLEKEETGVCVSVADTGIGIRPEDVSRVFTRFFKADRSRGKPGNGLGLAIAKRIVEMHRGDISVESEPGRGSTFKVHLPYTQGGR

SEQ ID NO: 2410 - DNA, 1251 bp, Artificial
  Substituion in SEQ ID NO 2399
gtgggggtacgactacgcgggggacgagcggacggtggacgtgcacatcaagcggttgcgcgtcaagttccccgaggacgtgtatccgtttcgcatccgcaccgtgcgcgggttgggctatcgcctggaggtgaacgcgtgaaggagcgagccgcctcgcgggggtctgacgacgacttccgcgcccgtcatcagcgctggcagtggcgcgaagcgttggacaggctcctctggatgtcgtgttggtcgtttgtgttgctgagcgcctcgtacggcgtggtgcgcctcatggggcgtgcactcggctggcggcccgtgccgtacggccaactgatgatcatcggcggcgtgggtgtggtgatgctcgcgctcgtcgcgcttctctggaacgcgcttggcttcgaacgcgatgatcgcctctttttccgcattctcgactccttgagcgagattggccgcgggaatttcagcgcccgcgccatgctggaggtccggcgtggctttccggatcaccccatgaaccagctggtgctgcacgttcgcgagatggcggaagggctcgagcgcatcgaacagatgcgccaggagtttgtggcgaacgtgtcgcacgagatgcagacgccgctcacgtccatcctcggcttcgtgaaggcgctcaaatcggacggactgtcggaaggcgagcggcgccactatctcgacatcatcgaggcggagagcgagcggttgtcccgcctggcggacaacctgctcaagctcacctcgctcgaatcgggccatcacccggtgacgctgacgcgcttccgtctcgaccgccaactgcgcgaggtggcgattgcgtgcgagccgctgtggacggagaaaggtctcttcctcgacatgcaggtggagcccgtcgagttggagggcgacgaggacctcctcggccaggtgtggatgaacctcttgtcaaacgccatcaagttcacggagccgggcggccgaattcaagtgcgcctcgagaaggaagaaacaggcgtctgcgtgtcggttgcggacacgggcatcggcatccgtccggaggatgtgagccgcgtgttcactcgcttcttcaaggcggaccggtcgcgcggcaagccgggcaatgggctgggcctcgccatcgccaagcgcattgtggagatgcaccgcggggacatctcggtcgaaagcgagccaggtcgtgggtcgacattcaaggtgcacctaccgtatactcagggtggaagatga

SEQ ID NO: 2411 - DNA, 1251 bp, Artificial
  Substituion in SEQ ID NO 2399
gtgggggtacgactacgcgggggacgagcggacggtggacgtgcacatcaagcggttgcgcgtcaagttccccgaggacgtgtatccgtttcgcatccgcaccgtgcgcgggttgggctatcgcctggaggtgaacgcgtgaaggagcgagccgcctcgcgggggtctgacgacgacttccgcgcccgtcatcagcgctggcagtggcgcgaagcgttggacaggctcctctggatgtcgtgttggtcgtttgtgttgctgagcgcctcgtacggcgtggtgcgcctcatggggcgtgcactcggctggcggcccgtgccgtacggccaactgatgatcatcggcggcgtgggtgtggtgatgctcgcgctcgtcgcgcttctctggaacgcgcttggcttcgatcgcgatgatcgcctctttttccgcattctcgactccttgagcgagattggccgcgggaatttcagcgcccgcgccatgctggaggtccggcgtggctttccggatcaccccatgaaccagctggtgctgcacgttcgcgagatggcggaagggctcgagcgcatcgaacagatgcgccaggagtttgtggcgaacgtgtcgcacgagatgcagacgccgctcacgtccatcctcggcttcgtgaaggcgctcaaatcggacggactgtcggaaggcgagcggcgccactatctcgacatcatcgaggcggagagcgagcggttgtcccgcctggcggacaacctgctcaagctcacctcgctcgaatcgggccatcacccggtgacgctgacgcgcttccgtctcgaccgccaactgcgcgaggtggcgattgcgtgcgagccgctgtggacggagaaaggtctcttcctcgacatgcaggtggagcccgtcgagttggagggcgacgatgacctcctcggccaggtgtggatgaacctcttgtcaaacgccatcaagttcacggagccgggcggccgaattcaagtgcgcctcgagaaggaagaaacaggcgtctgcgtgtcggttgcggacacgggcatcggcatccgtccggaggatgtgagccgcgtgttcactcgcttcttcaaggcggaccggtcgcgcggcaagccgggcaatgggctgggcctcgccatcgccaagcgcattgtggagatgcaccgcggggacatctcggtcgaaagcgagccaggtcgtgggtcgacattcaaggtgcacctaccgtatactcagggtggaagatga

SEQ ID NO: 2412 - DNA, 1251 bp, Artificial
  Substituion in SEQ ID NO 2399
gtgggggtacgactacgcgggggacgagcggacggtggacgtgcacatcaagcggttgcgcgtcaagttccccgaggacgtgtatccgtttcgcatccgcaccgtgcgcgggttgggctatcgcctggaggtgaacgcgtgaaggagcgagccgcctcgcgggggtctgacgacgacttccgcgcccgtcatcagcgctggcagtggcgcgaagcgttggacaggctcctctggatgtcgtgttggtcgtttgtgttgctgagcgcctcgtacggcgtggtgcgcctcatggggcgtgcaattggctggcggcccgtgccgtacggccaactgatgatcatcggcggcgtgggtgtggtgatgctcgcgctcgtcgcgcttctctggaacgcgcttggcttcgatcgcgatgatcgcctctttttccgcattctcgactccttgagcgagattggccgcgggaatttcagcgcccgcgccatgctggaggtccggcgtggctttccggatcaccccatgaaccagctggtgctgcacgttcgcgagatggcggaagggctcgagcgcatcgaacagatgcgccaggagtttgtggcgaacgtgtcgcacgagatgcagacgccgctcacgtccatcctcggcttcgtgaaggcgctcaaatcggacggactgtcggaaggcgagcggcgccactatctcgacatcatcgaggcggagagcgagcggttgtcccgcctggcggacaacctgctcaagctcacctcgctcgaatcgggccatcacccggtgacgctgacgcgcttccgtctcgaccgccaactgcgcgaggtggcgattgcgtgcgagccgctgtggacggagaaaggtctcttcctcgacatgcaggtggagcccgtcgagttggagggcgacgaggacctcctcggccaggtgtggatgaacctcttgtcaaacgccatcaagttcacggagccgggcggccgaattcaagtgcgcctcgagaaggaagaaacaggcgtctgcgtgtcggttgcggacacgggcatcggcatccgtccggaggatgtgagccgcgtgttcactcgcttcttcaaggcggaccggtcgcgcggcaagccgggcaatgggctgggcctcgccatcgccaagcgcattgtggagatgcaccgcggggacatctcggtcgaaagcgagccaggtcgtgggtcgacattcaaggtgcacctaccgtatactcagggtggaagatga

SEQ ID NO: 2413 - DNA, 1251 bp, Artificial
  Substituion in SEQ ID NO 2399
gtgggggtacgactacgcgggggacgagcggacggtggacgtgcacatcaagcggttgcgcgtcaagttccccgaggacgtgtatccgtttcgcatccgcaccgtgcgcgggttgggctatcgcctggaggtgaacgcgtgaaggagcgagccgcctcgcgggggtctgacgacgacttccgcgcccgtcatcagcgctggcagtggcgcgaagcgttggacaggctcctctggatgtcgtgttggtcgtttgtgttgctgagcgcctcgtacggcgtggtgcgcctcatggggcgtgcactcggctggcggcccgtgccgtacggccaactgatgatcatcggcggcgtgggtgtggtgatgctcgcgctcgtcgcgcttctctggaacgcgcttggcttcgatcgcgatgatcgcctctttttccgcattctcgactccttgagcgagattggccgcgggaatttcagcgcccgcgccatgctggaggtccggcgtggctttccggatcaccccatgaaccagctggtgctgcacgttcgcgagatggcggaagggctcgagcgcatcgaacagatgcgccaggagtttgtggcgaacgtgtcgcacgagatgcagacgccgctcacgtccatcctcggcttcgtgaaggcgctcaaatcggacggactgtcggaaggcgagcggcgccactatctcgacatcatcgaggcggagagcgagcggttgtcccgcctggcggacaacctgctcaagctcacctcgctcgaatcgggccatcacccggtgacgctgacgcgcttccgtctcgaccgccaactgcgcgaggtggcgattgcgtgcgagccgctgtggacggagaaaggtctcttcctcgacatgcaggtggagcccgtcgagttggagggcgacgaggacctcctcggccaggtgtggatgaacctcttgtcaaacgccatcaagttcacggagccgggcggccgaattcaagtgcgcctcgagaaggaagaaacaggcgtctgcgtgtcggttgcggacacgggcatcggcatccgtccggatgatgtgagccgcgtgttcactcgcttcttcaaggcggaccggtcgcgcggcaagccgggcaatgggctgggcctcgccatcgccaagcgcattgtggagatgcaccgcggggacatctcggtcgaaagcgagccaggtcgtgggtcgacattcaaggtgcacctaccgtatactcagggtggaagatga

SEQ ID NO: 2414 - DNA, 1251 bp, Artificial
  Substituion in SEQ ID NO 2399
gtgggggtacgactacgcgggggacgagcggacggtggacgtgcacatcaagcggttgcgcgtcaagttccccgaggacgtgtatccgtttcgcatccgcaccgtgcgcgggttgggctatcgcctggaggtgaacgcgtgaaggagcgagccgcctcgcgggggtctgacgacgacttccgcgcccgtcatcagcgctggcagtggcgcgaagcgttggacaggctcctctggatgtcgtgttggtcgtttgtgttgctgagcgcctcgtacggcgtggtgcgcctcatggggcgtgcactcggctggcggcccgtgccgtacggccaactgatgatcatcggcggcgtgggtgtggtgatgctcgcgctcgtcgcgcttctctggaacgcgcttggcttcgatcgcgatgatcgcctctttttccgcttactcgactccttgagcgagattggccgcgggaatttcagcgcccgcgccatgctggaggtccggcgtggctttccggatcaccccatgaaccagctggtgctgcacgttcgcgagatggcggaagggctcgagcgcatcgaacagatgcgccaggagtttgtggcgaacgtgtcgcacgagatgcagacgccgctcacgtccatcctcggcttcgtgaaggcgctcaaatcggacggactgtcggaaggcgagcggcgccactatctcgacatcatcgaggcggagagcgagcggttgtcccgcctggcggacaacctgctcaagctcacctcgctcgaatcgggccatcacccggtgacgctgacgcgcttccgtctcgaccgccaactgcgcgaggtggcgattgcgtgcgagccgctgtggacggagaaaggtctcttcctcgacatgcaggtggagcccgtcgagttggagggcgacgaggacctcctcggccaggtgtggatgaacctcttgtcaaacgccatcaagttcacggagccgggcggccgaattcaagtgcgcctcgagaaggaagaaacaggcgtctgcgtgtcggttgcggacacgggcatcggcatccgtccggaggatgtgagccgcgtgttcactcgcttcttcaaggcggaccggtcgcgcggcaagccgggcaatgggctgggcctcgccatcgccaagcgcattgtggagatgcaccgcggggacatctcggtcgaaagcgagccaggtcgtgggtcgacattcaaggtgcacctaccgtatactcagggtggaagatga

SEQ ID NO: 2415 - protein, 256 aa, Alicyclobacillus acidocaldarius
MTGGVPHPSVSHLRDGVAECFLDGNLSKGEYPMSERMDQWLTELVRLNEDDRVTDRQLNILRAAVEVFAEKGFAAASTSEIAQRAGVAEGTIFRHYKTKKDLLLSITVPVIDEFVGPFLLRDLETILTAQHERFEDFLRAVLFNRLQFAKKYAQVLRILAQEIPFHPELKAQLKQYVTENVLKRLVGIIEHFQEKGEIARIPARTVIRLTVSVILSHVVLRHILFHDAPWRDDEEIEMTVRFIVQGLRPDASRDQK

SEQ ID NO: 2416 - DNA, 771 bp, Alicyclobacillus acidocaldarius
atgacgggcggagtaccccacccgtccgtctcccaccttcgagacggagtggcggagtgttttctggatggaaatttatcgaaaggtgaatatccaatgtccgagcgaatggaccagtggttgaccgagttggtgcgtctaaacgaggatgaccgcgtgaccgaccgacaattgaacatcttacgcgcggcggtggaagtgttcgcggagaagggttttgctgctgcgtccacgagcgagatcgcacagcgggcaggcgtggccgaaggcaccatcttcagacactataagacaaagaaggatttgcttctttccatcacggtaccggtgatcgatgaatttgtcggaccgttcttgctccgagatctcgagaccattcttactgcccaacacgaacggtttgaagactttctacgagccgtattgtttaaccgcttgcaatttgcaaagaaatatgctcaagttctgaggattttagctcaagaaataccttttcatcccgagttgaaggcgcaactcaagcaatatgtcaccgagaatgtgttgaagcgcctagtcgggattattgaacactttcaggaaaaaggggagattgcgcggattcccgcgcggactgtgatccggctaacggtgtcagtcatcctaagccatgtggtgttgcgtcacatcctgtttcacgatgcaccctggcgagatgatgaggaaattgagatgactgttcgtttcattgtgcagggtttaaggccggacgcgagcagagaccagaaataa

SEQ ID NO: 2417 - protein, 211 aa, Bacillus thuringiensis serovar konkukian str. 97-27
WLEELIAATNTDKRNERQMRILEAAVDMFGEKGYASTSTSEIAKRAGVAEGTIFRYYKTKKDLLLAVVMPTLMKFAAPFFVQAFAKEIFKSEYESYEGLLRVVIHNRFDFAKKHFPMIKILIQEVPFHPELKNEIQQLVETELLLHFKKLIEKFQEKGEIIEMPPATVLRLTLSAVLGLLLTRFLLLPEEKWDDETEIENTIQFILYGLTP

SEQ ID NO: 2418 - protein, 211 aa, Bacillus cereus ATCC 10987
WLEELIAATNTDKRNERQMRILEAAVDMFGEKGYASTSTSEIAKRAGVAEGTIFRYYKTKKDLLLAVVMPTLTKFAAPFFVQAFAKEIFESEYESYEGLLRVVIHNRFEFAKKHFPMIKILIQEVPFQPELKNEIQQLVETELLSHFKKLIEKFQEKGEIIEMPPVTVLRLTLSAVLGLLLTRFLLLPEEKWNDEAEIENTIQFILYGLTP

SEQ ID NO: 2419 - protein, 198 aa, Bacillus sp. NRRL B-14911
LTEKQRSILLAAIQMFSEKGYSATSTNEIAKLAGVAEGTIFRHYKTKKDLLLAIVEPIMSDLVAPYLIQDIEQVLKQRPIRYEDFLRSLLDNRIAFLKKNLPIVKILIQEIPFHPDLKKRFIEQIAEKVFQQFAKIVEYYQEQGQIISGIPPKSIVRMTFSALIGHLAIRYLFLPEAQWDDEAEVERTIRFVMNGLSP

SEQ ID NO: 2420 - protein, 211 aa, Bacillus anthracis str. Ames
WLEELIAATNTDKRNERQMRILEAAVDMFGEKGYASTSTSEIAKRAGVAEGTIFRYYKTKKDLLLAVVMPTLMKFAAPFFVQAFAKEIFKSEYESYEGLLRVVIHNRFDFAKKHFPMIKILIQEVPFHPELKNEIQQLVETELLLHFKKLIEKFQEKGKIIEMPPATVLRLTLSAVFGLLLTRFLLLPEEKWDDETEIENTIQFILYGLTP

SEQ ID NO: 2421 - protein, 211 aa, Bacillus cereus AH187
WLEELIAATNTDKRNQRQMRILEAAVDMFGEKGYASTSTSEIAKRAGVAEGTIFRYYKTKKDLLLAVVMPTLTKFAAPFFVQAFAKEIFKSEYESYEGLLRVVIHNRFEFAKKHFPMIKILIQEVPFQPELKNEIQQLVETELLSHFKKLIAKFQEEGEIIEMPPSSVLRLTLSAVLGLLLTRFLLLPEEKWDDEVEIEHTIQFILFGLTP

SEQ ID NO: 2422 - protein, 256 aa, Artificial
  Substituion in SEQ ID NO 2415
MTGGVPHPSVSHLRDGVAECFLDGNLSKGEYPMSERMDQWLTELVRLNEDDRVTDRQLNILRAAVEVFAEKGFAAASTSEIAQRAGVAEGTIFRHYKTKKDLLLSITVPVIDEFVGPFLLRDLETILTAQHERFEDFLRAVLFNRLQFAKKYAQVLRILAQEIPFHPELKAQLKQYVTENVLKRLVGIIEHFQEKGEIARIPARTVIRLTVSVILSHVVLRHILFHDAPWRDDDEIEMTVRFIVQGLRPDASRDQK

SEQ ID NO: 2423 - protein, 256 aa, Artificial
  Substituion in SEQ ID NO 2415
MTGGVPHPSVSHLRDGVAECFLDGNLSKGEYPMSERMDQWLTELVRLNEDDRVTDRQLNILRAAVEVFAEKGFAAASTSEIAQRAGVAEGTIFRHYKTKKDLLLSITVPVIDEFVGPFILRDLETILTAQHERFEDFLRAVLFNRLQFAKKYAQVLRILAQEIPFHPELKAQLKQYVTENVLKRLVGIIEHFQEKGEIARIPARTVIRLTVSVILSHVVLRHILFHDAPWRDDEEIEMTVRFIVQGLRPDASRDQK

SEQ ID NO: 2424 - protein, 256 aa, Artificial
  Substituion in SEQ ID NO 2415
MTGGVPHPSVSHLRDGVAECFLDGNLSKGEYPMSERMDQWLTELVRLNEDDRVTDRQLNILRAAVEVFAEKGFAAASTSEIAQRAGVAEGTIFRHYKTKKDLLLSITVPVIDEFVGPFLLRDLETILTAQHERFEDFLRAVLFNRLQFAKKYAQVLRILAQEIPFHPELKAQLKQYVTENVLKRLVGIIEHFQEKGEIARIPARTVIRLTVSVILSHVVLRHILFHDAPWRDDEEIEMTVRFIVQGLRPDASRDQR

SEQ ID NO: 2425 - protein, 256 aa, Artificial
  Substituion in SEQ ID NO 2415
MTGGVPHPSVSHLRDGVAECFLDGNLSKGEYPMSERMDQWLTELVRLNEDDRVTDRQLNILRAAVEVFAEKGFAAASTSEIAQRAGVAEGTIFRHYKTKKDLLLSITVPVIDEFVGPFLLRDLETILTAQHERFEDFLRAVLFNRLQFAKKYAQVLRILAQEIPFHPELKAQLKQYVTENVLKRLVGIIEHFQEKGEIARIPARTVIRLTVSVILSHIVLRHILFHDAPWRDDEEIEMTVRFIVQGLRPDASRDQK

SEQ ID NO: 2426 - protein, 256 aa, Artificial
  Substituion in SEQ ID NO 2415
MTGGVPHPSVSHLRDGIAECFLDGNLSKGEYPMSERMDQWLTELVRLNEDDRVTDRQLNILRAAVEVFAEKGFAAASTSEIAQRAGVAEGTIFRHYKTKKDLLLSITVPVIDEFVGPFLLRDLETILTAQHERFEDFLRAVLFNRLQFAKKYAQVLRILAQEIPFHPELKAQLKQYVTENVLKRLVGIIEHFQEKGEIARIPARTVIRLTVSVILSHVVLRHILFHDAPWRDDEEIEMTVRFIVQGLRPDASRDQK

SEQ ID NO: 2427 - DNA, 771 bp, Artificial
  Substituion in SEQ ID NO 2416
atgacgggcggagtaccccacccgtccgtctcccaccttcgagacggagtggcggagtgttttctggatggaaatttatcgaaaggtgaatatccaatgtccgagcgaatggaccagtggttgaccgagttggtgcgtctaaacgaggatgaccgcgtgaccgaccgacaattgaacatcttacgcgcggcggtggaagtgttcgcggagaagggttttgctgctgcgtccacgagcgagatcgcacagcgggcaggcgtggccgaaggcaccatcttcagacactataagacaaagaaggatttgcttctttccatcacggtaccggtgatcgatgaatttgtcggaccgttcttgctccgagatctcgagaccattcttactgcccaacacgaacggtttgaagactttctacgagccgtattgtttaaccgcttgcaatttgcaaagaaatatgctcaagttctgaggattttagctcaagaaataccttttcatcccgagttgaaggcgcaactcaagcaatatgtcaccgagaatgtgttgaagcgcctagtcgggattattgaacactttcaggaaaaaggggagattgcgcggattcccgcgcggactgtgatccggctaacggtgtcagtcatcctaagccatgtggtgttgcgtcacatcctgtttcacgatgcaccctggcgagatgatgatgaaattgagatgactgttcgtttcattgtgcagggtttaaggccggacgcgagcagagaccagaaataa

SEQ ID NO: 2428 - DNA, 771 bp, Artificial
  Substituion in SEQ ID NO 2416
atgacgggcggagtaccccacccgtccgtctcccaccttcgagacggagtggcggagtgttttctggatggaaatttatcgaaaggtgaatatccaatgtccgagcgaatggaccagtggttgaccgagttggtgcgtctaaacgaggatgaccgcgtgaccgaccgacaattgaacatcttacgcgcggcggtggaagtgttcgcggagaagggttttgctgctgcgtccacgagcgagatcgcacagcgggcaggcgtggccgaaggcaccatcttcagacactataagacaaagaaggatttgcttctttccatcacggtaccggtgatcgatgaatttgtcggaccgttcattctccgagatctcgagaccattcttactgcccaacacgaacggtttgaagactttctacgagccgtattgtttaaccgcttgcaatttgcaaagaaatatgctcaagttctgaggattttagctcaagaaataccttttcatcccgagttgaaggcgcaactcaagcaatatgtcaccgagaatgtgttgaagcgcctagtcgggattattgaacactttcaggaaaaaggggagattgcgcggattcccgcgcggactgtgatccggctaacggtgtcagtcatcctaagccatgtggtgttgcgtcacatcctgtttcacgatgcaccctggcgagatgatgaggaaattgagatgactgttcgtttcattgtgcagggtttaaggccggacgcgagcagagaccagaaataa

SEQ ID NO: 2429 - DNA, 771 bp, Artificial
  Substituion in SEQ ID NO 2416
atgacgggcggagtaccccacccgtccgtctcccaccttcgagacggagtggcggagtgttttctggatggaaatttatcgaaaggtgaatatccaatgtccgagcgaatggaccagtggttgaccgagttggtgcgtctaaacgaggatgaccgcgtgaccgaccgacaattgaacatcttacgcgcggcggtggaagtgttcgcggagaagggttttgctgctgcgtccacgagcgagatcgcacagcgggcaggcgtggccgaaggcaccatcttcagacactataagacaaagaaggatttgcttctttccatcacggtaccggtgatcgatgaatttgtcggaccgttcttgctccgagatctcgagaccattcttactgcccaacacgaacggtttgaagactttctacgagccgtattgtttaaccgcttgcaatttgcaaagaaatatgctcaagttctgaggattttagctcaagaaataccttttcatcccgagttgaaggcgcaactcaagcaatatgtcaccgagaatgtgttgaagcgcctagtcgggattattgaacactttcaggaaaaaggggagattgcgcggattcccgcgcggactgtgatccggctaacggtgtcagtcatcctaagccatgtggtgttgcgtcacatcctgtttcacgatgcaccctggcgagatgatgaggaaattgagatgactgttcgtttcattgtgcagggtttaaggccggacgcgagcagagaccagcgttaa

SEQ ID NO: 2430 - DNA, 771 bp, Artificial
  Substituion in SEQ ID NO 2416
atgacgggcggagtaccccacccgtccgtctcccaccttcgagacggagtggcggagtgttttctggatggaaatttatcgaaaggtgaatatccaatgtccgagcgaatggaccagtggttgaccgagttggtgcgtctaaacgaggatgaccgcgtgaccgaccgacaattgaacatcttacgcgcggcggtggaagtgttcgcggagaagggttttgctgctgcgtccacgagcgagatcgcacagcgggcaggcgtggccgaaggcaccatcttcagacactataagacaaagaaggatttgcttctttccatcacggtaccggtgatcgatgaatttgtcggaccgttcttgctccgagatctcgagaccattcttactgcccaacacgaacggtttgaagactttctacgagccgtattgtttaaccgcttgcaatttgcaaagaaatatgctcaagttctgaggattttagctcaagaaataccttttcatcccgagttgaaggcgcaactcaagcaatatgtcaccgagaatgtgttgaagcgcctagtcgggattattgaacactttcaggaaaaaggggagattgcgcggattcccgcgcggactgtgatccggctaacggtgtcagtcatcctaagccatattgtgttgcgtcacatcctgtttcacgatgcaccctggcgagatgatgaggaaattgagatgactgttcgtttcattgtgcagggtttaaggccggacgcgagcagagaccagaaataa

SEQ ID NO: 2431 - DNA, 771 bp, Artificial
  Substituion in SEQ ID NO 2416
atgacgggcggagtaccccacccgtccgtctcccaccttcgagacggaattgcggagtgttttctggatggaaatttatcgaaaggtgaatatccaatgtccgagcgaatggaccagtggttgaccgagttggtgcgtctaaacgaggatgaccgcgtgaccgaccgacaattgaacatcttacgcgcggcggtggaagtgttcgcggagaagggttttgctgctgcgtccacgagcgagatcgcacagcgggcaggcgtggccgaaggcaccatcttcagacactataagacaaagaaggatttgcttctttccatcacggtaccggtgatcgatgaatttgtcggaccgttcttgctccgagatctcgagaccattcttactgcccaacacgaacggtttgaagactttctacgagccgtattgtttaaccgcttgcaatttgcaaagaaatatgctcaagttctgaggattttagctcaagaaataccttttcatcccgagttgaaggcgcaactcaagcaatatgtcaccgagaatgtgttgaagcgcctagtcgggattattgaacactttcaggaaaaaggggagattgcgcggattcccgcgcggactgtgatccggctaacggtgtcagtcatcctaagccatgtggtgttgcgtcacatcctgtttcacgatgcaccctggcgagatgatgaggaaattgagatgactgttcgtttcattgtgcagggtttaaggccggacgcgagcagagaccagaaataa

SEQ ID NO: 2432-2516 - skipped (85 entries)

SEQ ID NO: 2517 - protein, 469 aa, Alicyclobacillus acidocaldarius
MHVYESRFWRWLGRMTSRLIRLGCAALAAAASLAVYQPAVRAERSTSPPVATESLIPREDVLNVQSGPIPYVVGEDASSWPSIVSQAAVVMDMDTGAVVYAKHSTAPHYPASITKIMTALLALRLGHLTDVLTASTDAVRQPPDKLYMRAGEKATLKDLLYGLLIDSANDAAVEIAERYGGSVAHFADMMNAEARALGATHTHFVNPSGLPDPRHVTTAYDMAVIARAAMQIPEFRTIVDTRSFDWKGTAWQATLTNLNRMLFTYPGAIGVKTGFTSVAHETLVVAATRGGTTFLAVLMDCPTDAEIRQDATNLLNYAFLHDETQRILPAGYRAGFVLARDGEDPVVTSEPVLATVPIGHPLDVIERVRVSAPLDRAPKGAAAGELDLVDAATGRKLGSVPLVLAAPFEPVPKPIPWPRLAAPAAAVILMAALVLGWRRRRRSRMAPRARVVRVQPWQESWQSARRGRR

SEQ ID NO: 2518 - DNA, 1410 bp, Alicyclobacillus acidocaldarius
gtgcatgtgtatgaaagccggttctggaggtggctcggtcgcatgacatctcgtctcatccgccttggatgcgccgcgctggctgcggccgcgtcgctggccgtgtaccagcccgcggtgcgagcggaacgctcgacgtcgcctccggttgcgaccgagtcgctgattcctcgcgaagacgtgttgaatgtccagtccggtcccattccctacgtcgtcggagaagacgcctcctcatggccttccatcgtgtcgcaggcggccgtggtgatggacatggacacgggcgccgtggtctacgccaaacactccaccgcgcctcactatcccgccagcatcacgaagatcatgacggccctcctcgccctgcggctcgggcatctgaccgacgtgctgacggcgtctaccgacgcggtccgccagccgccggacaagctgtacatgcgcgcaggcgagaaggcgacgctgaaggatctgctctatggcctgctgattgattccgccaacgatgccgcggtcgagatcgccgagcggtacggcggcagcgtggcccatttcgcggacatgatgaacgcggaagcgcgggccctcggggcgacccatacgcatttcgtgaaccccagcgggctgccggatccgcgccacgtcaccaccgcgtacgacatggccgtgatcgcgcgcgcggcgatgcagatcccggagtttcgcaccattgtcgacacgcgttcattcgattggaagggaacggcgtggcaagcaacgctcaccaacttaaaccgcatgctgttcacgtaccccggtgccatcggcgtcaagacgggatttacgagtgtagcgcatgagacgctcgtcgtggccgccacgcgcggtggcacgacgtttctggcggtgttgatggactgccccaccgatgcggaaatccgccaggatgccacgaacttgctgaattacgcgtttttgcacgatgagacccagcgcattctgcccgccgggtaccgggcgggctttgtcttggcgcgcgacggggaggatcccgtcgtcacgtcggagccggtcctcgcgacggtgcccatcggccacccgctggacgtgatcgagcgggtgcgtgtgagcgcgccgctcgatcgcgccccaaagggagccgcggcgggagagctggatcttgtcgacgccgccacgggaaggaagcttggttccgtgccgctggtcctggcggcgccgttcgagccggttccgaagcccattccgtggcctcggctcgccgcgccggccgccgcggtgatcttgatggcggcgctcgtccttggctggagacggcgaaggcgatcccgcatggcaccgcgggctcgcgtcgtgcgcgtccagccgtggcaggagtcctggcagagcgcgcggcggggccgcaggtag

SEQ ID NO: 2519 - protein, 335 aa, Moorella thermoacetica ATCC 39073
PDIQAESYVLMDFRTGQVLMAKNPHERRPQAITTKITTAILALERGNLNDQVIASKNAAETPESSIYLQEGETLTLEELLYALLLRSANDAAVAIAEHIGGSVENFARMMNAKVQEIGARDTHYVNPHGLTAPDHYSSAYDLALIGRYAMMNPKFREIVATRQRIIPWAGKPWPRLLINENRLLWGYYAYPGADGVKNGYTTPAGQVLVASATRDNWRLIAVVMKSPNMYRETSAILDYGFNNFHQVKLMPAGQQVALAGVRGGIAANIPAVTADDVLVVEPKNETWTWQQRVELNPDLNAPVKKGDRIGRIIFTSHDQEVSVDLIAAGDVAPRP

SEQ ID NO: 2520 - protein, 330 aa, Pelotomaculum thermopropionicum SI
ASSGPEIVGEAAVVIDIKNGQVLFEKNPDRRVYPASTTKIMTAVIALENGRLDAAVAVPGEACNIEGSSIGLQEGEKISLEDLLYALMLNSGNDTAVAIACHVGGSVEAFVSMMNKKAAELGAVNTHFNNPNGLPDPGHYSTAYDMALISRYAMQNPEFRKIVSTRVKTIRRSVPDAQVYLENHNRLLWLYEGATGVKTGYTVEAGQCLVSSAARQGRELLAVVMKSEGSNIWSDSTSLMDYCFKEFRPVCLVEAGAFVADVPVKFGEPAAVAVQTGSSFTYNFPADKPLEIKKEVLLEKEFCAPVRAGEKLGEMAFYDGERELGRVDLV

SEQ ID NO: 2521 - protein, 256 aa, Thermoanaerobacter sp. X514
AESYPSISAKAAIVMDQETGRVLYEKNPHEKLPMASTTKIMTLLVALEKGNLNDIVTVSKRAASVGGSSIWLSPGEKIDMESLLYGLMLNSGNDAATAIAEHIGGSVENFIEIMNQKAREIGAYNTHFVTPSGLDIGIDDHYTTAYDLALITRYAFRYPKFAEIVSTKEKTIPWEGKEWDRYLRNKNKLLWIYEGADGVKTGFTNKAGRCLVSSATRDGRRFIAVVLNSPPMWEDSMKILDYAFSKYKPYKVLEKG

SEQ ID NO: 2522 - protein, 278 aa, Carboxydothermus hydrogenoformans Z-2901
PQIIGRAAAVINVNSGKFVYLKNADQKMYPASTTKIMTTLIALEKGNLSDRVYIDKEACYVEGSAIWLNPGEQLSLEDLLYSIMLNSANDSAIAVAKYIGGDVATFVQEMNDKARELGAKNTHFVNPNGLPNDDHYTTARDLALIARAAMQNPKFREIAATKTKVINRDPKYLRFLQNHNKLLWRYEGANGIKTGYTVKARQCLVASAARDGEEFIAVVLGSEGRNVYDDATKLLDYAFNNFKTVKLVSKGQEFGKVEVAGGKEPVKLIAAEDLYDTV

SEQ ID NO: 2523 - protein, 256 aa, Thermoanaerobacter pseudethanolicus ATCC 33223
AESYPSISAKAAIVMDQETGRVLYEKNPHEKLPMASTTKIMTLLVALEKGNLNDIVTVSKRAASVGGSSIWLSPGEKIDMESLLYGLMLNSGNDAATAIAEHIGGSVENFIEIMNQKAREIGAYNTHFVTPSGLDIGIDDHYTTAYDLALITRYAFRYPKFAEIVSTKEKTIPWEGREWDRYLRNKNKLLWIYEGADGVKTGFTNKAGRCLVSSASREGRRFIAVVLNSPPMWEDSMKILDYAFSKYKPYKVLEKG

SEQ ID NO: 2524 - protein, 469 aa, Artificial
  Substituion in SEQ ID NO 2517
MHVYESRFWRWLGRMTSRLIRLGCAALAAAASLAVYQPAVRAERSTSPPVATESLIPREDVLNVQSGPIPYVVGEDASSWPSIVSQAAVVMDMDTGAVVYAKHSTAPHYPASITKIMTALLALRLGHLTDVLTASTDAVRQPPDKLYMRAGEKATLKDLLYGLLIDSANDAAVEIAERYGGSVAHFADMMNAEARALGATHTHFVNPSGLPDPRHVTTAYDMAVIARAAMQIPEFRTIVDTRSFDWKGTAWQATLTNLNRMLFTYPGAIGVKTGFTSVAHETLVVAATRGGTTFLAVLMDCPTDAEIRQDATNLLNYAFLHDETQRILPAGYRAGFVLARDGEDPVVTSDPVLATVPIGHPLDVIERVRVSAPLDRAPKGAAAGELDLVDAATGRKLGSVPLVLAAPFEPVPKPIPWPRLAAPAAAVILMAALVLGWRRRRRSRMAPRARVVRVQPWQESWQSARRGRR

SEQ ID NO: 2525 - protein, 469 aa, Artificial
  Substituion in SEQ ID NO 2517
MHVYESRFWRWLGRMTSRLIRLGCAALAAAASLAVYQPAVRAERSTSPPVATESLIPREDVLNVQSGPIPYVVGEDASSWPSIVSQAAVVMDMDTGAVVYAKHSTAPHYPASITKIMTALLALRLGHLTDVLTASTDAVRQPPDKLYMRAGEKATLKDLLYGLLIDSANDAAVEIAERYGGSVAHFADMMNAEARALGATHTHFVNPSGLPDPRHVTTAYDMAVIARAAMQIPEFRTIVDTRSFDWKGTAWQATLTNLNRMLFTYPGAIGVKTGFTSVAHETLVVAATRGGTTFLAVLMDCPTDAEIRQDATNLLNYAFLHDETQRILPAGYRAGFILARDGEDPVVTSEPVLATVPIGHPLDVIERVRVSAPLDRAPKGAAAGELDLVDAATGRKLGSVPLVLAAPFEPVPKPIPWPRLAAPAAAVILMAALVLGWRRRRRSRMAPRARVVRVQPWQESWQSARRGRR

SEQ ID NO: 2526 - protein, 469 aa, Artificial
  Substituion in SEQ ID NO 2517
MHVYESRFWRWLGRMTSRLIRLGCAALAAAASLAVYQPAVRAERSTSPPVATESLIPREDVLNVQSGPIPYVVGEDASSWPSIVSQAAVVMDMDTGAVVYAKHSTAPHYPASITKIMTALLALRLGHLTDVLTASTDAVRQPPDKLYMRAGEKATLKDLLYGLLIDSANDAAVEIAERYGGSVAHFADMMNAEARALGATHTHFVNPSGLPDPRHVTTAYDMAVIARAAMQIPEFRTIVDTRSFDWKGTAWQATLTNLNRMLFTYPGAIGVKTGFTSVAHETLVVAATRGGTTFLAVLMDCPTDAEIRQDATNLLNYAFLHDETQRILPAGYRAGFVIARDGEDPVVTSEPVLATVPIGHPLDVIERVRVSAPLDRAPKGAAAGELDLVDAATGRKLGSVPLVLAAPFEPVPKPIPWPRLAAPAAAVILMAALVLGWRRRRRSRMAPRARVVRVQPWQESWQSARRGRR

SEQ ID NO: 2527 - protein, 469 aa, Artificial
  Substituion in SEQ ID NO 2517
MHVYESRFWRWLGRMTSRLIRLGCAALAAAASLAVYQPAVRAERSTSPPVATESLIPREDVLNVQSGPIPYVVGEDASSWPSIVSQAAVVMDMDTGAVVYAKHSTAPHYPASITKIMTALLALRLGHLTDVLTASTDAVRQPPDKLYMRAGEKATLKDLLYGLLIDSANDAAVEIAERYGGSVAHFADMMNAEARALGATHTHFVNPSGLPDPRHVTTAYDMAVIARAAMQIPEFRTIVDTRSFDWKGTAWQATLTNLNRMLFTYPGAIGVKTGFTSVAHETLVVAATRGGTTFLAVLMDCPTDAEIRQDATNLLNYAFLHDETQRILPAGYRAGFVLARDGEDPVVTSEPVLATVPLGHPLDVIERVRVSAPLDRAPKGAAAGELDLVDAATGRKLGSVPLVLAAPFEPVPKPIPWPRLAAPAAAVILMAALVLGWRRRRRSRMAPRARVVRVQPWQESWQSARRGRR

SEQ ID NO: 2528 - protein, 469 aa, Artificial
  Substituion in SEQ ID NO 2517
MHVYESRFWRWLGRMTSRLIRLGCAALAAAASLAVYQPAVRAERSTSPPVATESLIPREDVLNVQSGPIPYVVGEDASSWPSIVSQAAVVMDMDTGAVVYAKHSTAPHYPASITKIMTALLALRLGHLTDVLTASTDAVRQPPDKLYMRAGEKATLKDLLYGLLIDSANDAAVEIAERYGGSVAHFADMMNAEARALGATHTHFVNPSGLPDPRHVTTAYDMAVIARAAMQIPEFRTIVDTRSFDWKGTAWQATLTNLNRMLFTYPGAIGVKTGFTSVAHETLVVAATRGGTTFLAVLMDCPTDAEIRQDATNLLNYAFLHDETQRILPAGYRAGFVLARDGEDPVVTSEPVLATVPIGHPLDVIERVRVSAPLDRAPKGAAAGELELVDAATGRKLGSVPLVLAAPFEPVPKPIPWPRLAAPAAAVILMAALVLGWRRRRRSRMAPRARVVRVQPWQESWQSARRGRR

SEQ ID NO: 2529 - DNA, 1410 bp, Artificial
  Substituion in SEQ ID NO 2518
gtgcatgtgtatgaaagccggttctggaggtggctcggtcgcatgacatctcgtctcatccgccttggatgcgccgcgctggctgcggccgcgtcgctggccgtgtaccagcccgcggtgcgagcggaacgctcgacgtcgcctccggttgcgaccgagtcgctgattcctcgcgaagacgtgttgaatgtccagtccggtcccattccctacgtcgtcggagaagacgcctcctcatggccttccatcgtgtcgcaggcggccgtggtgatggacatggacacgggcgccgtggtctacgccaaacactccaccgcgcctcactatcccgccagcatcacgaagatcatgacggccctcctcgccctgcggctcgggcatctgaccgacgtgctgacggcgtctaccgacgcggtccgccagccgccggacaagctgtacatgcgcgcaggcgagaaggcgacgctgaaggatctgctctatggcctgctgattgattccgccaacgatgccgcggtcgagatcgccgagcggtacggcggcagcgtggcccatttcgcggacatgatgaacgcggaagcgcgggccctcggggcgacccatacgcatttcgtgaaccccagcgggctgccggatccgcgccacgtcaccaccgcgtacgacatggccgtgatcgcgcgcgcggcgatgcagatcccggagtttcgcaccattgtcgacacgcgttcattcgattggaagggaacggcgtggcaagcaacgctcaccaacttaaaccgcatgctgttcacgtaccccggtgccatcggcgtcaagacgggatttacgagtgtagcgcatgagacgctcgtcgtggccgccacgcgcggtggcacgacgtttctggcggtgttgatggactgccccaccgatgcggaaatccgccaggatgccacgaacttgctgaattacgcgtttttgcacgatgagacccagcgcattctgcccgccgggtaccgggcgggctttgtcttggcgcgcgacggggaggatcccgtcgtcacgtcggatccggtcctcgcgacggtgcccatcggccacccgctggacgtgatcgagcgggtgcgtgtgagcgcgccgctcgatcgcgccccaaagggagccgcggcgggagagctggatcttgtcgacgccgccacgggaaggaagcttggttccgtgccgctggtcctggcggcgccgttcgagccggttccgaagcccattccgtggcctcggctcgccgcgccggccgccgcggtgatcttgatggcggcgctcgtccttggctggagacggcgaaggcgatcccgcatggcaccgcgggctcgcgtcgtgcgcgtccagccgtggcaggagtcctggcagagcgcgcggcggggccgcaggtag

SEQ ID NO: 2530 - DNA, 1410 bp, Artificial
  Substituion in SEQ ID NO 2518
gtgcatgtgtatgaaagccggttctggaggtggctcggtcgcatgacatctcgtctcatccgccttggatgcgccgcgctggctgcggccgcgtcgctggccgtgtaccagcccgcggtgcgagcggaacgctcgacgtcgcctccggttgcgaccgagtcgctgattcctcgcgaagacgtgttgaatgtccagtccggtcccattccctacgtcgtcggagaagacgcctcctcatggccttccatcgtgtcgcaggcggccgtggtgatggacatggacacgggcgccgtggtctacgccaaacactccaccgcgcctcactatcccgccagcatcacgaagatcatgacggccctcctcgccctgcggctcgggcatctgaccgacgtgctgacggcgtctaccgacgcggtccgccagccgccggacaagctgtacatgcgcgcaggcgagaaggcgacgctgaaggatctgctctatggcctgctgattgattccgccaacgatgccgcggtcgagatcgccgagcggtacggcggcagcgtggcccatttcgcggacatgatgaacgcggaagcgcgggccctcggggcgacccatacgcatttcgtgaaccccagcgggctgccggatccgcgccacgtcaccaccgcgtacgacatggccgtgatcgcgcgcgcggcgatgcagatcccggagtttcgcaccattgtcgacacgcgttcattcgattggaagggaacggcgtggcaagcaacgctcaccaacttaaaccgcatgctgttcacgtaccccggtgccatcggcgtcaagacgggatttacgagtgtagcgcatgagacgctcgtcgtggccgccacgcgcggtggcacgacgtttctggcggtgttgatggactgccccaccgatgcggaaatccgccaggatgccacgaacttgctgaattacgcgtttttgcacgatgagacccagcgcattctgcccgccgggtaccgggcgggctttattttggcgcgcgacggggaggatcccgtcgtcacgtcggagccggtcctcgcgacggtgcccatcggccacccgctggacgtgatcgagcgggtgcgtgtgagcgcgccgctcgatcgcgccccaaagggagccgcggcgggagagctggatcttgtcgacgccgccacgggaaggaagcttggttccgtgccgctggtcctggcggcgccgttcgagccggttccgaagcccattccgtggcctcggctcgccgcgccggccgccgcggtgatcttgatggcggcgctcgtccttggctggagacggcgaaggcgatcccgcatggcaccgcgggctcgcgtcgtgcgcgtccagccgtggcaggagtcctggcagagcgcgcggcggggccgcaggtag

SEQ ID NO: 2531 - DNA, 1410 bp, Artificial
  Substituion in SEQ ID NO 2518
gtgcatgtgtatgaaagccggttctggaggtggctcggtcgcatgacatctcgtctcatccgccttggatgcgccgcgctggctgcggccgcgtcgctggccgtgtaccagcccgcggtgcgagcggaacgctcgacgtcgcctccggttgcgaccgagtcgctgattcctcgcgaagacgtgttgaatgtccagtccggtcccattccctacgtcgtcggagaagacgcctcctcatggccttccatcgtgtcgcaggcggccgtggtgatggacatggacacgggcgccgtggtctacgccaaacactccaccgcgcctcactatcccgccagcatcacgaagatcatgacggccctcctcgccctgcggctcgggcatctgaccgacgtgctgacggcgtctaccgacgcggtccgccagccgccggacaagctgtacatgcgcgcaggcgagaaggcgacgctgaaggatctgctctatggcctgctgattgattccgccaacgatgccgcggtcgagatcgccgagcggtacggcggcagcgtggcccatttcgcggacatgatgaacgcggaagcgcgggccctcggggcgacccatacgcatttcgtgaaccccagcgggctgccggatccgcgccacgtcaccaccgcgtacgacatggccgtgatcgcgcgcgcggcgatgcagatcccggagtttcgcaccattgtcgacacgcgttcattcgattggaagggaacggcgtggcaagcaacgctcaccaacttaaaccgcatgctgttcacgtaccccggtgccatcggcgtcaagacgggatttacgagtgtagcgcatgagacgctcgtcgtggccgccacgcgcggtggcacgacgtttctggcggtgttgatggactgccccaccgatgcggaaatccgccaggatgccacgaacttgctgaattacgcgtttttgcacgatgagacccagcgcattctgcccgccgggtaccgggcgggctttgtcattgcgcgcgacggggaggatcccgtcgtcacgtcggagccggtcctcgcgacggtgcccatcggccacccgctggacgtgatcgagcgggtgcgtgtgagcgcgccgctcgatcgcgccccaaagggagccgcggcgggagagctggatcttgtcgacgccgccacgggaaggaagcttggttccgtgccgctggtcctggcggcgccgttcgagccggttccgaagcccattccgtggcctcggctcgccgcgccggccgccgcggtgatcttgatggcggcgctcgtccttggctggagacggcgaaggcgatcccgcatggcaccgcgggctcgcgtcgtgcgcgtccagccgtggcaggagtcctggcagagcgcgcggcggggccgcaggtag

SEQ ID NO: 2532 - DNA, 1410 bp, Artificial
  Substituion in SEQ ID NO 2518
gtgcatgtgtatgaaagccggttctggaggtggctcggtcgcatgacatctcgtctcatccgccttggatgcgccgcgctggctgcggccgcgtcgctggccgtgtaccagcccgcggtgcgagcggaacgctcgacgtcgcctccggttgcgaccgagtcgctgattcctcgcgaagacgtgttgaatgtccagtccggtcccattccctacgtcgtcggagaagacgcctcctcatggccttccatcgtgtcgcaggcggccgtggtgatggacatggacacgggcgccgtggtctacgccaaacactccaccgcgcctcactatcccgccagcatcacgaagatcatgacggccctcctcgccctgcggctcgggcatctgaccgacgtgctgacggcgtctaccgacgcggtccgccagccgccggacaagctgtacatgcgcgcaggcgagaaggcgacgctgaaggatctgctctatggcctgctgattgattccgccaacgatgccgcggtcgagatcgccgagcggtacggcggcagcgtggcccatttcgcggacatgatgaacgcggaagcgcgggccctcggggcgacccatacgcatttcgtgaaccccagcgggctgccggatccgcgccacgtcaccaccgcgtacgacatggccgtgatcgcgcgcgcggcgatgcagatcccggagtttcgcaccattgtcgacacgcgttcattcgattggaagggaacggcgtggcaagcaacgctcaccaacttaaaccgcatgctgttcacgtaccccggtgccatcggcgtcaagacgggatttacgagtgtagcgcatgagacgctcgtcgtggccgccacgcgcggtggcacgacgtttctggcggtgttgatggactgccccaccgatgcggaaatccgccaggatgccacgaacttgctgaattacgcgtttttgcacgatgagacccagcgcattctgcccgccgggtaccgggcgggctttgtcttggcgcgcgacggggaggatcccgtcgtcacgtcggagccggtcctcgcgacggtgcccttaggccacccgctggacgtgatcgagcgggtgcgtgtgagcgcgccgctcgatcgcgccccaaagggagccgcggcgggagagctggatcttgtcgacgccgccacgggaaggaagcttggttccgtgccgctggtcctggcggcgccgttcgagccggttccgaagcccattccgtggcctcggctcgccgcgccggccgccgcggtgatcttgatggcggcgctcgtccttggctggagacggcgaaggcgatcccgcatggcaccgcgggctcgcgtcgtgcgcgtccagccgtggcaggagtcctggcagagcgcgcggcggggccgcaggtag

SEQ ID NO: 2533 - DNA, 1410 bp, Artificial
  Substituion in SEQ ID NO 2518
gtgcatgtgtatgaaagccggttctggaggtggctcggtcgcatgacatctcgtctcatccgccttggatgcgccgcgctggctgcggccgcgtcgctggccgtgtaccagcccgcggtgcgagcggaacgctcgacgtcgcctccggttgcgaccgagtcgctgattcctcgcgaagacgtgttgaatgtccagtccggtcccattccctacgtcgtcggagaagacgcctcctcatggccttccatcgtgtcgcaggcggccgtggtgatggacatggacacgggcgccgtggtctacgccaaacactccaccgcgcctcactatcccgccagcatcacgaagatcatgacggccctcctcgccctgcggctcgggcatctgaccgacgtgctgacggcgtctaccgacgcggtccgccagccgccggacaagctgtacatgcgcgcaggcgagaaggcgacgctgaaggatctgctctatggcctgctgattgattccgccaacgatgccgcggtcgagatcgccgagcggtacggcggcagcgtggcccatttcgcggacatgatgaacgcggaagcgcgggccctcggggcgacccatacgcatttcgtgaaccccagcgggctgccggatccgcgccacgtcaccaccgcgtacgacatggccgtgatcgcgcgcgcggcgatgcagatcccggagtttcgcaccattgtcgacacgcgttcattcgattggaagggaacggcgtggcaagcaacgctcaccaacttaaaccgcatgctgttcacgtaccccggtgccatcggcgtcaagacgggatttacgagtgtagcgcatgagacgctcgtcgtggccgccacgcgcggtggcacgacgtttctggcggtgttgatggactgccccaccgatgcggaaatccgccaggatgccacgaacttgctgaattacgcgtttttgcacgatgagacccagcgcattctgcccgccgggtaccgggcgggctttgtcttggcgcgcgacggggaggatcccgtcgtcacgtcggagccggtcctcgcgacggtgcccatcggccacccgctggacgtgatcgagcgggtgcgtgtgagcgcgccgctcgatcgcgccccaaagggagccgcggcgggagagctggaacttgtcgacgccgccacgggaaggaagcttggttccgtgccgctggtcctggcggcgccgttcgagccggttccgaagcccattccgtggcctcggctcgccgcgccggccgccgcggtgatcttgatggcggcgctcgtccttggctggagacggcgaaggcgatcccgcatggcaccgcgggctcgcgtcgtgcgcgtccagccgtggcaggagtcctggcagagcgcgcggcggggccgcaggtag

SEQ ID NO: 2534 - protein, 119 aa, Alicyclobacillus acidocaldarius
MANILVVDDAAFMRMMIKDILTKNGHVVVGEAADGAQAVERYQELRPDLVTMDITMPEVDGIEAIKRIRQIDPNARIIVCSAMGQQAMVIEAIQAGAKDFIVKPFQADRVVEAVQKALR

SEQ ID NO: 2535 - DNA, 360 bp, Alicyclobacillus acidocaldarius
atggcaaacattctggtggtggacgacgccgccttcatgcggatgatgatcaaagacatcctgaccaaaaacgggcacgtcgtggtgggggaagcggcagacggggcgcaggccgtcgagcgctatcaagagcttcgccccgatctcgtcacgatggatatcaccatgccggaggtggacgggatcgaagccatcaagcgcatccggcaaatcgacccgaacgcgcgcatcatcgtgtgctccgcgatgggacagcaggcgatggtgatcgaggccattcaggcgggggccaaggattttatcgtcaagccgtttcaggccgatcgcgtcgtcgaagcggtgcagaaggcgctcaggtga

SEQ ID NO: 2536 - protein, 118 aa, Geobacillus thermodenitrificans NG80-2
MARILVVDDAAFMRMMIKDILTKNGHEVVAEAADGRQAIEKYKETRPDIVTMDITMPEMDGITALKEIKKIDSNAKVIMCSAMGQQAMVIDAIQAGAKDFVVKPFQADRVIEAINKTL

SEQ ID NO: 2537 - protein, 115 aa, Bacillus coagulans 36D1
ILIVDDAAFMRMMIKDILTKNGYDVVAEAGDGAQAIEKYKEHRPDLVTMDITMPEVDGISALKEIKKIDPDAKVIMCSAMGQQAMVIDAIQAGAKDFIVKPFQADRVIEAIQKTL

SEQ ID NO: 2538 - protein, 119 aa, Fervidobacterium nodosum Rt17-B1
MAKVLVVDDAAFMRMMLKDILTKAGHEVVGEAANGVEAVEKYKELKPDVVTMDITMPEMNGIDAIKEIKKFDPNATVIVCSAMGQQAMVIEAIQAGAKDFIVKPFQAARVIEAIQKVLK

SEQ ID NO: 2539 - protein, 119 aa, Bacillus sp. SG-1
MANKILIVDDAAFMRMMIKDILTKNGFEVVGEAADGNQAVEKYKELSPDLVTMDITMPEKDGIAALKEIKSLDANAKIIMCSAMGQQAMVIDAIQAGAKDFIVKPFQADRVIEAIQKAL

SEQ ID NO: 2540 - protein, 117 aa, Bacillus halodurans C-125
ARILIVDDASFMRMMIKDILTKNGYDVVGEAHDGEQAVEKYKELSPDLVTMDITMPEKDGIAALKDIRAIDPNAKVIMCSAMGQQAMVIDAIQAGAKDFIVKPFQADRVIDAIQKTL

SEQ ID NO: 2541 - protein, 119 aa, Artificial
  Substituion in SEQ ID NO 2534
MANILVVDDAAFMRMMIKDILTKQGHVVVGEAADGAQAVERYQELRPDLVTMDITMPEVDGIEAIKRIRQIDPNARIIVCSAMGQQAMVIEAIQAGAKDFIVKPFQADRVVEAVQKALR

SEQ ID NO: 2542 - protein, 119 aa, Artificial
  Substituion in SEQ ID NO 2534
MANILVVDDAAFMRMMIKDILTKNGHVVVGEAADGAQAVERYQELRPDLVTMDITMPEVDGIEAIKRIKQIDPNARIIVCSAMGQQAMVIEAIQAGAKDFIVKPFQADRVVEAVQKALR

SEQ ID NO: 2543 - protein, 119 aa, Artificial
  Substituion in SEQ ID NO 2534
MANILVVDDAAFMRMMIKDILTKNGHVVVGEAADGAQAVERYQELRPDLVTMDITMPEVDGIEAIKRIRQIDPNARIIVCSAMGQQAMVIEAIQAGAKDFLVKPFQADRVVEAVQKALR

SEQ ID NO: 2544 - protein, 119 aa, Artificial
  Substituion in SEQ ID NO 2534
MANILVVDDAAFMRMMIKDILTKNGHVVVGEAADGAQAVERYQELRPDLVTMDITMPEVDGIEAIKRIRQIDPNARIIVCSAMGQQAMVIEAIQAGAKDFIVKPFQADRVVEAIQKALR

SEQ ID NO: 2545 - protein, 119 aa, Artificial
  Substituion in SEQ ID NO 2534
MANILVVDDAAFMRMMIKDILTKNGHVVVGEAADGAQAVERYQELRPDLVTMDITMPEVDGIEAIKRIRQIDPNARIIICSAMGQQAMVIEAIQAGAKDFIVKPFQADRVVEAVQKALR

SEQ ID NO: 2546 - DNA, 360 bp, Artificial
  Substituion in SEQ ID NO 2535
atggcaaacattctggtggtggacgacgccgccttcatgcggatgatgatcaaagacatcctgaccaaacaagggcacgtcgtggtgggggaagcggcagacggggcgcaggccgtcgagcgctatcaagagcttcgccccgatctcgtcacgatggatatcaccatgccggaggtggacgggatcgaagccatcaagcgcatccggcaaatcgacccgaacgcgcgcatcatcgtgtgctccgcgatgggacagcaggcgatggtgatcgaggccattcaggcgggggccaaggattttatcgtcaagccgtttcaggccgatcgcgtcgtcgaagcggtgcagaaggcgctcaggtga

SEQ ID NO: 2547 - DNA, 360 bp, Artificial
  Substituion in SEQ ID NO 2535
atggcaaacattctggtggtggacgacgccgccttcatgcggatgatgatcaaagacatcctgaccaaaaacgggcacgtcgtggtgggggaagcggcagacggggcgcaggccgtcgagcgctatcaagagcttcgccccgatctcgtcacgatggatatcaccatgccggaggtggacgggatcgaagccatcaagcgcatcaaacaaatcgacccgaacgcgcgcatcatcgtgtgctccgcgatgggacagcaggcgatggtgatcgaggccattcaggcgggggccaaggattttatcgtcaagccgtttcaggccgatcgcgtcgtcgaagcggtgcagaaggcgctcaggtga

SEQ ID NO: 2548 - DNA, 360 bp, Artificial
  Substituion in SEQ ID NO 2535
atggcaaacattctggtggtggacgacgccgccttcatgcggatgatgatcaaagacatcctgaccaaaaacgggcacgtcgtggtgggggaagcggcagacggggcgcaggccgtcgagcgctatcaagagcttcgccccgatctcgtcacgatggatatcaccatgccggaggtggacgggatcgaagccatcaagcgcatccggcaaatcgacccgaacgcgcgcatcatcgtgtgctccgcgatgggacagcaggcgatggtgatcgaggccattcaggcgggggccaaggattttttagtcaagccgtttcaggccgatcgcgtcgtcgaagcggtgcagaaggcgctcaggtga

SEQ ID NO: 2549 - DNA, 360 bp, Artificial
  Substituion in SEQ ID NO 2535
atggcaaacattctggtggtggacgacgccgccttcatgcggatgatgatcaaagacatcctgaccaaaaacgggcacgtcgtggtgggggaagcggcagacggggcgcaggccgtcgagcgctatcaagagcttcgccccgatctcgtcacgatggatatcaccatgccggaggtggacgggatcgaagccatcaagcgcatccggcaaatcgacccgaacgcgcgcatcatcgtgtgctccgcgatgggacagcaggcgatggtgatcgaggccattcaggcgggggccaaggattttatcgtcaagccgtttcaggccgatcgcgtcgtcgaagcgattcagaaggcgctcaggtga

SEQ ID NO: 2550 - DNA, 360 bp, Artificial
  Substituion in SEQ ID NO 2535
atggcaaacattctggtggtggacgacgccgccttcatgcggatgatgatcaaagacatcctgaccaaaaacgggcacgtcgtggtgggggaagcggcagacggggcgcaggccgtcgagcgctatcaagagcttcgccccgatctcgtcacgatggatatcaccatgccggaggtggacgggatcgaagccatcaagcgcatccggcaaatcgacccgaacgcgcgcatcatcatttgctccgcgatgggacagcaggcgatggtgatcgaggccattcaggcgggggccaaggattttatcgtcaagccgtttcaggccgatcgcgtcgtcgaagcggtgcagaaggcgctcaggtga

SEQ ID NO: 2551 - protein, 664 aa, Alicyclobacillus acidocaldarius
MHDEYLEAFLAESMENVERLEAFCLTLEREGSKPDLLDEMFRAAHTLKGMSATMGFSKLAALTHRVEDLLGTLRDERVRLEPRHVDALLLAVDRMRARIQAIGVSAKEPDEPDDDAMDALAGALRGGADVGGTREEDSKPFANLSDWANRAAAEGKELYTVHIRLAPDCVMPGVRLAMAYQALKASAILMAAHPAEENVMAGQVEATEAFAAVMVAPGEIDRVRQGVLDVTDVSSCEVSKVSESHSAPKEDAPRAEQGDAPIEPRVSRHANGSSPAGADLRRDATLRVPVRKVDALMNTLSDLVITKTRLATLVSSADDPALKEAVERLDRLTGDIQDGLMRLRMVPVETIFHRYPRMMRDLEHRLQREFDFVMTGLDTEMDRVVLEEMGEVIVHLLRNAVDHGLEPPEARESQGKPRRGIVRLAAYTASGHVYLEVSDDGRGIDRGRVLETAVAKGWITPEEGAAMSDESVYALLFRPGFSTAERVSDISGRGVGLDAVREKVEALGGQIRLNSVLGAGTTFTIELPLTLAILSALLVSVRGQVFAIPTANVDEVRRVTRDDVRHVQERPVFQDSAGIVPIVDLAERLGLGSRRDAYPQTAVVCRDGKRRLALVVDHVLDELEIVNKPLGRYLQGVREFAGATILGDGRVSLILDVRSIANPA

SEQ ID NO: 2552 - DNA, 1995 bp, Alicyclobacillus acidocaldarius
gtgcacgacgaatacctggaggcctttttggccgagtcgatggaaaacgtcgaacgcctggaggcgttttgcctcacgctcgagcgagaagggtcgaagcccgacctgctggacgagatgtttcgggccgcgcataccctgaaaggcatgagcgccacgatggggttctccaagttggcggccttgacgcaccgcgtggaggacctgttgggaacgctgcgggacgaacgcgtccgattggagccgcggcacgtggatgcgcttctgctcgcggtggatcggatgcgagcgaggatccaggccatcggggtctctgccaaggaacctgacgagccggatgacgacgcgatggacgcgctcgcgggcgcgcttcgaggaggcgcggacgttggagggacgcgcgaggaggattcgaagccttttgcgaatctttcggattgggcaaaccgcgccgcggcagagggaaaggagctgtacaccgtccatattcgcctcgctcccgactgcgtcatgcccggcgtgcggctcgccatggcgtaccaagctttgaaagcctcggcgattttgatggcggcccatcctgcggaagagaacgtcatggccggacaggtcgaggcgacggaggctttcgcggccgtcatggtggcgcctggcgagatcgaccgcgttcgacagggcgtgctcgacgtcaccgatgtgtcgtcttgcgaagtgtccaaggtgagcgagtcccattcggctcccaaggaggatgcgccgcgcgcggagcagggcgacgcgcccatcgagccccgggtctcgcgccacgcgaacggctcctcccccgctggcgccgacctgcggagggacgcgacgcttcgcgtcccggtccggaaggtggatgcgctcatgaacaccttgagcgatctcgtcatcaccaagacgcgcctcgccaccctggtgtcgtccgccgacgatccggccttgaaggaggcggtcgagcggttggaccgcctgacgggcgacattcaagatggattgatgcggctcaggatggtgccggtggaaaccatcttccatcgatacccacgcatgatgcgcgatctggaacaccgcctccagcgcgagtttgacttcgtgatgacgggcctggacaccgaaatggatcgagtcgttctcgaggagatgggcgaggtcatcgtgcaccttctgcgcaacgcggtcgatcacggcctcgagccgccggaggcgcgcgagtcccaaggcaaacctcggcgcggcatcgtccgtctcgctgcgtacacggccagcggccacgtgtatctcgaggtgtcagatgacggccggggaattgaccgcggtcgcgtcctcgaaacggctgtggccaaagggtggatcacgccagaggaaggcgccgcaatgtcggatgagtccgtgtacgcgcttctgtttcgccctgggttcagcaccgcggagcgcgtctcggacatctccgggcgaggcgtggggctggacgccgtgcgcgaaaaagtcgaggccttgggagggcagattcgcctgaattcggttctcggggcgggcacgacgttcaccatcgagttgccgctgaccctcgccatcctgtcggccctgttggtgtccgttcgcgggcaggtgtttgccatccccacggcgaatgtggatgaggtgcgcagagtgacacgggatgacgttcgtcacgtccaggagcgacccgtctttcaagacagcgcgggaatcgtgcccatcgtggatttggcggagcgattgggattgggctctcgtcgcgatgcgtatccacagaccgcggtcgtgtgccgcgatgggaagcgcaggctcgcgctcgtcgtcgatcacgtcctggatgagctcgagatcgtgaataagccgctcggccgatacctgcagggagttcgggagttcgctggcgccaccattctcggcgatggccgggtgtcgctcattctcgatgtgcgctccatcgcaaatcccgcgtag

SEQ ID NO: 2553 - protein, 660 aa, Geobacillus kaustophilus HTA426
QYLDLFIDESKEHLQAINERLLELEKTPEDMSVVNDIFRSAHTLKGMSATMGFEDLANLTHQMENVLDGIRNRRLSVTPELLDVIFEAVDHLEAMISSIAAGGDGTRDVRRTVEQLKRIEQGEMPNKQAAREEPPLEHAYGEFEYHVLEQAKEQGFSVYEIRVRLRDDCLLKAARVYMVFEQLNEVGEIVKATPPVEMLEEEQFDREFLVTVVSKAPADELQKRLMGISEIDDVKVSMLSSNEPSAESEKAAAPQQPAAMEQAAAVQAEAEAPEKQTAKQATKTIRVNIERLDRLMNLFEELVVDRGRLEQISRELNHAELTETVERMSRISSDLQTIILNMRMVPVETVFNRFPRMVRQLARELGKKVRLDIIGADTELDRTVIDEIGDPLVHLIRNALDHGIEAPDVRVARGKPEEGTVQLRAYHSGNHVFIEIEDDGAGISREKVLQKAKSRGIVSPQAAEHLNDQQIYELIFAPGFSTAEQVSDISGRGVGLDVVKSTIESLGGTVSVDSQPGKGSLFSIQLPLTLSIISVLLVQIAEETYAIPLSSIIETALVKKEEIFSAHNQPVIDFRGKIVPLVRLKDVFAVPGVADDGDAVAVVIVRKGEKLAALAVDSFIGQQEVVLKSLGNYLSSVFAISGATILGDGRVALIIDCNAL

SEQ ID NO: 2554 - protein, 670 aa, Bacillus sp. NRRL B-14911
QYLEVFIEESREHLQAINEHLLELEKNPADLKIINEIFRSAHTLKGMSATMGYEDLARLTHQMENVLDAIRNQKIGVTPELLDTVFLAVDDLEAMVLSISEGGDGKRDVSTAVKQLELIENGQTPLMESRQEAAAAAAAEAEVPAELRSDYDEFERTVLSQSKEQGFDVFEISISLREDCLLKAARVFMVFEVLEKSGEIIKSNPPVDVLEEEQFDSAFTVTLVTKEPKEEIQAKIMKVSEIEKAEIINIDLMPASPAEEEPAPAPGIIQPVEEPKEESRNGAPAKQASSKTIRVNIERLDILMNLFEELVIDRGRLEQISKELNNQELHETVERMSRISGDLQNIILNMRMVPVETVFNRFPRMVRQLARDLNKKINLEIVGAETELDRTVIDEIGDPLVHLIRNALDHGVETPEVRKANGKNEEGTVVLKAYHSGNHVFIELIDDGAGINRDKVLQKAVKNGIITEQAGASLTDKQVYELIFASGFSTADKISDVSGRGVGLDVVKSTIESLGGTVTIDSQEGKGSTFSIQLPLTLSIISVMLIEVQKEKYAIPLSSIIETAIIKKEDIMNAHNQKVIDFRGKVVPLLFLKDVFAVPVHLEEDGYYSVVIVRKGDKMAGLVVDSFIGQQEIVLKSLGGYLNDIFAISGATILGDGQVALIVDCNALIN

SEQ ID NO: 2555 - protein, 662 aa, Geobacillus thermodenitrificans NG80-2
QYLDIFIDESKEHLQTINERLLELEQTPGDMALVNEIFRSAHTLKGMSATMGFEDLANLTHQLENVLDGIRNQRLIVTPELLDVVFQAVDHLEAMIISIASGGDGKRDVGETVEQLKRIEQGEMPNKPTAGEQLPLEHTYGEFEYHVLQQAKDQGFSIYEIRVRLRKDCMLKAARVYMVFEQLNEAGEIVKSTPPADMLEEEKFDQEFLVTVVSKTPADELRMRLMSISEIDEVEIAAVTVDEPSAKSGEQDDLEPPVSTAIGQVAATQTKAEAAEKLAAKQAGKTIRVNIERLDMLMNLFEELVVDRGRLEQISRDLNHPELTETVERMSRISSDLQTIILNMRMVPVETVFNRFPRMVRQLARELGKKVRLDVIGAETELDRTVIDEIGDPLVHLIRNALDHGIEAPDIRVACGKPEEGTVKLRAYHSGNHVFIEIEDDGAGISREKVLQKAIDRGIVSAEEAAHLTDQQVYGLIFSPGFSTADRISDISGRGVGLDVVKSTIQSLGGTVTVDSQPGKGSLFSIQLPLTLSIISVLLVQIAAETYAIPLSSIMETALVKKEDIFSAHNQPVIDFRGKVVPLVRLKDVFSVPNASDEGDAVAAVIVRKGEKLAALAVDSFIGQQEVVLKSLGNYLSSVFAISGATILGDGRVALIIDCNAL

SEQ ID NO: 2556 - protein, 671 aa, Bacillus pumilus SAFR-032
NQYLDIFLDESREHLQTCNEKLLDLEKNPTDLQLVNDIFRAAHTLKGMSATMGYADMAQLTHHLENMFDAIRNEQMIVTPESMDTMFEALDHLEAMVQSIAEGGDGKRDVTEISKKLDVTGSHAEAAPSVETADVSAASANDLDYNEFERTVLDEAREQGFKCYELNVTLSDACLLKAVRVYMIFERLNEAGEVVKTVPNAELLESEDFESEFSISYLSKQPMDEVKKIVMTISEVEQVEISEVSAFEEASPAEKQEAKPEQEKEEVSVPAAKAPANDAPKANGNNVAAAGGTKTIRVNIDRLDSLMNLFEELVIDRGRLEQIAKELENNELTDTVERMTRISGDLQSIILNMRMVPVETVFNRFPRMIRQLTKELNKKIELIIEGAETELDRTVIDEIGDPLLHLLRNSLDHGIESPEERVKKGKPEKGTVLLKAYHSGNHVFIEVEDDGGGINRKKVLEKALERGVITDREAETLEDHQIDSLIFAAGFSTADTISDISGRGVGLDVVKNKLESLGGSVSINSTEGQGSLFSIQLPLTLSIISVLLVKLEEETFAIPISSIIETAVIKKSDILQTHDREVIDFRGFIVPVVYLKKQFHVPNANELEEELHIIVVRKGDKLTAFVVDSFIGQQEVVLKSLGDYLPNVFAISGATILGDGQVALIVDCNAL

SEQ ID NO: 2557 - protein, 686 aa, Bacillus sp. SG-1
NQYLEVFIEESKEHLQTCNEQLLELEKNPENLAIVNEIFRSAHTLKGMAATMGYEDLASLTHQMENVLDAIRNSKIQVSSLILDVVFMAVDDLEAMVMSIAEGGDGKRDVTEIVKKLALIEKGESLDNLQAQSEAAAAVLEAEPSNTHTAQYDQFERTVIEQSKEQGFQCFEISVSLREDCLLKAARVFMVFEVLEKCGEVIKSVPAVDVLEEENFDQDFLVSIVSKDSQEDIKKKVMKVSEVHKVDVRLVDLEKGKESDSQITEQPSASTEDATDRVTGKQANVASVPVVKKEEKKESAPSKQANTGNKTIRVNIERLDILMNLFEELVIDRGRLEQISKELNHPELNETVERMSRISGDLQNIILNMRMVPVETVFNRFPRMIRQLARDLNKKIELEIIGAETELDRTVIDEIGDPLVHLLRNAIDHGIEAPEIRRQNGKPEEGTVTLKAYHSGNHVFIEISDNGGGISREKVLKKAISQGIVTEESAAALTDRQVYELILASGFSTAETISDISGRGVGLDVVKATIESLGGSITIDSVLGEGSTFSIQLPLTLSIISVMLVEVEKEKYAIPLSSIIETAIIKKEDILNAHNQKVIDFRGKVVPLLFLEDVFEIPKQEGDDFYSVVIVRKGDRMAGLVVDSFIGQQEVVLKSLGNYLTDVFAISGATILGDGQVALIVDCNAL

SEQ ID NO: 2558 - protein, 664 aa, Artificial
  Substituion in SEQ ID NO 2551
MHDEYLEAFLAESMENVERLEAFCLTLEREGSKPDLLDEMFRAAHTLKGMSATMGFSKLAALTHRVEDLLGTLRDERVRLEPRHVDALLLAVDRMRARIQAIGVSAKEPDEPDDDAMDALAGALRGGADVGGTREEDSKPFANLSDWANRAAAEGKELYTVHIRLAPDCVMPGVRLAMAYQALKASAILMAAHPAEENVMAGQVEATEAFAAVMVAPGEIDRVRQGVLDVTDVSSCEVSKVSESHSAPKEDAPRAEQGDAPIEPRVSRHANGSSPAGADLRRDATLRVPVRKVDALMNTLSDLVITKTRLATLVSSADDPALKEAVERLDRLTGDIQDGLMRLRMVPVETIFHRYPRMMRDLEHRLQREFDFIMTGLDTEMDRVVLEEMGEVIVHLLRNAVDHGLEPPEARESQGKPRRGIVRLAAYTASGHVYLEVSDDGRGIDRGRVLETAVAKGWITPEEGAAMSDESVYALLFRPGFSTAERVSDISGRGVGLDAVREKVEALGGQIRLNSVLGAGTTFTIELPLTLAILSALLVSVRGQVFAIPTANVDEVRRVTRDDVRHVQERPVFQDSAGIVPIVDLAERLGLGSRRDAYPQTAVVCRDGKRRLALVVDHVLDELEIVNKPLGRYLQGVREFAGATILGDGRVSLILDVRSIANPA

SEQ ID NO: 2559 - protein, 664 aa, Artificial
  Substituion in SEQ ID NO 2551
MHDEYLEAFLAESMEQVERLEAFCLTLEREGSKPDLLDEMFRAAHTLKGMSATMGFSKLAALTHRVEDLLGTLRDERVRLEPRHVDALLLAVDRMRARIQAIGVSAKEPDEPDDDAMDALAGALRGGADVGGTREEDSKPFANLSDWANRAAAEGKELYTVHIRLAPDCVMPGVRLAMAYQALKASAILMAAHPAEENVMAGQVEATEAFAAVMVAPGEIDRVRQGVLDVTDVSSCEVSKVSESHSAPKEDAPRAEQGDAPIEPRVSRHANGSSPAGADLRRDATLRVPVRKVDALMNTLSDLVITKTRLATLVSSADDPALKEAVERLDRLTGDIQDGLMRLRMVPVETIFHRYPRMMRDLEHRLQREFDFVMTGLDTEMDRVVLEEMGEVIVHLLRNAVDHGLEPPEARESQGKPRRGIVRLAAYTASGHVYLEVSDDGRGIDRGRVLETAVAKGWITPEEGAAMSDESVYALLFRPGFSTAERVSDISGRGVGLDAVREKVEALGGQIRLNSVLGAGTTFTIELPLTLAILSALLVSVRGQVFAIPTANVDEVRRVTRDDVRHVQERPVFQDSAGIVPIVDLAERLGLGSRRDAYPQTAVVCRDGKRRLALVVDHVLDELEIVNKPLGRYLQGVREFAGATILGDGRVSLILDVRSIANPA

SEQ ID NO: 2560 - protein, 664 aa, Artificial
  Substituion in SEQ ID NO 2551
MHDEYLEAFLAESMENVERLEAFCLTLEREGSKPDLLDEMFRAAHTLKGMSATMGFSKLAALTHRVEDLLGTLRDERVRLEPRHVDALLLAVDRMRARIQAIGVSAKEPDEPEDDAMDALAGALRGGADVGGTREEDSKPFANLSDWANRAAAEGKELYTVHIRLAPDCVMPGVRLAMAYQALKASAILMAAHPAEENVMAGQVEATEAFAAVMVAPGEIDRVRQGVLDVTDVSSCEVSKVSESHSAPKEDAPRAEQGDAPIEPRVSRHANGSSPAGADLRRDATLRVPVRKVDALMNTLSDLVITKTRLATLVSSADDPALKEAVERLDRLTGDIQDGLMRLRMVPVETIFHRYPRMMRDLEHRLQREFDFVMTGLDTEMDRVVLEEMGEVIVHLLRNAVDHGLEPPEARESQGKPRRGIVRLAAYTASGHVYLEVSDDGRGIDRGRVLETAVAKGWITPEEGAAMSDESVYALLFRPGFSTAERVSDISGRGVGLDAVREKVEALGGQIRLNSVLGAGTTFTIELPLTLAILSALLVSVRGQVFAIPTANVDEVRRVTRDDVRHVQERPVFQDSAGIVPIVDLAERLGLGSRRDAYPQTAVVCRDGKRRLALVVDHVLDELEIVNKPLGRYLQGVREFAGATILGDGRVSLILDVRSIANPA

SEQ ID NO: 2561 - protein, 664 aa, Artificial
  Substituion in SEQ ID NO 2551
MHDEYLEAFLAESMENVERLEAFCLTLEREGSKPDLLDEMFRAAHTLKGMSATMGFSKLAALTHRVEDLLGTLRDERVRLEPRHVDALLLAVDRMRARIQAIGVSAKEPDEPDDDAMDALAGALRGGADVGGTREEDSKPFANLSDWANRAAAEGKELYTVHIRLAPDCVMPGVRLAMAYQALKASAILMAAHPAEENVMAGQVEATEAFAAVMVAPGEIDRVRQGVLDVTDVSSCEVSKVSESHSAPKEDAPRAEQGDAPIEPRVSRHANGSSPAGADLRRDATLRVPVRKVDALMNTLSDLVITKTRLATLVSSADDPALKEAVERLDRLTGDIQDGLMRLRMVPVETIFHRYPRMMRDLEHRLQREFDFVMTGLDTEMDRVVLEEMGEVIVHLLRNAVDHGLEPPEARESQGKPRRGIVRLAAYTASGHVYLEVSDDGRGIDRGRVLETAVAKGWITPEEGAAMSDESVYALLFRPGFSTAERVSDISGRGVGLDAVREKVEALGGQIRLNSVLGAGTTFTIELPLTLAILSALLVSVRGQVFAIPTANVDEVRRVTRDDVRHVQERPVFQDSAGIVPIVDLAERLGIGSRRDAYPQTAVVCRDGKRRLALVVDHVLDELEIVNKPLGRYLQGVREFAGATILGDGRVSLILDVRSIANPA

SEQ ID NO: 2562 - protein, 664 aa, Artificial
  Substituion in SEQ ID NO 2551
MHDEYLEAFLAESMENVERLEAFCLTLEREGSKPDLLDEMFRAAHTLKGMSATMGFSKLAALTHRVEDLLGTLRDERVRLEPRHVDALLLAVDRMRARIQAIGVSAKEPDEPDDDAMDALAGALRGGADVGGTREEDSKPFANLSDWANRAAAEGRELYTVHIRLAPDCVMPGVRLAMAYQALKASAILMAAHPAEENVMAGQVEATEAFAAVMVAPGEIDRVRQGVLDVTDVSSCEVSKVSESHSAPKEDAPRAEQGDAPIEPRVSRHANGSSPAGADLRRDATLRVPVRKVDALMNTLSDLVITKTRLATLVSSADDPALKEAVERLDRLTGDIQDGLMRLRMVPVETIFHRYPRMMRDLEHRLQREFDFVMTGLDTEMDRVVLEEMGEVIVHLLRNAVDHGLEPPEARESQGKPRRGIVRLAAYTASGHVYLEVSDDGRGIDRGRVLETAVAKGWITPEEGAAMSDESVYALLFRPGFSTAERVSDISGRGVGLDAVREKVEALGGQIRLNSVLGAGTTFTIELPLTLAILSALLVSVRGQVFAIPTANVDEVRRVTRDDVRHVQERPVFQDSAGIVPIVDLAERLGLGSRRDAYPQTAVVCRDGKRRLALVVDHVLDELEIVNKPLGRYLQGVREFAGATILGDGRVSLILDVRSIANPA

SEQ ID NO: 2563 - DNA, 1995 bp, Artificial
  Substituion in SEQ ID NO 2552
gtgcacgacgaatacctggaggcctttttggccgagtcgatggaaaacgtcgaacgcctggaggcgttttgcctcacgctcgagcgagaagggtcgaagcccgacctgctggacgagatgtttcgggccgcgcataccctgaaaggcatgagcgccacgatggggttctccaagttggcggccttgacgcaccgcgtggaggacctgttgggaacgctgcgggacgaacgcgtccgattggagccgcggcacgtggatgcgcttctgctcgcggtggatcggatgcgagcgaggatccaggccatcggggtctctgccaaggaacctgacgagccggatgacgacgcgatggacgcgctcgcgggcgcgcttcgaggaggcgcggacgttggagggacgcgcgaggaggattcgaagccttttgcgaatctttcggattgggcaaaccgcgccgcggcagagggaaaggagctgtacaccgtccatattcgcctcgctcccgactgcgtcatgcccggcgtgcggctcgccatggcgtaccaagctttgaaagcctcggcgattttgatggcggcccatcctgcggaagagaacgtcatggccggacaggtcgaggcgacggaggctttcgcggccgtcatggtggcgcctggcgagatcgaccgcgttcgacagggcgtgctcgacgtcaccgatgtgtcgtcttgcgaagtgtccaaggtgagcgagtcccattcggctcccaaggaggatgcgccgcgcgcggagcagggcgacgcgcccatcgagccccgggtctcgcgccacgcgaacggctcctcccccgctggcgccgacctgcggagggacgcgacgcttcgcgtcccggtccggaaggtggatgcgctcatgaacaccttgagcgatctcgtcatcaccaagacgcgcctcgccaccctggtgtcgtccgccgacgatccggccttgaaggaggcggtcgagcggttggaccgcctgacgggcgacattcaagatggattgatgcggctcaggatggtgccggtggaaaccatcttccatcgatacccacgcatgatgcgcgatctggaacaccgcctccagcgcgagtttgacttcattatgacgggcctggacaccgaaatggatcgagtcgttctcgaggagatgggcgaggtcatcgtgcaccttctgcgcaacgcggtcgatcacggcctcgagccgccggaggcgcgcgagtcccaaggcaaacctcggcgcggcatcgtccgtctcgctgcgtacacggccagcggccacgtgtatctcgaggtgtcagatgacggccggggaattgaccgcggtcgcgtcctcgaaacggctgtggccaaagggtggatcacgccagaggaaggcgccgcaatgtcggatgagtccgtgtacgcgcttctgtttcgccctgggttcagcaccgcggagcgcgtctcggacatctccgggcgaggcgtggggctggacgccgtgcgcgaaaaagtcgaggccttgggagggcagattcgcctgaattcggttctcggggcgggcacgacgttcaccatcgagttgccgctgaccctcgccatcctgtcggccctgttggtgtccgttcgcgggcaggtgtttgccatccccacggcgaatgtggatgaggtgcgcagagtgacacgggatgacgttcgtcacgtccaggagcgacccgtctttcaagacagcgcgggaatcgtgcccatcgtggatttggcggagcgattgggattgggctctcgtcgcgatgcgtatccacagaccgcggtcgtgtgccgcgatgggaagcgcaggctcgcgctcgtcgtcgatcacgtcctggatgagctcgagatcgtgaataagccgctcggccgatacctgcagggagttcgggagttcgctggcgccaccattctcggcgatggccgggtgtcgctcattctcgatgtgcgctccatcgcaaatcccgcgtag

SEQ ID NO: 2564 - DNA, 1995 bp, Artificial
  Substituion in SEQ ID NO 2552
gtgcacgacgaatacctggaggcctttttggccgagtcgatggaacaagtcgaacgcctggaggcgttttgcctcacgctcgagcgagaagggtcgaagcccgacctgctggacgagatgtttcgggccgcgcataccctgaaaggcatgagcgccacgatggggttctccaagttggcggccttgacgcaccgcgtggaggacctgttgggaacgctgcgggacgaacgcgtccgattggagccgcggcacgtggatgcgcttctgctcgcggtggatcggatgcgagcgaggatccaggccatcggggtctctgccaaggaacctgacgagccggatgacgacgcgatggacgcgctcgcgggcgcgcttcgaggaggcgcggacgttggagggacgcgcgaggaggattcgaagccttttgcgaatctttcggattgggcaaaccgcgccgcggcagagggaaaggagctgtacaccgtccatattcgcctcgctcccgactgcgtcatgcccggcgtgcggctcgccatggcgtaccaagctttgaaagcctcggcgattttgatggcggcccatcctgcggaagagaacgtcatggccggacaggtcgaggcgacggaggctttcgcggccgtcatggtggcgcctggcgagatcgaccgcgttcgacagggcgtgctcgacgtcaccgatgtgtcgtcttgcgaagtgtccaaggtgagcgagtcccattcggctcccaaggaggatgcgccgcgcgcggagcagggcgacgcgcccatcgagccccgggtctcgcgccacgcgaacggctcctcccccgctggcgccgacctgcggagggacgcgacgcttcgcgtcccggtccggaaggtggatgcgctcatgaacaccttgagcgatctcgtcatcaccaagacgcgcctcgccaccctggtgtcgtccgccgacgatccggccttgaaggaggcggtcgagcggttggaccgcctgacgggcgacattcaagatggattgatgcggctcaggatggtgccggtggaaaccatcttccatcgatacccacgcatgatgcgcgatctggaacaccgcctccagcgcgagtttgacttcgtgatgacgggcctggacaccgaaatggatcgagtcgttctcgaggagatgggcgaggtcatcgtgcaccttctgcgcaacgcggtcgatcacggcctcgagccgccggaggcgcgcgagtcccaaggcaaacctcggcgcggcatcgtccgtctcgctgcgtacacggccagcggccacgtgtatctcgaggtgtcagatgacggccggggaattgaccgcggtcgcgtcctcgaaacggctgtggccaaagggtggatcacgccagaggaaggcgccgcaatgtcggatgagtccgtgtacgcgcttctgtttcgccctgggttcagcaccgcggagcgcgtctcggacatctccgggcgaggcgtggggctggacgccgtgcgcgaaaaagtcgaggccttgggagggcagattcgcctgaattcggttctcggggcgggcacgacgttcaccatcgagttgccgctgaccctcgccatcctgtcggccctgttggtgtccgttcgcgggcaggtgtttgccatccccacggcgaatgtggatgaggtgcgcagagtgacacgggatgacgttcgtcacgtccaggagcgacccgtctttcaagacagcgcgggaatcgtgcccatcgtggatttggcggagcgattgggattgggctctcgtcgcgatgcgtatccacagaccgcggtcgtgtgccgcgatgggaagcgcaggctcgcgctcgtcgtcgatcacgtcctggatgagctcgagatcgtgaataagccgctcggccgatacctgcagggagttcgggagttcgctggcgccaccattctcggcgatggccgggtgtcgctcattctcgatgtgcgctccatcgcaaatcccgcgtag

SEQ ID NO: 2565 - DNA, 1995 bp, Artificial
  Substituion in SEQ ID NO 2552
gtgcacgacgaatacctggaggcctttttggccgagtcgatggaaaacgtcgaacgcctggaggcgttttgcctcacgctcgagcgagaagggtcgaagcccgacctgctggacgagatgtttcgggccgcgcataccctgaaaggcatgagcgccacgatggggttctccaagttggcggccttgacgcaccgcgtggaggacctgttgggaacgctgcgggacgaacgcgtccgattggagccgcggcacgtggatgcgcttctgctcgcggtggatcggatgcgagcgaggatccaggccatcggggtctctgccaaggaacctgacgagccggaagacgacgcgatggacgcgctcgcgggcgcgcttcgaggaggcgcggacgttggagggacgcgcgaggaggattcgaagccttttgcgaatctttcggattgggcaaaccgcgccgcggcagagggaaaggagctgtacaccgtccatattcgcctcgctcccgactgcgtcatgcccggcgtgcggctcgccatggcgtaccaagctttgaaagcctcggcgattttgatggcggcccatcctgcggaagagaacgtcatggccggacaggtcgaggcgacggaggctttcgcggccgtcatggtggcgcctggcgagatcgaccgcgttcgacagggcgtgctcgacgtcaccgatgtgtcgtcttgcgaagtgtccaaggtgagcgagtcccattcggctcccaaggaggatgcgccgcgcgcggagcagggcgacgcgcccatcgagccccgggtctcgcgccacgcgaacggctcctcccccgctggcgccgacctgcggagggacgcgacgcttcgcgtcccggtccggaaggtggatgcgctcatgaacaccttgagcgatctcgtcatcaccaagacgcgcctcgccaccctggtgtcgtccgccgacgatccggccttgaaggaggcggtcgagcggttggaccgcctgacgggcgacattcaagatggattgatgcggctcaggatggtgccggtggaaaccatcttccatcgatacccacgcatgatgcgcgatctggaacaccgcctccagcgcgagtttgacttcgtgatgacgggcctggacaccgaaatggatcgagtcgttctcgaggagatgggcgaggtcatcgtgcaccttctgcgcaacgcggtcgatcacggcctcgagccgccggaggcgcgcgagtcccaaggcaaacctcggcgcggcatcgtccgtctcgctgcgtacacggccagcggccacgtgtatctcgaggtgtcagatgacggccggggaattgaccgcggtcgcgtcctcgaaacggctgtggccaaagggtggatcacgccagaggaaggcgccgcaatgtcggatgagtccgtgtacgcgcttctgtttcgccctgggttcagcaccgcggagcgcgtctcggacatctccgggcgaggcgtggggctggacgccgtgcgcgaaaaagtcgaggccttgggagggcagattcgcctgaattcggttctcggggcgggcacgacgttcaccatcgagttgccgctgaccctcgccatcctgtcggccctgttggtgtccgttcgcgggcaggtgtttgccatccccacggcgaatgtggatgaggtgcgcagagtgacacgggatgacgttcgtcacgtccaggagcgacccgtctttcaagacagcgcgggaatcgtgcccatcgtggatttggcggagcgattgggattgggctctcgtcgcgatgcgtatccacagaccgcggtcgtgtgccgcgatgggaagcgcaggctcgcgctcgtcgtcgatcacgtcctggatgagctcgagatcgtgaataagccgctcggccgatacctgcagggagttcgggagttcgctggcgccaccattctcggcgatggccgggtgtcgctcattctcgatgtgcgctccatcgcaaatcccgcgtag

SEQ ID NO: 2566 - DNA, 1995 bp, Artificial
  Substituion in SEQ ID NO 2552
gtgcacgacgaatacctggaggcctttttggccgagtcgatggaaaacgtcgaacgcctggaggcgttttgcctcacgctcgagcgagaagggtcgaagcccgacctgctggacgagatgtttcgggccgcgcataccctgaaaggcatgagcgccacgatggggttctccaagttggcggccttgacgcaccgcgtggaggacctgttgggaacgctgcgggacgaacgcgtccgattggagccgcggcacgtggatgcgcttctgctcgcggtggatcggatgcgagcgaggatccaggccatcggggtctctgccaaggaacctgacgagccggatgacgacgcgatggacgcgctcgcgggcgcgcttcgaggaggcgcggacgttggagggacgcgcgaggaggattcgaagccttttgcgaatctttcggattgggcaaaccgcgccgcggcagagggaaaggagctgtacaccgtccatattcgcctcgctcccgactgcgtcatgcccggcgtgcggctcgccatggcgtaccaagctttgaaagcctcggcgattttgatggcggcccatcctgcggaagagaacgtcatggccggacaggtcgaggcgacggaggctttcgcggccgtcatggtggcgcctggcgagatcgaccgcgttcgacagggcgtgctcgacgtcaccgatgtgtcgtcttgcgaagtgtccaaggtgagcgagtcccattcggctcccaaggaggatgcgccgcgcgcggagcagggcgacgcgcccatcgagccccgggtctcgcgccacgcgaacggctcctcccccgctggcgccgacctgcggagggacgcgacgcttcgcgtcccggtccggaaggtggatgcgctcatgaacaccttgagcgatctcgtcatcaccaagacgcgcctcgccaccctggtgtcgtccgccgacgatccggccttgaaggaggcggtcgagcggttggaccgcctgacgggcgacattcaagatggattgatgcggctcaggatggtgccggtggaaaccatcttccatcgatacccacgcatgatgcgcgatctggaacaccgcctccagcgcgagtttgacttcgtgatgacgggcctggacaccgaaatggatcgagtcgttctcgaggagatgggcgaggtcatcgtgcaccttctgcgcaacgcggtcgatcacggcctcgagccgccggaggcgcgcgagtcccaaggcaaacctcggcgcggcatcgtccgtctcgctgcgtacacggccagcggccacgtgtatctcgaggtgtcagatgacggccggggaattgaccgcggtcgcgtcctcgaaacggctgtggccaaagggtggatcacgccagaggaaggcgccgcaatgtcggatgagtccgtgtacgcgcttctgtttcgccctgggttcagcaccgcggagcgcgtctcggacatctccgggcgaggcgtggggctggacgccgtgcgcgaaaaagtcgaggccttgggagggcagattcgcctgaattcggttctcggggcgggcacgacgttcaccatcgagttgccgctgaccctcgccatcctgtcggccctgttggtgtccgttcgcgggcaggtgtttgccatccccacggcgaatgtggatgaggtgcgcagagtgacacgggatgacgttcgtcacgtccaggagcgacccgtctttcaagacagcgcgggaatcgtgcccatcgtggatttggcggagcgattgggaattggctctcgtcgcgatgcgtatccacagaccgcggtcgtgtgccgcgatgggaagcgcaggctcgcgctcgtcgtcgatcacgtcctggatgagctcgagatcgtgaataagccgctcggccgatacctgcagggagttcgggagttcgctggcgccaccattctcggcgatggccgggtgtcgctcattctcgatgtgcgctccatcgcaaatcccgcgtag

SEQ ID NO: 2567 - DNA, 1995 bp, Artificial
  Substituion in SEQ ID NO 2552
gtgcacgacgaatacctggaggcctttttggccgagtcgatggaaaacgtcgaacgcctggaggcgttttgcctcacgctcgagcgagaagggtcgaagcccgacctgctggacgagatgtttcgggccgcgcataccctgaaaggcatgagcgccacgatggggttctccaagttggcggccttgacgcaccgcgtggaggacctgttgggaacgctgcgggacgaacgcgtccgattggagccgcggcacgtggatgcgcttctgctcgcggtggatcggatgcgagcgaggatccaggccatcggggtctctgccaaggaacctgacgagccggatgacgacgcgatggacgcgctcgcgggcgcgcttcgaggaggcgcggacgttggagggacgcgcgaggaggattcgaagccttttgcgaatctttcggattgggcaaaccgcgccgcggcagagggacgtgagctgtacaccgtccatattcgcctcgctcccgactgcgtcatgcccggcgtgcggctcgccatggcgtaccaagctttgaaagcctcggcgattttgatggcggcccatcctgcggaagagaacgtcatggccggacaggtcgaggcgacggaggctttcgcggccgtcatggtggcgcctggcgagatcgaccgcgttcgacagggcgtgctcgacgtcaccgatgtgtcgtcttgcgaagtgtccaaggtgagcgagtcccattcggctcccaaggaggatgcgccgcgcgcggagcagggcgacgcgcccatcgagccccgggtctcgcgccacgcgaacggctcctcccccgctggcgccgacctgcggagggacgcgacgcttcgcgtcccggtccggaaggtggatgcgctcatgaacaccttgagcgatctcgtcatcaccaagacgcgcctcgccaccctggtgtcgtccgccgacgatccggccttgaaggaggcggtcgagcggttggaccgcctgacgggcgacattcaagatggattgatgcggctcaggatggtgccggtggaaaccatcttccatcgatacccacgcatgatgcgcgatctggaacaccgcctccagcgcgagtttgacttcgtgatgacgggcctggacaccgaaatggatcgagtcgttctcgaggagatgggcgaggtcatcgtgcaccttctgcgcaacgcggtcgatcacggcctcgagccgccggaggcgcgcgagtcccaaggcaaacctcggcgcggcatcgtccgtctcgctgcgtacacggccagcggccacgtgtatctcgaggtgtcagatgacggccggggaattgaccgcggtcgcgtcctcgaaacggctgtggccaaagggtggatcacgccagaggaaggcgccgcaatgtcggatgagtccgtgtacgcgcttctgtttcgccctgggttcagcaccgcggagcgcgtctcggacatctccgggcgaggcgtggggctggacgccgtgcgcgaaaaagtcgaggccttgggagggcagattcgcctgaattcggttctcggggcgggcacgacgttcaccatcgagttgccgctgaccctcgccatcctgtcggccctgttggtgtccgttcgcgggcaggtgtttgccatccccacggcgaatgtggatgaggtgcgcagagtgacacgggatgacgttcgtcacgtccaggagcgacccgtctttcaagacagcgcgggaatcgtgcccatcgtggatttggcggagcgattgggattgggctctcgtcgcgatgcgtatccacagaccgcggtcgtgtgccgcgatgggaagcgcaggctcgcgctcgtcgtcgatcacgtcctggatgagctcgagatcgtgaataagccgctcggccgatacctgcagggagttcgggagttcgctggcgccaccattctcggcgatggccgggtgtcgctcattctcgatgtgcgctccatcgcaaatcccgcgtag

SEQ ID NO: 2568 - protein, 398 aa, Alicyclobacillus acidocaldarius
MRTRGWLWSGDPNAPEISRRGGSLVMNVDFLEALDQLAREKGIDKEVLLEAIEAALIASYRRNFHSAANVRVEVKRDTGEVHVYARKTVVEEPKDTRLEISLDAARDINPSYQIGDVVEIEVTPRDFGRIAAQAAKQVVMQRVKEAERSVIYSKFADREEEVVSGIVSRLEPRVAYIDLGDTEAILPQSEQMASDKLQVGKRLKVFIARVERTSKGPQIVVSRTHPGLLRRLFELEVPEIYEGIVEIKAVAREAGSRSKIAVHSRNPEVDPIGACVGARGSRVQAIVNELNGEKVDIVEWSEDPATFVANALSPAKVIDVHIYEDERVARTVVPDYQLSLAIGKEGQNARLAARLTGWKIDIKSESQMASHSLLDQLEDTNEEEPEFATLSDDWLNEP

SEQ ID NO: 2569 - DNA, 1197 bp, Alicyclobacillus acidocaldarius
ttgcgcacgcgcggctggctctggagtggtgacccgaacgcgcctgagatttcgcgaaggggaggttccctagtcatgaatgtggattttctggaagcgctggaccagttggcgcgcgaaaaaggaattgacaaggaagttctgctcgaggcgattgaggcggcgctcatcgcgagctaccgccgcaacttccactcggcggccaacgtgcgcgtggaggtgaagcgagacacgggcgaggtccacgtgtacgcgcgcaagaccgtcgtcgaggagccgaaggacacgcgcctcgagatctcgctagacgcggcgcgcgacatcaatccaagctatcaaatcggagatgtcgtggaaattgaggtcacccctcgcgacttcgggcgcatcgccgcgcaggccgccaagcaggtcgtcatgcagcgcgtgaaggaagccgagcgatccgtcatctacagcaagtttgcggatcgcgaggaagaggtcgtgagcgggatcgtcagccggctcgagccgcgcgtcgcctacatcgatctcggcgacacggaggcgattttgccgcagtcggaacagatggcgtccgacaagctgcaggtcggcaagcggctcaaggtgttcatcgcgcgcgtggagcgcacgtcgaagggcccgcagattgtggtgtcccgcacccatccggggcttcttcgccgcttgtttgaactcgaggtgccggaaatttacgagggcatcgtggagatcaaggccgtggcccgcgaggcgggatcgcgttccaaaatcgcggttcattcgcgcaatccggaggtggatcccatcggcgcgtgcgtcggcgcccggggatcgcgcgtccaggcgattgtgaacgaattgaacggggaaaaggtcgacatcgtggagtggagcgaagatccggcgacgttcgtggcgaatgcgctgtctcccgcgaaagtgatcgacgtgcacatctatgaggacgagcgcgtggcgcggacggtggttccggattatcaactgtccctggcgattgggaaggagggacagaacgcccggcttgccgcgcggctcacgggctggaagatcgacatcaagagcgagtcgcagatggcctcccattcgcttctcgatcagctcgaggacacgaacgaggaggaacccgagtttgccacgctgtccgacgactggctgaacgaaccctga

SEQ ID NO: 2570 - protein, 342 aa, Geobacillus kaustophilus HTA426
MNTQLLEALADLMREKGISKEVVMEAIEAAIVSAYKRNFGQAQNVRVDLNMDTGTIRVFARKDVVEEVADPRLEISLEDAQRINPNYQIGDVVELEVTPRDFGRIAAQTAKQVVTQRVREAERSIIYAEFVDREEDIMTGIVQRVDPRFVYVSLGKAEALLPANEQMPNETYKPHDRLKVYITKVEKTTKGPQIFVSRTHPGLLKRLFELEVPEIYDGTVEIKSIAREAGDRSKISVHSDNPEVDPVGACVGPRGQRVQAIVDELNGEKIDIVRWSADPVEFVANALSPAKVLRVIVNEEQKATTVIVPDYQLSLAIGKRGQNARLAAKLTGWKIDIKSESE

SEQ ID NO: 2571 - protein, 357 aa, Bacillus halodurans C-125
MNSEFMDALTTLEKEKGISKEVIIEAIEAALISGYKRNFNQAQNVRVDVNRENGSIRVFARKEVVEEVFDARLEISLDEAKGINPNYEVDDVVEIEVTPKDFGRIAAQTAKQVVTQRVREAERGIIYADFIDREEDIMTGIVQRQDNRFIYVDLGKVEALLPLSEQMPNESYRHNDRIKAYITKVEKTTKGPQIMISRTHPGLLKRLFELEVPEIYDGTVELKSVAREAGDRSKISVHAENPEVDPVGACVGPKGSRVQTIVNELKGEKIDIVRWSEDPVEYVANALSPSKVVKVNVNEEEKTTQVIVPDYQLSLAIGKRGQNARLAAKLTGWKIDIKSESEAQELGLLEDEAASHE

SEQ ID NO: 2572 - protein, 342 aa, Geobacillus thermodenitrificans NG80-2
MNTQLLEALADLMREKGISKEVIMEAIEAALVSAYKRNFGQAQNVRVDLNMDTGTIRVLARKDVVEEVTDPRLEISLEEAQRLNPNYQIGDVVELEVTPRDFGRIAAQTAKQVVTQRVREAERSIIYAEFVDREEDIMTGIVQRIDPRFVYVSLGKAEALLPANEQMPNETYKPHDRLKVYITKVEKTTKGPQIFVSRTHPGLLKRLFELEVPEIYDGTVEIKSIAREAGDRSKISVHSDNPEVDPVGACVGPKGQRVQAIVDELHGEKIDIVRWSADPVEFVANALSPAKVLRVIVNEEQKATTVIVPDYQLSLAIGKRGQNARLAAKLTGWKIDIKSESE

SEQ ID NO: 2573 - protein, 361 aa, Bacillus clausii KSM-K16
MNSEFMEALSTLEADKGIKKEVIIEAIEAALISGYKRNFGQAQNVRVDVNRDNGSIRVFARKVVVEEVFDKRLEISEAEAQRINPHYEVDDIVEIEVTPKDFGRIAAQTAKQVVTQRVREAERGIIYSDFIDREEDIMNGIVQRQDHRFIYVDLGKVEALLPLSEQMPNETYKHNDRIKAYITKVEKTTKGPQILISRTHPGLLKRLFELEVPEIYDGTVEIKSVSREAGDRSKIAVHSDNPEVDSVGACVGQRGQRVQTIVDELKGEKIDIVEWSEDPVVYVANALSPAKVMKVNVLEGEKMTQVIVPDYQLSLAIGKRGQNARLAAKLTGWKIDIKSESEARELGLLDEENENDELEEF

SEQ ID NO: 2574 - protein, 342 aa, Paenibacillus larvae subsp. larvae BRL-230010
MNSEFIEALSEIEREKGISKDLLIDAIEAAMISSYKRNFNTAQNVRVDINRQTGVIRVFARKTVVEDVLDPRLEISLTAAREINQNYQLGDIVEIEVTPRDFGRIAAQTAKQVVTQRIREAERGLIYNAFIDKEEDIVTGIVQRQDQRSYYVDLGKVEAVLPLNEVMPTEKFKHGDRVKAYITKVENTTKGPQIILSRTHPGLLKRLFELEVPEIFDGVVEIRSVAREAGFRSKIAVDSRNEEVDPVGSCVGPKGLRVQTIVNELRGEKIDIVRWMESTEEYVANALSPSKVLEVNIFEDEKMARVIVPDYQLSLAIGIKGQNARLAAKLTGWKIDIKSETQ

SEQ ID NO: 2575 - protein, 398 aa, Artificial
  Substituion in SEQ ID NO 2568
MRTRGWLWSGDPNAPEISRRGGSLVMNVDFLEALDQLAREKGIDKEVILEAIEAALIASYRRNFHSAANVRVEVKRDTGEVHVYARKTVVEEPKDTRLEISLDAARDINPSYQIGDVVEIEVTPRDFGRIAAQAAKQVVMQRVKEAERSVIYSKFADREEEVVSGIVSRLEPRVAYIDLGDTEAILPQSEQMASDKLQVGKRLKVFIARVERTSKGPQIVVSRTHPGLLRRLFELEVPEIYEGIVEIKAVAREAGSRSKIAVHSRNPEVDPIGACVGARGSRVQAIVNELNGEKVDIVEWSEDPATFVANALSPAKVIDVHIYEDERVARTVVPDYQLSLAIGKEGQNARLAARLTGWKIDIKSESQMASHSLLDQLEDTNEEEPEFATLSDDWLNEP

SEQ ID NO: 2576 - protein, 398 aa, Artificial
  Substituion in SEQ ID NO 2568
MRTRGWLWSGDPNAPEISRRGGSLVMNVDFLEALDQLAREKGIDKEVLLEAIEAALIASYRRNFHSAANVRVEVKRDTGEVHVYARKTVVEEPKDTRLEISLDAAREINPSYQIGDVVEIEVTPRDFGRIAAQAAKQVVMQRVKEAERSVIYSKFADREEEVVSGIVSRLEPRVAYIDLGDTEAILPQSEQMASDKLQVGKRLKVFIARVERTSKGPQIVVSRTHPGLLRRLFELEVPEIYEGIVEIKAVAREAGSRSKIAVHSRNPEVDPIGACVGARGSRVQAIVNELNGEKVDIVEWSEDPATFVANALSPAKVIDVHIYEDERVARTVVPDYQLSLAIGKEGQNARLAARLTGWKIDIKSESQMASHSLLDQLEDTNEEEPEFATLSDDWLNEP

SEQ ID NO: 2577 - protein, 398 aa, Artificial
  Substituion in SEQ ID NO 2568
MRTRGWLWSGDPNAPEISRRGGSLVMNVDFLEALDQLAREKGIDKEVLLEAIEAALIASYRRNFHSAANVRVEVKRDTGEVHVYARKTVVEEPKDTRLEISLDAARDINPSYQIGDVVEIEVTPRDFGRIAAQAAKQVVMQRVKEAERSVIYSKFADREEDVVSGIVSRLEPRVAYIDLGDTEAILPQSEQMASDKLQVGKRLKVFIARVERTSKGPQIVVSRTHPGLLRRLFELEVPEIYEGIVEIKAVAREAGSRSKIAVHSRNPEVDPIGACVGARGSRVQAIVNELNGEKVDIVEWSEDPATFVANALSPAKVIDVHIYEDERVARTVVPDYQLSLAIGKEGQNARLAARLTGWKIDIKSESQMASHSLLDQLEDTNEEEPEFATLSDDWLNEP

SEQ ID NO: 2578 - protein, 398 aa, Artificial
  Substituion in SEQ ID NO 2568
MRTRGWLWSGDPNAPEISRRGGSLVMNIDFLEALDQLAREKGIDKEVLLEAIEAALIASYRRNFHSAANVRVEVKRDTGEVHVYARKTVVEEPKDTRLEISLDAARDINPSYQIGDVVEIEVTPRDFGRIAAQAAKQVVMQRVKEAERSVIYSKFADREEEVVSGIVSRLEPRVAYIDLGDTEAILPQSEQMASDKLQVGKRLKVFIARVERTSKGPQIVVSRTHPGLLRRLFELEVPEIYEGIVEIKAVAREAGSRSKIAVHSRNPEVDPIGACVGARGSRVQAIVNELNGEKVDIVEWSEDPATFVANALSPAKVIDVHIYEDERVARTVVPDYQLSLAIGKEGQNARLAARLTGWKIDIKSESQMASHSLLDQLEDTNEEEPEFATLSDDWLNEP

SEQ ID NO: 2579 - protein, 398 aa, Artificial
  Substituion in SEQ ID NO 2568
MRTRGWLWSGDPNAPEISRRGGSLVMNVDFLEALDQLAREKGIDKEVLLEAIEAALLASYRRNFHSAANVRVEVKRDTGEVHVYARKTVVEEPKDTRLEISLDAARDINPSYQIGDVVEIEVTPRDFGRIAAQAAKQVVMQRVKEAERSVIYSKFADREEEVVSGIVSRLEPRVAYIDLGDTEAILPQSEQMASDKLQVGKRLKVFIARVERTSKGPQIVVSRTHPGLLRRLFELEVPEIYEGIVEIKAVAREAGSRSKIAVHSRNPEVDPIGACVGARGSRVQAIVNELNGEKVDIVEWSEDPATFVANALSPAKVIDVHIYEDERVARTVVPDYQLSLAIGKEGQNARLAARLTGWKIDIKSESQMASHSLLDQLEDTNEEEPEFATLSDDWLNEP

SEQ ID NO: 2580 - DNA, 1197 bp, Artificial
  Substituion in SEQ ID NO 2569
ttgcgcacgcgcggctggctctggagtggtgacccgaacgcgcctgagatttcgcgaaggggaggttccctagtcatgaatgtggattttctggaagcgctggaccagttggcgcgcgaaaaaggaattgacaaggaagttattctcgaggcgattgaggcggcgctcatcgcgagctaccgccgcaacttccactcggcggccaacgtgcgcgtggaggtgaagcgagacacgggcgaggtccacgtgtacgcgcgcaagaccgtcgtcgaggagccgaaggacacgcgcctcgagatctcgctagacgcggcgcgcgacatcaatccaagctatcaaatcggagatgtcgtggaaattgaggtcacccctcgcgacttcgggcgcatcgccgcgcaggccgccaagcaggtcgtcatgcagcgcgtgaaggaagccgagcgatccgtcatctacagcaagtttgcggatcgcgaggaagaggtcgtgagcgggatcgtcagccggctcgagccgcgcgtcgcctacatcgatctcggcgacacggaggcgattttgccgcagtcggaacagatggcgtccgacaagctgcaggtcggcaagcggctcaaggtgttcatcgcgcgcgtggagcgcacgtcgaagggcccgcagattgtggtgtcccgcacccatccggggcttcttcgccgcttgtttgaactcgaggtgccggaaatttacgagggcatcgtggagatcaaggccgtggcccgcgaggcgggatcgcgttccaaaatcgcggttcattcgcgcaatccggaggtggatcccatcggcgcgtgcgtcggcgcccggggatcgcgcgtccaggcgattgtgaacgaattgaacggggaaaaggtcgacatcgtggagtggagcgaagatccggcgacgttcgtggcgaatgcgctgtctcccgcgaaagtgatcgacgtgcacatctatgaggacgagcgcgtggcgcggacggtggttccggattatcaactgtccctggcgattgggaaggagggacagaacgcccggcttgccgcgcggctcacgggctggaagatcgacatcaagagcgagtcgcagatggcctcccattcgcttctcgatcagctcgaggacacgaacgaggaggaacccgagtttgccacgctgtccgacgactggctgaacgaaccctga

SEQ ID NO: 2581 - DNA, 1197 bp, Artificial
  Substituion in SEQ ID NO 2569
ttgcgcacgcgcggctggctctggagtggtgacccgaacgcgcctgagatttcgcgaaggggaggttccctagtcatgaatgtggattttctggaagcgctggaccagttggcgcgcgaaaaaggaattgacaaggaagttctgctcgaggcgattgaggcggcgctcatcgcgagctaccgccgcaacttccactcggcggccaacgtgcgcgtggaggtgaagcgagacacgggcgaggtccacgtgtacgcgcgcaagaccgtcgtcgaggagccgaaggacacgcgcctcgagatctcgctagacgcggcgcgcgaaatcaatccaagctatcaaatcggagatgtcgtggaaattgaggtcacccctcgcgacttcgggcgcatcgccgcgcaggccgccaagcaggtcgtcatgcagcgcgtgaaggaagccgagcgatccgtcatctacagcaagtttgcggatcgcgaggaagaggtcgtgagcgggatcgtcagccggctcgagccgcgcgtcgcctacatcgatctcggcgacacggaggcgattttgccgcagtcggaacagatggcgtccgacaagctgcaggtcggcaagcggctcaaggtgttcatcgcgcgcgtggagcgcacgtcgaagggcccgcagattgtggtgtcccgcacccatccggggcttcttcgccgcttgtttgaactcgaggtgccggaaatttacgagggcatcgtggagatcaaggccgtggcccgcgaggcgggatcgcgttccaaaatcgcggttcattcgcgcaatccggaggtggatcccatcggcgcgtgcgtcggcgcccggggatcgcgcgtccaggcgattgtgaacgaattgaacggggaaaaggtcgacatcgtggagtggagcgaagatccggcgacgttcgtggcgaatgcgctgtctcccgcgaaagtgatcgacgtgcacatctatgaggacgagcgcgtggcgcggacggtggttccggattatcaactgtccctggcgattgggaaggagggacagaacgcccggcttgccgcgcggctcacgggctggaagatcgacatcaagagcgagtcgcagatggcctcccattcgcttctcgatcagctcgaggacacgaacgaggaggaacccgagtttgccacgctgtccgacgactggctgaacgaaccctga

SEQ ID NO: 2582 - DNA, 1197 bp, Artificial
  Substituion in SEQ ID NO 2569
ttgcgcacgcgcggctggctctggagtggtgacccgaacgcgcctgagatttcgcgaaggggaggttccctagtcatgaatgtggattttctggaagcgctggaccagttggcgcgcgaaaaaggaattgacaaggaagttctgctcgaggcgattgaggcggcgctcatcgcgagctaccgccgcaacttccactcggcggccaacgtgcgcgtggaggtgaagcgagacacgggcgaggtccacgtgtacgcgcgcaagaccgtcgtcgaggagccgaaggacacgcgcctcgagatctcgctagacgcggcgcgcgacatcaatccaagctatcaaatcggagatgtcgtggaaattgaggtcacccctcgcgacttcgggcgcatcgccgcgcaggccgccaagcaggtcgtcatgcagcgcgtgaaggaagccgagcgatccgtcatctacagcaagtttgcggatcgcgaggaagatgtcgtgagcgggatcgtcagccggctcgagccgcgcgtcgcctacatcgatctcggcgacacggaggcgattttgccgcagtcggaacagatggcgtccgacaagctgcaggtcggcaagcggctcaaggtgttcatcgcgcgcgtggagcgcacgtcgaagggcccgcagattgtggtgtcccgcacccatccggggcttcttcgccgcttgtttgaactcgaggtgccggaaatttacgagggcatcgtggagatcaaggccgtggcccgcgaggcgggatcgcgttccaaaatcgcggttcattcgcgcaatccggaggtggatcccatcggcgcgtgcgtcggcgcccggggatcgcgcgtccaggcgattgtgaacgaattgaacggggaaaaggtcgacatcgtggagtggagcgaagatccggcgacgttcgtggcgaatgcgctgtctcccgcgaaagtgatcgacgtgcacatctatgaggacgagcgcgtggcgcggacggtggttccggattatcaactgtccctggcgattgggaaggagggacagaacgcccggcttgccgcgcggctcacgggctggaagatcgacatcaagagcgagtcgcagatggcctcccattcgcttctcgatcagctcgaggacacgaacgaggaggaacccgagtttgccacgctgtccgacgactggctgaacgaaccctga

SEQ ID NO: 2583 - DNA, 1197 bp, Artificial
  Substituion in SEQ ID NO 2569
ttgcgcacgcgcggctggctctggagtggtgacccgaacgcgcctgagatttcgcgaaggggaggttccctagtcatgaatattgattttctggaagcgctggaccagttggcgcgcgaaaaaggaattgacaaggaagttctgctcgaggcgattgaggcggcgctcatcgcgagctaccgccgcaacttccactcggcggccaacgtgcgcgtggaggtgaagcgagacacgggcgaggtccacgtgtacgcgcgcaagaccgtcgtcgaggagccgaaggacacgcgcctcgagatctcgctagacgcggcgcgcgacatcaatccaagctatcaaatcggagatgtcgtggaaattgaggtcacccctcgcgacttcgggcgcatcgccgcgcaggccgccaagcaggtcgtcatgcagcgcgtgaaggaagccgagcgatccgtcatctacagcaagtttgcggatcgcgaggaagaggtcgtgagcgggatcgtcagccggctcgagccgcgcgtcgcctacatcgatctcggcgacacggaggcgattttgccgcagtcggaacagatggcgtccgacaagctgcaggtcggcaagcggctcaaggtgttcatcgcgcgcgtggagcgcacgtcgaagggcccgcagattgtggtgtcccgcacccatccggggcttcttcgccgcttgtttgaactcgaggtgccggaaatttacgagggcatcgtggagatcaaggccgtggcccgcgaggcgggatcgcgttccaaaatcgcggttcattcgcgcaatccggaggtggatcccatcggcgcgtgcgtcggcgcccggggatcgcgcgtccaggcgattgtgaacgaattgaacggggaaaaggtcgacatcgtggagtggagcgaagatccggcgacgttcgtggcgaatgcgctgtctcccgcgaaagtgatcgacgtgcacatctatgaggacgagcgcgtggcgcggacggtggttccggattatcaactgtccctggcgattgggaaggagggacagaacgcccggcttgccgcgcggctcacgggctggaagatcgacatcaagagcgagtcgcagatggcctcccattcgcttctcgatcagctcgaggacacgaacgaggaggaacccgagtttgccacgctgtccgacgactggctgaacgaaccctga

SEQ ID NO: 2584 - DNA, 1197 bp, Artificial
  Substituion in SEQ ID NO 2569
ttgcgcacgcgcggctggctctggagtggtgacccgaacgcgcctgagatttcgcgaaggggaggttccctagtcatgaatgtggattttctggaagcgctggaccagttggcgcgcgaaaaaggaattgacaaggaagttctgctcgaggcgattgaggcggcgctcttagcgagctaccgccgcaacttccactcggcggccaacgtgcgcgtggaggtgaagcgagacacgggcgaggtccacgtgtacgcgcgcaagaccgtcgtcgaggagccgaaggacacgcgcctcgagatctcgctagacgcggcgcgcgacatcaatccaagctatcaaatcggagatgtcgtggaaattgaggtcacccctcgcgacttcgggcgcatcgccgcgcaggccgccaagcaggtcgtcatgcagcgcgtgaaggaagccgagcgatccgtcatctacagcaagtttgcggatcgcgaggaagaggtcgtgagcgggatcgtcagccggctcgagccgcgcgtcgcctacatcgatctcggcgacacggaggcgattttgccgcagtcggaacagatggcgtccgacaagctgcaggtcggcaagcggctcaaggtgttcatcgcgcgcgtggagcgcacgtcgaagggcccgcagattgtggtgtcccgcacccatccggggcttcttcgccgcttgtttgaactcgaggtgccggaaatttacgagggcatcgtggagatcaaggccgtggcccgcgaggcgggatcgcgttccaaaatcgcggttcattcgcgcaatccggaggtggatcccatcggcgcgtgcgtcggcgcccggggatcgcgcgtccaggcgattgtgaacgaattgaacggggaaaaggtcgacatcgtggagtggagcgaagatccggcgacgttcgtggcgaatgcgctgtctcccgcgaaagtgatcgacgtgcacatctatgaggacgagcgcgtggcgcggacggtggttccggattatcaactgtccctggcgattgggaaggagggacagaacgcccggcttgccgcgcggctcacgggctggaagatcgacatcaagagcgagtcgcagatggcctcccattcgcttctcgatcagctcgaggacacgaacgaggaggaacccgagtttgccacgctgtccgacgactggctgaacgaaccctga

SEQ ID NO: 2585-2601 - skipped (17 entries)

SEQ ID NO: 2602 - protein, 95 aa, Alicyclobacillus acidocaldarius
MLDVLVDRTAPSVEDVVFGPPKGVSAEELVAWAERHWRLNLSELEREVWRLRIEGHSYTEIQRMLGCGYKAVDNAVQRLRKKARRALMRQEGAAL

SEQ ID NO: 2603 - DNA, 288 bp, Alicyclobacillus acidocaldarius
gtgctggacgtgctcgttgatcgtacggcaccgagtgtggaggatgtggtgttcgggccgcctaagggtgtatctgcggaagagctcgtggcatgggctgagcggcattggagacttaacttgtcggagctcgaacgcgaggtgtggcggttgcggatcgagggtcattcgtacacggagatccagcggatgttgggatgcggatacaaggcggtggacaatgcggtgcagaggttaaggaaaaaagcgcgaagggcactcatgcgccaggaaggagcggcgttgtga

SEQ ID NO: 2604 - protein, 36 aa, Fervidobacterium nodosum Rt17-B1
LNEEETQIFELWLDGYSYKEIEEMVGVNFKKVDNTV

SEQ ID NO: 2605 - protein, 69 aa, Bacillus pumilus SAFR-032
LLDVISGAKALNPEDLIISKEEFDDIEMKMGELLSELERKVLVLYLDGRSYQEISEDLNRHVKSIDNAL

SEQ ID NO: 2606 - protein, 43 aa, Dehalococcoides ethenogenes 195
WLEPAKGMNISHRELEVFVLMIEGHNNKEIGALLGIQYQSVKN

SEQ ID NO: 2607 - protein, 69 aa, Bacillus cereus ATCC 10987
LLDVISEAKVTDPEEMIISQEEYTDIESKISELLSDLERKVLSLYLDGRSYQEISEQLNRHVKSIDNAL

SEQ ID NO: 2608 - protein, 69 aa, Bacillus anthracis str. Ames; identical to SEQ ID NO: 2607

SEQ ID NO: 2609 - protein, 95 aa, Artificial
  Substituion in SEQ ID NO 2602
MLDVLVDRTAPSVEDVVFGPPKGVSAEELVAWAERHWRLNLSELEREVWRLRIEGHSYTEINRMLGCGYKAVDNAVQRLRKKARRALMRQEGAAL

SEQ ID NO: 2610 - protein, 95 aa, Artificial
  Substituion in SEQ ID NO 2602
MLDVLVDRTAPSVEDVVFGPPKGVSAEELVAWAERHWRLNLSELEREVWRLRIEGHSYTEIQRMLGCGYKAVDNAVQRLKKKARRALMRQEGAAL

SEQ ID NO: 2611 - protein, 95 aa, Artificial
  Substituion in SEQ ID NO 2602
MLDVLVDRTAPSVEDVVFGPPKGVSAEELVAWAERHWRINLSELEREVWRLRIEGHSYTEIQRMLGCGYKAVDNAVQRLRKKARRALMRQEGAAL

SEQ ID NO: 2612 - protein, 95 aa, Artificial
  Substituion in SEQ ID NO 2602
MLDVLVDRTAPSVEDVVFGPPKGVSAEELVAWAEKHWRLNLSELEREVWRLRIEGHSYTEIQRMLGCGYKAVDNAVQRLRKKARRALMRQEGAAL

SEQ ID NO: 2613 - protein, 95 aa, Artificial
  Substituion in SEQ ID NO 2602
MLDVLVDRTAPSVEDVVFGPPKGVSAEELVAWAERHWRLNLSELEREVWRLRIEGHSYTEIQRMLGCGYKAVDNAVQRLRKKARRALMRQEGAAI

SEQ ID NO: 2614 - DNA, 288 bp, Artificial
  Substituion in SEQ ID NO 2603
gtgctggacgtgctcgttgatcgtacggcaccgagtgtggaggatgtggtgttcgggccgcctaagggtgtatctgcggaagagctcgtggcatgggctgagcggcattggagacttaacttgtcggagctcgaacgcgaggtgtggcggttgcggatcgagggtcattcgtacacggagatcaatcggatgttgggatgcggatacaaggcggtggacaatgcggtgcagaggttaaggaaaaaagcgcgaagggcactcatgcgccaggaaggagcggcgttgtga

SEQ ID NO: 2615 - DNA, 288 bp, Artificial
  Substituion in SEQ ID NO 2603
gtgctggacgtgctcgttgatcgtacggcaccgagtgtggaggatgtggtgttcgggccgcctaagggtgtatctgcggaagagctcgtggcatgggctgagcggcattggagacttaacttgtcggagctcgaacgcgaggtgtggcggttgcggatcgagggtcattcgtacacggagatccagcggatgttgggatgcggatacaaggcggtggacaatgcggtgcagaggttaaaaaaaaaagcgcgaagggcactcatgcgccaggaaggagcggcgttgtga

SEQ ID NO: 2616 - DNA, 288 bp, Artificial
  Substituion in SEQ ID NO 2603
gtgctggacgtgctcgttgatcgtacggcaccgagtgtggaggatgtggtgttcgggccgcctaagggtgtatctgcggaagagctcgtggcatgggctgagcggcattggagaattaacttgtcggagctcgaacgcgaggtgtggcggttgcggatcgagggtcattcgtacacggagatccagcggatgttgggatgcggatacaaggcggtggacaatgcggtgcagaggttaaggaaaaaagcgcgaagggcactcatgcgccaggaaggagcggcgttgtga

SEQ ID NO: 2617 - DNA, 288 bp, Artificial
  Substituion in SEQ ID NO 2603
gtgctggacgtgctcgttgatcgtacggcaccgagtgtggaggatgtggtgttcgggccgcctaagggtgtatctgcggaagagctcgtggcatgggctgagaaacattggagacttaacttgtcggagctcgaacgcgaggtgtggcggttgcggatcgagggtcattcgtacacggagatccagcggatgttgggatgcggatacaaggcggtggacaatgcggtgcagaggttaaggaaaaaagcgcgaagggcactcatgcgccaggaaggagcggcgttgtga

SEQ ID NO: 2618 - DNA, 288 bp, Artificial
  Substituion in SEQ ID NO 2603
gtgctggacgtgctcgttgatcgtacggcaccgagtgtggaggatgtggtgttcgggccgcctaagggtgtatctgcggaagagctcgtggcatgggctgagcggcattggagacttaacttgtcggagctcgaacgcgaggtgtggcggttgcggatcgagggtcattcgtacacggagatccagcggatgttgggatgcggatacaaggcggtggacaatgcggtgcagaggttaaggaaaaaagcgcgaagggcactcatgcgccaggaaggagcggcgatttga

SEQ ID NO: 2619 - protein, 449 aa, Alicyclobacillus acidocaldarius
MEPSVVADVWKLYQEILEFAPVGVHAVDREGRTRVYNRVMGEIDGYRPDEVLEKNVFELYELDEETSTLWRALKTGHPVQIDEQVYVARNGRRVVTQNRTKPVVIAGEIIGAMEIAVPREAGGAQEAADARIRRRYSFADILGESRAMQRALDLAERAARMDLPVLLVGETGTGKELFAQAIHGASARKHGPFLAQNCAAWPEGLAESVLFGTRRGGFTGAVDRAGVFELACGGTLLLDEVHAMSPSVQAKLLRALQDGEVWPIGARRSVQTDVRVIAAMNVPPSAALSRGLVRPDLLYRIGAIAIHLPPLRERPEDIPLLAQAFLRRYGEARAVRLSSDAMAFLTSHDWPGNVRELEQTVRSALALWPEAREITSEMLRSAHPLLGEGAPRELERVARAARPSDDAIRRAYEAASGNLTHAAQALGISRQRMQYHVRRLGLRTSSQPK

SEQ ID NO: 2620 - DNA, 1350 bp, Alicyclobacillus acidocaldarius
atggaaccgagcgtggtggcggacgtgtggaagctgtatcaggagatcctcgaattcgcgccggtcggcgttcacgcggtcgatcgcgaagggcgcacgcgggtctacaaccgggtgatgggcgagatcgacgggtacaggccggacgaagtgctggagaaaaacgtgttcgaactgtacgagctcgacgaggagacgagcacgctctggcgggcgctgaagacggggcatccggtgcagattgacgagcaggtgtacgtggcgcgcaacgggcggcgcgtcgtgacgcagaatcgcacgaagccggtggtcatcgcgggcgagatcatcggcgcgatggagattgccgtgccgcgcgaggcgggaggcgcgcaggaagcggcagacgcgcggatcaggcgccgatactcgttcgcggacatcctgggcgagagccgggccatgcagagggcgctcgatctcgccgagcgcgcggcgcggatggacctgcccgtcctcctcgtgggcgagacgggcacgggcaaggaactgttcgcccaggccattcatggggcgagcgcgcgcaagcacggcccgtttttggcgcaaaactgcgcggcctggccagaggggctcgcggagagtgtgctcttcggcacgaggcggggcggattcacgggcgccgtggatcgcgcgggcgtgttcgagctggcctgcggggggacgctgttgctcgacgaggtgcacgcgatgtccccctccgtgcaggcgaagctgttgcgcgccctccaggacggcgaggtgtggccgattggcgcgaggcggtccgtccagacggacgtccgcgtgatcgccgcgatgaacgtgccgccaagcgccgcgttgagccgcgggctcgtgcggccggatctcctgtaccgcatcggcgccatcgccattcacctgccgccgcttcgggaaaggcctgaggacatcccgcttttggcccaggcgtttttgcgcaggtacggagaagcgcgcgccgtgcgcctctcgagcgacgcgatggcctttttgacgagccacgactggcccgggaatgtgcgcgagctcgagcagaccgtgcgatccgccctggccctctggccggaagcgcgcgaaatcacgtccgagatgctgcgatccgcgcatccgctcctcggtgaaggcgcgccgcgcgaattggagcgtgtggcgcgcgccgcgcgcccctcggacgacgccattcgccgggcgtacgaagcggcttcgggcaacctgacccacgcggcgcaggcgctcggcatcagccggcagcgcatgcagtaccacgtgcggcggcttgggttgagaacctcgtcgcagccgaagtga

SEQ ID NO: 2621 - protein, 449 aa, Bacillus sp. NRRL B-14911
ILEQILEHVDAGIHAIDHEGRTIIYNRKMAEIEGMDPESVIGRSLLEVFPFSRREDSTLLLALQNGKGTQPAKQTYFNSKGKEITAINHAIPILAAGKSLGAIEIAKDVSRIERLVKENLSRKNSDRYTFESIIGSSKAILEVVEAAKRAVRTTSPILIAGETGTGKELFAQSIHSGSLRSPGPFVAQNCAALPENLVESILFGTKKGAFTGAVDRPGLFEQAEGGTLLLDEINSMPAPLQAKLLRVLQEKKVRRIGDTKDREIDVRVVAAINEDPVDAIAEGRLRKDLYYRLSAVSLFIPPLRERKEDILLLSSFFIQKYNDWFGMEVPGLDEETEEQFLRYDWPGNIRELEHVIEGAMNMAEDDARITSEILPHHFRQKAETSHSFPGRNLGEPAGPQPSLSDYVASAEKAYINKVWREQDGNITRTAKILGMSRQNLQYRIKKHGL

SEQ ID NO: 2622 - protein, 438 aa, Bacillus coagulans 36D1
LYETIMNLVDAGIHAVDEEGRTMIYNQKMRDIEGMDSREVLYKKLEDVFRFRSSEESTLLKALKTGEESHLVKQTYFNNKGREITSVNHTYPFYYKGKLAGAVEIAEDITKIERLIRRNHESHTGYTFHHIIGKSKAISEVIEFSRRAARTSSYVLIIGETGTGKELFAQSIHYESERSRGPFIAQNCAALPDNLIESILFGTKKGAFTGAVDRAGLFEQADGGTLLLDEINALNIHLQAKLLRVLQEKKVKRIGGTQEKPVDVRVIATMNETPYEAIANHRLRKDLYYRLGVVTLFIPPLRDRLEDLPLLTGHFIQKYNPLFQMNVRGITPEVLTFFRSYRWPGNIRELEHMIEAAMNVMLDEDMIELRHLPMQYRQSGHFNSPAEKSPLLKDRLFEYEKHCILEALEANGSNISKAAEQLGLSRQSLQYRMKRLGI

SEQ ID NO: 2623 - protein, 460 aa, Bacillus pumilus SAFR-032
LYKQMLDLIDVGVHAIDENGHTVVYNKKMMEIESLKRSDVLHKNVLDFFAFQDEMHSTLVQALRTGKQTVHAKQTYHNYNGKEITTINHTYPLVRDGLIQGAVEISNDVTKLERLIHHNMKKKGSTRFTFESIIGQSPAFLEVIEHAKRATRTSSYVLIVGETGTGKELFAQSIHNGSSRSSGPFITQNCAALPDNLIESLLFGTQKGAFTGAADQPGLFEQAQGGTLLLDEINSLNPHLQAKLLRVLQEKRVRRLGSTKEIAVDVRVIANMNEDPVDAIASGRMRKDLFYRLGIVTLFIPPLSERKEDIPTFVNHFIQKYNELFQMKVKAADEEVLALFKAYDWPGNVRELEHVIEAGMNMMMDEDELSMHHLPYHFRFKQMEGRPPAQLQTNSLQQTVAADTFVYTSPEQTTDFQTQMERFEKQYIVHYLEKMDDNISQTAKLLGMSRQSLQYRMKKL

SEQ ID NO: 2624 - protein, 466 aa, Bacillus selenitireducens MLS10
MQPEKLTDTAFIHPVYRKLLDYLDIGIHMINTEGRSVIYNRKMSEMEDMNPKEVLNKRIMEIFLFDSEEESRLLQALNNNVVHKDAKQVYFNFKGQEITTVNNTFPLTVDGEKIGAVEIARDITKLERLSRETSRGASDARFTFDQIIGNSPAIEDVVENARRATRTTSSVLIYGETGTGKELFAQSIHNGSSRASKPFISQNCAALPDTLIEGILFGSVKGAFTGATDHPGLFEQANGGTLMLDEINSLSASLQAKLLRAIQEKTIRRIGDTKSRSVDVRIIATMNEDPVDALSKNKLREDLYYRLSVVSIVIPPLRHRKEDLTVLIAHFIRKYNRLFQMNIQEVTDDVFNLFSEYDWPGNVRELEHTIEGAMNLIYDDEPIGFQHLPLHLKHKFTQPPATSEGTERLFTQQPEPGLPLETYMDTVEKAYIQKSLTEAGGNISQAARTLGLKRQSLQYRMRKFNL

SEQ ID NO: 2625 - protein, 445 aa, Bacillus clausii KSM-K16
LYQMLIDEINVGIHVIDQDGHTIIYNKKMMEIESMVDTDVLHKNLLEVFTFHDDERSTLVQALKTGKVTKDVKQTYFNNKGEEITTINNTFPFIENGKITAAVEIAKDMTQLDHVIKKNVLRKRESHYTFDQIIGNSKAFLAVIEEAKRAARTSSSVLIVGETGTGKELFAQSIHYASPRSHAPFLAQNCAAIPENLMESLLFGTKKGAFTGALDTPGLFEQADGGTLLLDEINSLDPALQAKLLRVIQEKTIRRIGDTKDKKVDVRIIATINEDPIDMIAKQRLRKDLYYRLSVVTLFIPPLRERKEDILPLIEEFIHKYNTLFQMNVKTISEEAKAILFQHDWPGNARELEHTIEGTMNFISDETEIHIHNLPFRLRNRYQKEVKDTETGNLPAKTLQEKMAEVEKLYILQALRENNNNVSQTAKNLGMSRQNLQYRLKKFHL

SEQ ID NO: 2626 - protein, 449 aa, Artificial
  Substituion in SEQ ID NO 2619
MEPSVVADVWKLYQEILEFAPVGVHAVDREGRTRVYNRVMGEIDGYRPDEVLEKNVFELYELDEETSTLWRALKTGHPVQIDEQVYVARNGRRVVTQNRTKPVVIAGEIIGAMEIAVPREAGGAQEAADARIRRRYSFADILGESRAMQRALDLAERAARMDLPVLLVGETGTGKELFAQAIHGASARKHGPFLAQNCAAWPEGLAESVLFGTRRGGFTGAVDRAGVFELACGGTLLLDEVHAMSPSVQAKLLRALQDGDVWPIGARRSVQTDVRVIAAMNVPPSAALSRGLVRPDLLYRIGAIAIHLPPLRERPEDIPLLAQAFLRRYGEARAVRLSSDAMAFLTSHDWPGNVRELEQTVRSALALWPEAREITSEMLRSAHPLLGEGAPRELERVARAARPSDDAIRRAYEAASGNLTHAAQALGISRQRMQYHVRRLGLRTSSQPK

SEQ ID NO: 2627 - protein, 449 aa, Artificial
  Substituion in SEQ ID NO 2619
MEPSVVADVWKLYQEILEFAPVGVHAVDREGRTRIYNRVMGEIDGYRPDEVLEKNVFELYELDEETSTLWRALKTGHPVQIDEQVYVARNGRRVVTQNRTKPVVIAGEIIGAMEIAVPREAGGAQEAADARIRRRYSFADILGESRAMQRALDLAERAARMDLPVLLVGETGTGKELFAQAIHGASARKHGPFLAQNCAAWPEGLAESVLFGTRRGGFTGAVDRAGVFELACGGTLLLDEVHAMSPSVQAKLLRALQDGEVWPIGARRSVQTDVRVIAAMNVPPSAALSRGLVRPDLLYRIGAIAIHLPPLRERPEDIPLLAQAFLRRYGEARAVRLSSDAMAFLTSHDWPGNVRELEQTVRSALALWPEAREITSEMLRSAHPLLGEGAPRELERVARAARPSDDAIRRAYEAASGNLTHAAQALGISRQRMQYHVRRLGLRTSSQPK

SEQ ID NO: 2628 - protein, 449 aa, Artificial
  Substituion in SEQ ID NO 2619
MEPSVVADVWKLYQEILEFAPVGVHAVDREGRTRVYNRVMGEIDGYRPDEVLEKNVFELYELDEETSTLWRALKTGHPVQIDEQVYVARNGRRVVTQNRTKPVVIAGEIIGAMEIAVPREAGGAQEAADARIRRRYSFADILGESRAMQRALDLAERAARMDLPVLLVGETGTGKELFAQAIHGASARKHGPFLAQNCAAWPEGLAESVLFGTRRGGFTGAVDRAGVFELACGGTLLLDEVHAMSPSVQAKLLRALQDGEIWPIGARRSVQTDVRVIAAMNVPPSAALSRGLVRPDLLYRIGAIAIHLPPLRERPEDIPLLAQAFLRRYGEARAVRLSSDAMAFLTSHDWPGNVRELEQTVRSALALWPEAREITSEMLRSAHPLLGEGAPRELERVARAARPSDDAIRRAYEAASGNLTHAAQALGISRQRMQYHVRRLGLRTSSQPK

SEQ ID NO: 2629 - protein, 449 aa, Artificial
  Substituion in SEQ ID NO 2619
MEPSVVADVWKLYQEILEFAPVGVHAVDREGRTRVYNRVMGEIDGYRPDEVLEKNVFELYELDEETSTLWRALKTGHPVQIDEQVYVARNGRRVVTQNRTKPVVIAGEIIGAMEIAVPREAGGAQEAADARIRRRYSFADILGESRAMQRALDLAERAARMDLPVLLVGETGTGKELFAQAIHGASARKHGPFLAQNCAAWPEGLAESVLFGTRRGGFTGAVDRAGVFELACGGTLLLDEVHAMSPSVQAKLLRALQDGEVWPIGARRSVQTDVRVIAAMNVPPSAALSRGLVRPDLLYRIGAIAIHLPPLRERPEDIPLLAQAFLRKYGEARAVRLSSDAMAFLTSHDWPGNVRELEQTVRSALALWPEAREITSEMLRSAHPLLGEGAPRELERVARAARPSDDAIRRAYEAASGNLTHAAQALGISRQRMQYHVRRLGLRTSSQPK

SEQ ID NO: 2630 - protein, 449 aa, Artificial
  Substituion in SEQ ID NO 2619
MEPSVVADVWKLYQEILEFAPVGVHAVDREGRTRVYNRVMGEIDGYRPDEVLEKNVFELYELDEETSTLWRALKTGHPVQIDEQVYVARNGRRVVTQNRTKPVVIAGEIIGAMEIAVPREAGGAQEAADARIRRRYSFADILGESRAMQRALDLADRAARMDLPVLLVGETGTGKELFAQAIHGASARKHGPFLAQNCAAWPEGLAESVLFGTRRGGFTGAVDRAGVFELACGGTLLLDEVHAMSPSVQAKLLRALQDGEVWPIGARRSVQTDVRVIAAMNVPPSAALSRGLVRPDLLYRIGAIAIHLPPLRERPEDIPLLAQAFLRRYGEARAVRLSSDAMAFLTSHDWPGNVRELEQTVRSALALWPEAREITSEMLRSAHPLLGEGAPRELERVARAARPSDDAIRRAYEAASGNLTHAAQALGISRQRMQYHVRRLGLRTSSQPK

SEQ ID NO: 2631 - DNA, 1350 bp, Artificial
  Substituion in SEQ ID NO 2620
atggaaccgagcgtggtggcggacgtgtggaagctgtatcaggagatcctcgaattcgcgccggtcggcgttcacgcggtcgatcgcgaagggcgcacgcgggtctacaaccgggtgatgggcgagatcgacgggtacaggccggacgaagtgctggagaaaaacgtgttcgaactgtacgagctcgacgaggagacgagcacgctctggcgggcgctgaagacggggcatccggtgcagattgacgagcaggtgtacgtggcgcgcaacgggcggcgcgtcgtgacgcagaatcgcacgaagccggtggtcatcgcgggcgagatcatcggcgcgatggagattgccgtgccgcgcgaggcgggaggcgcgcaggaagcggcagacgcgcggatcaggcgccgatactcgttcgcggacatcctgggcgagagccgggccatgcagagggcgctcgatctcgccgagcgcgcggcgcggatggacctgcccgtcctcctcgtgggcgagacgggcacgggcaaggaactgttcgcccaggccattcatggggcgagcgcgcgcaagcacggcccgtttttggcgcaaaactgcgcggcctggccagaggggctcgcggagagtgtgctcttcggcacgaggcggggcggattcacgggcgccgtggatcgcgcgggcgtgttcgagctggcctgcggggggacgctgttgctcgacgaggtgcacgcgatgtccccctccgtgcaggcgaagctgttgcgcgccctccaggacggcgatgtgtggccgattggcgcgaggcggtccgtccagacggacgtccgcgtgatcgccgcgatgaacgtgccgccaagcgccgcgttgagccgcgggctcgtgcggccggatctcctgtaccgcatcggcgccatcgccattcacctgccgccgcttcgggaaaggcctgaggacatcccgcttttggcccaggcgtttttgcgcaggtacggagaagcgcgcgccgtgcgcctctcgagcgacgcgatggcctttttgacgagccacgactggcccgggaatgtgcgcgagctcgagcagaccgtgcgatccgccctggccctctggccggaagcgcgcgaaatcacgtccgagatgctgcgatccgcgcatccgctcctcggtgaaggcgcgccgcgcgaattggagcgtgtggcgcgcgccgcgcgcccctcggacgacgccattcgccgggcgtacgaagcggcttcgggcaacctgacccacgcggcgcaggcgctcggcatcagccggcagcgcatgcagtaccacgtgcggcggcttgggttgagaacctcgtcgcagccgaagtga

SEQ ID NO: 2632 - DNA, 1350 bp, Artificial
  Substituion in SEQ ID NO 2620
atggaaccgagcgtggtggcggacgtgtggaagctgtatcaggagatcctcgaattcgcgccggtcggcgttcacgcggtcgatcgcgaagggcgcacgcggatttacaaccgggtgatgggcgagatcgacgggtacaggccggacgaagtgctggagaaaaacgtgttcgaactgtacgagctcgacgaggagacgagcacgctctggcgggcgctgaagacggggcatccggtgcagattgacgagcaggtgtacgtggcgcgcaacgggcggcgcgtcgtgacgcagaatcgcacgaagccggtggtcatcgcgggcgagatcatcggcgcgatggagattgccgtgccgcgcgaggcgggaggcgcgcaggaagcggcagacgcgcggatcaggcgccgatactcgttcgcggacatcctgggcgagagccgggccatgcagagggcgctcgatctcgccgagcgcgcggcgcggatggacctgcccgtcctcctcgtgggcgagacgggcacgggcaaggaactgttcgcccaggccattcatggggcgagcgcgcgcaagcacggcccgtttttggcgcaaaactgcgcggcctggccagaggggctcgcggagagtgtgctcttcggcacgaggcggggcggattcacgggcgccgtggatcgcgcgggcgtgttcgagctggcctgcggggggacgctgttgctcgacgaggtgcacgcgatgtccccctccgtgcaggcgaagctgttgcgcgccctccaggacggcgaggtgtggccgattggcgcgaggcggtccgtccagacggacgtccgcgtgatcgccgcgatgaacgtgccgccaagcgccgcgttgagccgcgggctcgtgcggccggatctcctgtaccgcatcggcgccatcgccattcacctgccgccgcttcgggaaaggcctgaggacatcccgcttttggcccaggcgtttttgcgcaggtacggagaagcgcgcgccgtgcgcctctcgagcgacgcgatggcctttttgacgagccacgactggcccgggaatgtgcgcgagctcgagcagaccgtgcgatccgccctggccctctggccggaagcgcgcgaaatcacgtccgagatgctgcgatccgcgcatccgctcctcggtgaaggcgcgccgcgcgaattggagcgtgtggcgcgcgccgcgcgcccctcggacgacgccattcgccgggcgtacgaagcggcttcgggcaacctgacccacgcggcgcaggcgctcggcatcagccggcagcgcatgcagtaccacgtgcggcggcttgggttgagaacctcgtcgcagccgaagtga

SEQ ID NO: 2633 - DNA, 1350 bp, Artificial
  Substituion in SEQ ID NO 2620
atggaaccgagcgtggtggcggacgtgtggaagctgtatcaggagatcctcgaattcgcgccggtcggcgttcacgcggtcgatcgcgaagggcgcacgcgggtctacaaccgggtgatgggcgagatcgacgggtacaggccggacgaagtgctggagaaaaacgtgttcgaactgtacgagctcgacgaggagacgagcacgctctggcgggcgctgaagacggggcatccggtgcagattgacgagcaggtgtacgtggcgcgcaacgggcggcgcgtcgtgacgcagaatcgcacgaagccggtggtcatcgcgggcgagatcatcggcgcgatggagattgccgtgccgcgcgaggcgggaggcgcgcaggaagcggcagacgcgcggatcaggcgccgatactcgttcgcggacatcctgggcgagagccgggccatgcagagggcgctcgatctcgccgagcgcgcggcgcggatggacctgcccgtcctcctcgtgggcgagacgggcacgggcaaggaactgttcgcccaggccattcatggggcgagcgcgcgcaagcacggcccgtttttggcgcaaaactgcgcggcctggccagaggggctcgcggagagtgtgctcttcggcacgaggcggggcggattcacgggcgccgtggatcgcgcgggcgtgttcgagctggcctgcggggggacgctgttgctcgacgaggtgcacgcgatgtccccctccgtgcaggcgaagctgttgcgcgccctccaggacggcgagatttggccgattggcgcgaggcggtccgtccagacggacgtccgcgtgatcgccgcgatgaacgtgccgccaagcgccgcgttgagccgcgggctcgtgcggccggatctcctgtaccgcatcggcgccatcgccattcacctgccgccgcttcgggaaaggcctgaggacatcccgcttttggcccaggcgtttttgcgcaggtacggagaagcgcgcgccgtgcgcctctcgagcgacgcgatggcctttttgacgagccacgactggcccgggaatgtgcgcgagctcgagcagaccgtgcgatccgccctggccctctggccggaagcgcgcgaaatcacgtccgagatgctgcgatccgcgcatccgctcctcggtgaaggcgcgccgcgcgaattggagcgtgtggcgcgcgccgcgcgcccctcggacgacgccattcgccgggcgtacgaagcggcttcgggcaacctgacccacgcggcgcaggcgctcggcatcagccggcagcgcatgcagtaccacgtgcggcggcttgggttgagaacctcgtcgcagccgaagtga

SEQ ID NO: 2634 - DNA, 1350 bp, Artificial
  Substituion in SEQ ID NO 2620
atggaaccgagcgtggtggcggacgtgtggaagctgtatcaggagatcctcgaattcgcgccggtcggcgttcacgcggtcgatcgcgaagggcgcacgcgggtctacaaccgggtgatgggcgagatcgacgggtacaggccggacgaagtgctggagaaaaacgtgttcgaactgtacgagctcgacgaggagacgagcacgctctggcgggcgctgaagacggggcatccggtgcagattgacgagcaggtgtacgtggcgcgcaacgggcggcgcgtcgtgacgcagaatcgcacgaagccggtggtcatcgcgggcgagatcatcggcgcgatggagattgccgtgccgcgcgaggcgggaggcgcgcaggaagcggcagacgcgcggatcaggcgccgatactcgttcgcggacatcctgggcgagagccgggccatgcagagggcgctcgatctcgccgagcgcgcggcgcggatggacctgcccgtcctcctcgtgggcgagacgggcacgggcaaggaactgttcgcccaggccattcatggggcgagcgcgcgcaagcacggcccgtttttggcgcaaaactgcgcggcctggccagaggggctcgcggagagtgtgctcttcggcacgaggcggggcggattcacgggcgccgtggatcgcgcgggcgtgttcgagctggcctgcggggggacgctgttgctcgacgaggtgcacgcgatgtccccctccgtgcaggcgaagctgttgcgcgccctccaggacggcgaggtgtggccgattggcgcgaggcggtccgtccagacggacgtccgcgtgatcgccgcgatgaacgtgccgccaagcgccgcgttgagccgcgggctcgtgcggccggatctcctgtaccgcatcggcgccatcgccattcacctgccgccgcttcgggaaaggcctgaggacatcccgcttttggcccaggcgtttttgcgcaaatacggagaagcgcgcgccgtgcgcctctcgagcgacgcgatggcctttttgacgagccacgactggcccgggaatgtgcgcgagctcgagcagaccgtgcgatccgccctggccctctggccggaagcgcgcgaaatcacgtccgagatgctgcgatccgcgcatccgctcctcggtgaaggcgcgccgcgcgaattggagcgtgtggcgcgcgccgcgcgcccctcggacgacgccattcgccgggcgtacgaagcggcttcgggcaacctgacccacgcggcgcaggcgctcggcatcagccggcagcgcatgcagtaccacgtgcggcggcttgggttgagaacctcgtcgcagccgaagtga

SEQ ID NO: 2635 - DNA, 1350 bp, Artificial
  Substituion in SEQ ID NO 2620
atggaaccgagcgtggtggcggacgtgtggaagctgtatcaggagatcctcgaattcgcgccggtcggcgttcacgcggtcgatcgcgaagggcgcacgcgggtctacaaccgggtgatgggcgagatcgacgggtacaggccggacgaagtgctggagaaaaacgtgttcgaactgtacgagctcgacgaggagacgagcacgctctggcgggcgctgaagacggggcatccggtgcagattgacgagcaggtgtacgtggcgcgcaacgggcggcgcgtcgtgacgcagaatcgcacgaagccggtggtcatcgcgggcgagatcatcggcgcgatggagattgccgtgccgcgcgaggcgggaggcgcgcaggaagcggcagacgcgcggatcaggcgccgatactcgttcgcggacatcctgggcgagagccgggccatgcagagggcgctcgatctcgccgatcgcgcggcgcggatggacctgcccgtcctcctcgtgggcgagacgggcacgggcaaggaactgttcgcccaggccattcatggggcgagcgcgcgcaagcacggcccgtttttggcgcaaaactgcgcggcctggccagaggggctcgcggagagtgtgctcttcggcacgaggcggggcggattcacgggcgccgtggatcgcgcgggcgtgttcgagctggcctgcggggggacgctgttgctcgacgaggtgcacgcgatgtccccctccgtgcaggcgaagctgttgcgcgccctccaggacggcgaggtgtggccgattggcgcgaggcggtccgtccagacggacgtccgcgtgatcgccgcgatgaacgtgccgccaagcgccgcgttgagccgcgggctcgtgcggccggatctcctgtaccgcatcggcgccatcgccattcacctgccgccgcttcgggaaaggcctgaggacatcccgcttttggcccaggcgtttttgcgcaggtacggagaagcgcgcgccgtgcgcctctcgagcgacgcgatggcctttttgacgagccacgactggcccgggaatgtgcgcgagctcgagcagaccgtgcgatccgccctggccctctggccggaagcgcgcgaaatcacgtccgagatgctgcgatccgcgcatccgctcctcggtgaaggcgcgccgcgcgaattggagcgtgtggcgcgcgccgcgcgcccctcggacgacgccattcgccgggcgtacgaagcggcttcgggcaacctgacccacgcggcgcaggcgctcggcatcagccggcagcgcatgcagtaccacgtgcggcggcttgggttgagaacctcgtcgcagccgaagtga

SEQ ID NO: 2636 - protein, 567 aa, Alicyclobacillus acidocaldarius
MIRRARIRAGSTCTIEANFVPNGQRRCRAGGAADRTGAKRALRFSDSDCKLGLHADLDRRHKALCILMQARLEHAERRRGMRAQDAEARRTLLEAALDALDEGVHVVDAEGVTVFYNRKMADIEAMSRQDVMGRRIDDVFSFPDAAGSTLLDAVRRGVRRDDVRQTYFNRRGQAITTVNRTFPVYADGRILGAVEIARDVTSVEQLRSTAFGQAGVRYTFASIIAESLAMREVLEQARRAARTDSSVLIIGETGTGKELLAQGIHAASPRRDGPFVSQNLAAIPDTLVEGILFGTARGAFTGAVDRPGLIEQANGGTLLLDELNAMPAPLQAKLLRVLQERVVRRVGDLKDRPVDVRILATMNEDPGRAIREGRLRADLFYRLSVVTLTVPPLRSRREDIPPLVAHFIRRLNGAFGLRVEGCEPRLMDAFLAYEWPGNVRELEHVIEGAMNLMEDEAKIGFQHLPGHVRRRLEQALDEMQGNEDQGGRDARAEVVREPTPQGASDEIPRGRPSFRDLVRDYARTVLQAALEETRGNVSEAARRLGMSRQNLQYWLREVAVDPARYRR

SEQ ID NO: 2637 - DNA, 1704 bp, Alicyclobacillus acidocaldarius
gtgatacgtagggccaggatccgcgcaggctctacctgtactatcgaagcaaactttgtgccaaatggccagcgcaggtgtcgggcaggtggcgcagccgaccgcacgggcgcaaaaagggccttgcgcttttcggactcggactgcaaactaggcttgcatgccgatctcgacaggcgccacaaggctctttgtatattgatgcaagcgaggctggaacatgcggagaggaggcgaggaatgcgcgcgcaagatgcggaggctcgccgcacgttgttggaggcggcgctcgacgccctggacgaaggcgtgcacgtggtggacgccgagggcgtgaccgtgttttacaaccggaagatggcggacatcgaggcgatgtcgaggcaggacgtgatggggcgacggatcgacgacgtgttctcgtttccagacgccgcggggagcacgctgctcgacgcggtgcggcgaggcgtgcggcgggacgacgtgcgacagacctacttcaaccggcgggggcaggccatcacgaccgtgaatcggacgtttccggtgtatgcggacgggaggattctgggcgcggtcgagatcgcccgggatgtgacgagcgtcgaacaactgaggagcacggccttcgggcaggcgggcgtgcgctacacgttcgcgtccatcatcgcggagagccttgcgatgcgcgaggtcctcgaacaggcgcggcgcgccgcgcgcacggactcatcggtgctcatcattggggaaacgggcacgggcaaggagcttctggcgcagggcatccacgcggccagcccgaggcgggacgggccgtttgtgtcgcagaacctcgccgccattccggacacgctcgtcgagggcatcttgtttggcacggcgcgcggggcgttcacgggcgcggtggatcggcctgggctcatcgagcaggcgaacgggggcacgcttctcctggacgagctgaacgccatgcccgcgccgcttcaggccaagctgctccgcgtgctccaggagcgcgtggtgcgccgcgtgggggatctgaaggatcgccctgtggatgtgcgcatcctcgccacgatgaacgaggatccgggccgcgccatccgcgagggccggttgcgggctgatctgttctaccgtctgagcgtcgtgacgctcacggtgcctcctctgcgatcccgccgcgaggacattccgccgctcgtggctcacttcatccgccggctgaacggcgcgtttgggctccgggtggaaggctgcgagccgaggctcatggacgcgttcctggcgtacgagtggcccggcaacgtccgcgagctggagcacgtgattgagggcgccatgaacctcatggaggatgaggcgaagatcgggtttcagcacctgccgggccacgtgcgtcgcaggctggaacaggcgctcgatgagatgcaggggaacgaggatcagggcgggcgtgacgcgcgcgccgaggtggtgcgcgagccgacgcctcaaggcgcttcggatgagatcccgcgaggacgcccatcctttcgcgatctcgtccgcgattacgcccggaccgtgctgcaggcggcgctcgaggagacgcgcgggaacgtctcggaggcggcgcgaaggcttggcatgtcgcgccagaacctgcagtactggctgcgggaggtggcggtggatccagcgcggtaccgccgctga

SEQ ID NO: 2638 - protein, 451 aa, Bacillus halodurans C-125
GIHVIDTFGQTIIYNKKMMEIESLTKEDVENKDFLDIFMFEEGQGSTLLEALYKKKHSKDVKQTYFNNRGKEITTINNTFPLYENGQVIGAIEISKDVTKLERLIRKNMESKGNTRYTFDSIIGESTAIREVIENTKRATRTASSVLIVGETGTGKELFAQSIHNGSDRSKGPFISQNCAAMPETLIESLLFGTKKGAYTGAIERPGLFEEAEGGTLLLDEINSLSPPLQAKLLRAIQEKQIRRVGDTVDRKVNVRILSTINEDPIEAIASGRLRKDLYYRLGVVTLFIPPLRERKEDIVPLVDHFIAKYNERFQMEVKGLSDEVTQLLLQYDWPGNVRELEHIIEGAMNLMIGEDLIDVRHLPFHFRQKSLSAPLSSQITSVYETGPSDAIEHSVEEQQPLRDLKDYLLEAEKMYIKKALERNKYHVTKTAEKLGLSRQSLQYRMKRLGI

SEQ ID NO: 2639 - protein, 438 aa, Bacillus selenitireducens MLS10
GIHMINTEGRSVIYNRKMSEMEDMNPKEVLNKRIMEIFLFDSEEESRLLQALNNNVVHKDAKQVYFNFKGQEITTVNNTFPLTVDGEKIGAVEIARDITKLERLSRETSRGASDARFTFDQIIGNSPAIEDVVENARRATRTTSSVLIYGETGTGKELFAQSIHNGSSRASKPFISQNCAALPDTLIEGILFGSVKGAFTGATDHPGLFEQANGGTLMLDEINSLSASLQAKLLRAIQEKTIRRIGDTKSRSVDVRIIATMNEDPVDALSKNKLREDLYYRLSVVSIVIPPLRHRKEDLTVLIAHFIRKYNRLFQMNIQEVTDDVFNLFSEYDWPGNVRELEHTIEGAMNLIYDDEPIGFQHLPLHLKHKFTQPPATSEGTERLFTQQPEPGLPLETYMDTVEKAYIQKSLTEAGGNISQAARTLGLKRQSLQYRMRK

SEQ ID NO: 2640 - protein, 435 aa, Bacillus sp. NRRL B-14911
GIHAIDHEGRTIIYNRKMAEIEGMDPESVIGRSLLEVFPFSRREDSTLLLALQNGKGTQPAKQTYFNSKGKEITAINHAIPILAAGKSLGAIEIAKDVSRIERLVKENLSRKNSDRYTFESIIGSSKAILEVVEAAKRAVRTTSPILIAGETGTGKELFAQSIHSGSLRSPGPFVAQNCAALPENLVESILFGTKKGAFTGAVDRPGLFEQAEGGTLLLDEINSMPAPLQAKLLRVLQEKKVRRIGDTKDREIDVRVVAAINEDPVDAIAEGRLRKDLYYRLSAVSLFIPPLRERKEDILLLSSFFIQKYNDWFGMEVPGLDEETEEQFLRYDWPGNIRELEHVIEGAMNMAEDDARITSEILPHHFRQKAETSHSFPGRNLGEPAGPQPSLSDYVASAEKAYINKVWREQDGNITRTAKILGMSRQNLQYRIKK

SEQ ID NO: 2641 - protein, 439 aa, Bacillus licheniformis ATCC 14580
GLHVVDENGTSVVYNKKMSQIEGMDVGDVLGKNVLDVFTFASQHDSTLLQALHHGKTNKNVKQTYFNNKGQEITTVNHTFPIMENGNTKGAVEIAKDVTKLERLIRENMNKTESTKYTFDSLIGVSPAFKEVIEHAKRATRTSSSILIVGDTGTGKELFAQSIHNGSQRSTGPFISQNCAALPESLVEGLLFGTVKGAFTGAVDRPGLFEQADGGTLLLDEINSLDFRLQAKLLRAIQEKTIRRIGASKDTPIDVRIIATMNEDPVDAVSGQRLRKDLYYRLSVVTLFIPPLKDRKEDIMPLTQHFIDKYNALFQMEVKGFEEEVRRFLLSYDWPGNVRELEHLIEGAMNLMSYEDKIELTHLPLQYRTKPAAKEQLPQQGYDLFAPLPSASAAPLKEQIENAEKYYIQKTVKKCNYNVSQAARVLGISRQSLQYRLKK

SEQ ID NO: 2642 - protein, 439 aa, Bacillus licheniformis ATCC 14580; identical to SEQ ID NO: 2641

SEQ ID NO: 2643 - protein, 567 aa, Artificial
  Substituion in SEQ ID NO 2636
MIRRARIRAGSTCTIEANFVPNGQRRCRAGGAADRTGAKRALRFSDSDCKLGLHADLDRRHKALCILMQARLEHAERRRGMRAQDAEARRTLLEAALDALDEGVHVVDAEGVTVFYNRKMADIEAMSRQDVMGRRIEDVFSFPDAAGSTLLDAVRRGVRRDDVRQTYFNRRGQAITTVNRTFPVYADGRILGAVEIARDVTSVEQLRSTAFGQAGVRYTFASIIAESLAMREVLEQARRAARTDSSVLIIGETGTGKELLAQGIHAASPRRDGPFVSQNLAAIPDTLVEGILFGTARGAFTGAVDRPGLIEQANGGTLLLDELNAMPAPLQAKLLRVLQERVVRRVGDLKDRPVDVRILATMNEDPGRAIREGRLRADLFYRLSVVTLTVPPLRSRREDIPPLVAHFIRRLNGAFGLRVEGCEPRLMDAFLAYEWPGNVRELEHVIEGAMNLMEDEAKIGFQHLPGHVRRRLEQALDEMQGNEDQGGRDARAEVVREPTPQGASDEIPRGRPSFRDLVRDYARTVLQAALEETRGNVSEAARRLGMSRQNLQYWLREVAVDPARYRR

SEQ ID NO: 2644 - protein, 567 aa, Artificial
  Substituion in SEQ ID NO 2636
MIRRARIRAGSTCTIEANFVPNGQRRCRAGGAADRTGAKRALRFSDSDCKLGLHADLDRRHKALCILMQARLEHAERRRGMRAQDAEARRTLLEAALDALDEGVHVVDAEGVTVFYNRKMADIEAMSRQDVMGRRIDDVFSFPDAAGSTLLDAVRRGVRRDDVRQTYFNRRGQAITTVNRTFPVYADGRILGAVEIARDVTSVEQLRSTAFGQAGVRYTFASIIAESLAMREVLEQARRAARTDSSVLIIGETGTGKELLAQGIHAASPRRDGPFVSQNLAAIPDTLVEGILFGTARGAFTGAVDRPGLIEQANGGTLLLDELNAMPAPLQAKLLRVLQERVVRRVGDLKDRPVDVRILATMNEDPGRAIREGRLRADLFYRLSVVTLTVPPLRSRREDIPPLVAHFIRRLNGAFGLRVEGCEPRLMDAFLAYEWPGNVRELEHVIEGAMNLMDDEAKIGFQHLPGHVRRRLEQALDEMQGNEDQGGRDARAEVVREPTPQGASDEIPRGRPSFRDLVRDYARTVLQAALEETRGNVSEAARRLGMSRQNLQYWLREVAVDPARYRR

SEQ ID NO: 2645 - protein, 567 aa, Artificial
  Substituion in SEQ ID NO 2636
MIRRARIRAGSTCTIEANFVPNGQRRCRAGGAADRTGAKRALRFSDSDCKLGLHADLDRRHKALCILMQARLEHAERRRGMRAQDAEARRTLLEAALDALDEGVHVVDAEGVTVFYNRKMADIEAMSRQDVMGRRIDDVFSFPDAAGSTLLDAVRRGVRRDEVRQTYFNRRGQAITTVNRTFPVYADGRILGAVEIARDVTSVEQLRSTAFGQAGVRYTFASIIAESLAMREVLEQARRAARTDSSVLIIGETGTGKELLAQGIHAASPRRDGPFVSQNLAAIPDTLVEGILFGTARGAFTGAVDRPGLIEQANGGTLLLDELNAMPAPLQAKLLRVLQERVVRRVGDLKDRPVDVRILATMNEDPGRAIREGRLRADLFYRLSVVTLTVPPLRSRREDIPPLVAHFIRRLNGAFGLRVEGCEPRLMDAFLAYEWPGNVRELEHVIEGAMNLMEDEAKIGFQHLPGHVRRRLEQALDEMQGNEDQGGRDARAEVVREPTPQGASDEIPRGRPSFRDLVRDYARTVLQAALEETRGNVSEAARRLGMSRQNLQYWLREVAVDPARYRR

SEQ ID NO: 2646 - protein, 567 aa, Artificial
  Substituion in SEQ ID NO 2636
MIRRARIRAGSTCTIEANFVPNGQRRCRAGGAADRTGAKRALRFSDSDCKLGLHADLDRRHKALCILMQARLEHAERRRGMRAQDAEARRTLLEAALDALDEGVHVVDAEGVTVFYNRKMADIEAMSRQDVMGRRIDDVFSFPDAAGSTLLDAVRRGVRRDDVRQTYFNRRGQAITTVNRTFPVYADGRILGAVEIARDVTSVEQLRSTAFGQAGVRYTFASIIAESLAMREVLEQARRAARTDSSVLIIGETGTGKELLAQGIHAASPRRDGPFVSQNLAAIPDTLVEGILFGTARGAFTGAVDRPGLIEQANGGTLLLDELNAMPAPLQAKLLRVLQERVVRRVGDLKDRPVDVRILATMNEDPGRAIREGRLRADLFYRLSVVTLTIPPLRSRREDIPPLVAHFIRRLNGAFGLRVEGCEPRLMDAFLAYEWPGNVRELEHVIEGAMNLMEDEAKIGFQHLPGHVRRRLEQALDEMQGNEDQGGRDARAEVVREPTPQGASDEIPRGRPSFRDLVRDYARTVLQAALEETRGNVSEAARRLGMSRQNLQYWLREVAVDPARYRR

SEQ ID NO: 2647 - protein, 567 aa, Artificial
  Substituion in SEQ ID NO 2636
MIRRARIRAGSTCTIEANFVPNGQRRCRAGGAADRTGAKRALRFSDSDCKLGLHADLDRRHKALCILMQARLEHAERRRGMRAQDAEARRTLLEAALDALDEGVHVVDAEGVTVFYNRKMADIEAMSRQDVMGRRIDDVFSFPDAAGSTLLDAVRRGVRRDDVRQTYFNRRGQAITTVNRTFPVYADGRILGAVEIARDVTSVEQLRSTAFGQAGVRYTFASIIAESLAMREVLEQARRAARTDSSVLIIGETGTGKELLAQGIHAASPRRDGPFVSQNLAAIPDTLVEGILFGTARGAFTGAVDRPGLIEQANGGTLLLDELNAMPAPLQAKLLRVLQERVVRRVGDLKDRPVDVRILATMNEDPGRAIRDGRLRADLFYRLSVVTLTVPPLRSRREDIPPLVAHFIRRLNGAFGLRVEGCEPRLMDAFLAYEWPGNVRELEHVIEGAMNLMEDEAKIGFQHLPGHVRRRLEQALDEMQGNEDQGGRDARAEVVREPTPQGASDEIPRGRPSFRDLVRDYARTVLQAALEETRGNVSEAARRLGMSRQNLQYWLREVAVDPARYRR

SEQ ID NO: 2648 - DNA, 1704 bp, Artificial
  Substituion in SEQ ID NO 2637
gtgatacgtagggccaggatccgcgcaggctctacctgtactatcgaagcaaactttgtgccaaatggccagcgcaggtgtcgggcaggtggcgcagccgaccgcacgggcgcaaaaagggccttgcgcttttcggactcggactgcaaactaggcttgcatgccgatctcgacaggcgccacaaggctctttgtatattgatgcaagcgaggctggaacatgcggagaggaggcgaggaatgcgcgcgcaagatgcggaggctcgccgcacgttgttggaggcggcgctcgacgccctggacgaaggcgtgcacgtggtggacgccgagggcgtgaccgtgttttacaaccggaagatggcggacatcgaggcgatgtcgaggcaggacgtgatggggcgacggatcgaagacgtgttctcgtttccagacgccgcggggagcacgctgctcgacgcggtgcggcgaggcgtgcggcgggacgacgtgcgacagacctacttcaaccggcgggggcaggccatcacgaccgtgaatcggacgtttccggtgtatgcggacgggaggattctgggcgcggtcgagatcgcccgggatgtgacgagcgtcgaacaactgaggagcacggccttcgggcaggcgggcgtgcgctacacgttcgcgtccatcatcgcggagagccttgcgatgcgcgaggtcctcgaacaggcgcggcgcgccgcgcgcacggactcatcggtgctcatcattggggaaacgggcacgggcaaggagcttctggcgcagggcatccacgcggccagcccgaggcgggacgggccgtttgtgtcgcagaacctcgccgccattccggacacgctcgtcgagggcatcttgtttggcacggcgcgcggggcgttcacgggcgcggtggatcggcctgggctcatcgagcaggcgaacgggggcacgcttctcctggacgagctgaacgccatgcccgcgccgcttcaggccaagctgctccgcgtgctccaggagcgcgtggtgcgccgcgtgggggatctgaaggatcgccctgtggatgtgcgcatcctcgccacgatgaacgaggatccgggccgcgccatccgcgagggccggttgcgggctgatctgttctaccgtctgagcgtcgtgacgctcacggtgcctcctctgcgatcccgccgcgaggacattccgccgctcgtggctcacttcatccgccggctgaacggcgcgtttgggctccgggtggaaggctgcgagccgaggctcatggacgcgttcctggcgtacgagtggcccggcaacgtccgcgagctggagcacgtgattgagggcgccatgaacctcatggaggatgaggcgaagatcgggtttcagcacctgccgggccacgtgcgtcgcaggctggaacaggcgctcgatgagatgcaggggaacgaggatcagggcgggcgtgacgcgcgcgccgaggtggtgcgcgagccgacgcctcaaggcgcttcggatgagatcccgcgaggacgcccatcctttcgcgatctcgtccgcgattacgcccggaccgtgctgcaggcggcgctcgaggagacgcgcgggaacgtctcggaggcggcgcgaaggcttggcatgtcgcgccagaacctgcagtactggctgcgggaggtggcggtggatccagcgcggtaccgccgctga

SEQ ID NO: 2649 - DNA, 1704 bp, Artificial
  Substituion in SEQ ID NO 2637
gtgatacgtagggccaggatccgcgcaggctctacctgtactatcgaagcaaactttgtgccaaatggccagcgcaggtgtcgggcaggtggcgcagccgaccgcacgggcgcaaaaagggccttgcgcttttcggactcggactgcaaactaggcttgcatgccgatctcgacaggcgccacaaggctctttgtatattgatgcaagcgaggctggaacatgcggagaggaggcgaggaatgcgcgcgcaagatgcggaggctcgccgcacgttgttggaggcggcgctcgacgccctggacgaaggcgtgcacgtggtggacgccgagggcgtgaccgtgttttacaaccggaagatggcggacatcgaggcgatgtcgaggcaggacgtgatggggcgacggatcgacgacgtgttctcgtttccagacgccgcggggagcacgctgctcgacgcggtgcggcgaggcgtgcggcgggacgacgtgcgacagacctacttcaaccggcgggggcaggccatcacgaccgtgaatcggacgtttccggtgtatgcggacgggaggattctgggcgcggtcgagatcgcccgggatgtgacgagcgtcgaacaactgaggagcacggccttcgggcaggcgggcgtgcgctacacgttcgcgtccatcatcgcggagagccttgcgatgcgcgaggtcctcgaacaggcgcggcgcgccgcgcgcacggactcatcggtgctcatcattggggaaacgggcacgggcaaggagcttctggcgcagggcatccacgcggccagcccgaggcgggacgggccgtttgtgtcgcagaacctcgccgccattccggacacgctcgtcgagggcatcttgtttggcacggcgcgcggggcgttcacgggcgcggtggatcggcctgggctcatcgagcaggcgaacgggggcacgcttctcctggacgagctgaacgccatgcccgcgccgcttcaggccaagctgctccgcgtgctccaggagcgcgtggtgcgccgcgtgggggatctgaaggatcgccctgtggatgtgcgcatcctcgccacgatgaacgaggatccgggccgcgccatccgcgagggccggttgcgggctgatctgttctaccgtctgagcgtcgtgacgctcacggtgcctcctctgcgatcccgccgcgaggacattccgccgctcgtggctcacttcatccgccggctgaacggcgcgtttgggctccgggtggaaggctgcgagccgaggctcatggacgcgttcctggcgtacgagtggcccggcaacgtccgcgagctggagcacgtgattgagggcgccatgaacctcatggatgatgaggcgaagatcgggtttcagcacctgccgggccacgtgcgtcgcaggctggaacaggcgctcgatgagatgcaggggaacgaggatcagggcgggcgtgacgcgcgcgccgaggtggtgcgcgagccgacgcctcaaggcgcttcggatgagatcccgcgaggacgcccatcctttcgcgatctcgtccgcgattacgcccggaccgtgctgcaggcggcgctcgaggagacgcgcgggaacgtctcggaggcggcgcgaaggcttggcatgtcgcgccagaacctgcagtactggctgcgggaggtggcggtggatccagcgcggtaccgccgctga

SEQ ID NO: 2650 - DNA, 1704 bp, Artificial
  Substituion in SEQ ID NO 2637
gtgatacgtagggccaggatccgcgcaggctctacctgtactatcgaagcaaactttgtgccaaatggccagcgcaggtgtcgggcaggtggcgcagccgaccgcacgggcgcaaaaagggccttgcgcttttcggactcggactgcaaactaggcttgcatgccgatctcgacaggcgccacaaggctctttgtatattgatgcaagcgaggctggaacatgcggagaggaggcgaggaatgcgcgcgcaagatgcggaggctcgccgcacgttgttggaggcggcgctcgacgccctggacgaaggcgtgcacgtggtggacgccgagggcgtgaccgtgttttacaaccggaagatggcggacatcgaggcgatgtcgaggcaggacgtgatggggcgacggatcgacgacgtgttctcgtttccagacgccgcggggagcacgctgctcgacgcggtgcggcgaggcgtgcggcgggacgaagtgcgacagacctacttcaaccggcgggggcaggccatcacgaccgtgaatcggacgtttccggtgtatgcggacgggaggattctgggcgcggtcgagatcgcccgggatgtgacgagcgtcgaacaactgaggagcacggccttcgggcaggcgggcgtgcgctacacgttcgcgtccatcatcgcggagagccttgcgatgcgcgaggtcctcgaacaggcgcggcgcgccgcgcgcacggactcatcggtgctcatcattggggaaacgggcacgggcaaggagcttctggcgcagggcatccacgcggccagcccgaggcgggacgggccgtttgtgtcgcagaacctcgccgccattccggacacgctcgtcgagggcatcttgtttggcacggcgcgcggggcgttcacgggcgcggtggatcggcctgggctcatcgagcaggcgaacgggggcacgcttctcctggacgagctgaacgccatgcccgcgccgcttcaggccaagctgctccgcgtgctccaggagcgcgtggtgcgccgcgtgggggatctgaaggatcgccctgtggatgtgcgcatcctcgccacgatgaacgaggatccgggccgcgccatccgcgagggccggttgcgggctgatctgttctaccgtctgagcgtcgtgacgctcacggtgcctcctctgcgatcccgccgcgaggacattccgccgctcgtggctcacttcatccgccggctgaacggcgcgtttgggctccgggtggaaggctgcgagccgaggctcatggacgcgttcctggcgtacgagtggcccggcaacgtccgcgagctggagcacgtgattgagggcgccatgaacctcatggaggatgaggcgaagatcgggtttcagcacctgccgggccacgtgcgtcgcaggctggaacaggcgctcgatgagatgcaggggaacgaggatcagggcgggcgtgacgcgcgcgccgaggtggtgcgcgagccgacgcctcaaggcgcttcggatgagatcccgcgaggacgcccatcctttcgcgatctcgtccgcgattacgcccggaccgtgctgcaggcggcgctcgaggagacgcgcgggaacgtctcggaggcggcgcgaaggcttggcatgtcgcgccagaacctgcagtactggctgcgggaggtggcggtggatccagcgcggtaccgccgctga

SEQ ID NO: 2651 - DNA, 1704 bp, Artificial
  Substituion in SEQ ID NO 2637
gtgatacgtagggccaggatccgcgcaggctctacctgtactatcgaagcaaactttgtgccaaatggccagcgcaggtgtcgggcaggtggcgcagccgaccgcacgggcgcaaaaagggccttgcgcttttcggactcggactgcaaactaggcttgcatgccgatctcgacaggcgccacaaggctctttgtatattgatgcaagcgaggctggaacatgcggagaggaggcgaggaatgcgcgcgcaagatgcggaggctcgccgcacgttgttggaggcggcgctcgacgccctggacgaaggcgtgcacgtggtggacgccgagggcgtgaccgtgttttacaaccggaagatggcggacatcgaggcgatgtcgaggcaggacgtgatggggcgacggatcgacgacgtgttctcgtttccagacgccgcggggagcacgctgctcgacgcggtgcggcgaggcgtgcggcgggacgacgtgcgacagacctacttcaaccggcgggggcaggccatcacgaccgtgaatcggacgtttccggtgtatgcggacgggaggattctgggcgcggtcgagatcgcccgggatgtgacgagcgtcgaacaactgaggagcacggccttcgggcaggcgggcgtgcgctacacgttcgcgtccatcatcgcggagagccttgcgatgcgcgaggtcctcgaacaggcgcggcgcgccgcgcgcacggactcatcggtgctcatcattggggaaacgggcacgggcaaggagcttctggcgcagggcatccacgcggccagcccgaggcgggacgggccgtttgtgtcgcagaacctcgccgccattccggacacgctcgtcgagggcatcttgtttggcacggcgcgcggggcgttcacgggcgcggtggatcggcctgggctcatcgagcaggcgaacgggggcacgcttctcctggacgagctgaacgccatgcccgcgccgcttcaggccaagctgctccgcgtgctccaggagcgcgtggtgcgccgcgtgggggatctgaaggatcgccctgtggatgtgcgcatcctcgccacgatgaacgaggatccgggccgcgccatccgcgagggccggttgcgggctgatctgttctaccgtctgagcgtcgtgacgctcacgattcctcctctgcgatcccgccgcgaggacattccgccgctcgtggctcacttcatccgccggctgaacggcgcgtttgggctccgggtggaaggctgcgagccgaggctcatggacgcgttcctggcgtacgagtggcccggcaacgtccgcgagctggagcacgtgattgagggcgccatgaacctcatggaggatgaggcgaagatcgggtttcagcacctgccgggccacgtgcgtcgcaggctggaacaggcgctcgatgagatgcaggggaacgaggatcagggcgggcgtgacgcgcgcgccgaggtggtgcgcgagccgacgcctcaaggcgcttcggatgagatcccgcgaggacgcccatcctttcgcgatctcgtccgcgattacgcccggaccgtgctgcaggcggcgctcgaggagacgcgcgggaacgtctcggaggcggcgcgaaggcttggcatgtcgcgccagaacctgcagtactggctgcgggaggtggcggtggatccagcgcggtaccgccgctga

SEQ ID NO: 2652 - DNA, 1704 bp, Artificial
  Substituion in SEQ ID NO 2637
gtgatacgtagggccaggatccgcgcaggctctacctgtactatcgaagcaaactttgtgccaaatggccagcgcaggtgtcgggcaggtggcgcagccgaccgcacgggcgcaaaaagggccttgcgcttttcggactcggactgcaaactaggcttgcatgccgatctcgacaggcgccacaaggctctttgtatattgatgcaagcgaggctggaacatgcggagaggaggcgaggaatgcgcgcgcaagatgcggaggctcgccgcacgttgttggaggcggcgctcgacgccctggacgaaggcgtgcacgtggtggacgccgagggcgtgaccgtgttttacaaccggaagatggcggacatcgaggcgatgtcgaggcaggacgtgatggggcgacggatcgacgacgtgttctcgtttccagacgccgcggggagcacgctgctcgacgcggtgcggcgaggcgtgcggcgggacgacgtgcgacagacctacttcaaccggcgggggcaggccatcacgaccgtgaatcggacgtttccggtgtatgcggacgggaggattctgggcgcggtcgagatcgcccgggatgtgacgagcgtcgaacaactgaggagcacggccttcgggcaggcgggcgtgcgctacacgttcgcgtccatcatcgcggagagccttgcgatgcgcgaggtcctcgaacaggcgcggcgcgccgcgcgcacggactcatcggtgctcatcattggggaaacgggcacgggcaaggagcttctggcgcagggcatccacgcggccagcccgaggcgggacgggccgtttgtgtcgcagaacctcgccgccattccggacacgctcgtcgagggcatcttgtttggcacggcgcgcggggcgttcacgggcgcggtggatcggcctgggctcatcgagcaggcgaacgggggcacgcttctcctggacgagctgaacgccatgcccgcgccgcttcaggccaagctgctccgcgtgctccaggagcgcgtggtgcgccgcgtgggggatctgaaggatcgccctgtggatgtgcgcatcctcgccacgatgaacgaggatccgggccgcgccatccgcgatggccggttgcgggctgatctgttctaccgtctgagcgtcgtgacgctcacggtgcctcctctgcgatcccgccgcgaggacattccgccgctcgtggctcacttcatccgccggctgaacggcgcgtttgggctccgggtggaaggctgcgagccgaggctcatggacgcgttcctggcgtacgagtggcccggcaacgtccgcgagctggagcacgtgattgagggcgccatgaacctcatggaggatgaggcgaagatcgggtttcagcacctgccgggccacgtgcgtcgcaggctggaacaggcgctcgatgagatgcaggggaacgaggatcagggcgggcgtgacgcgcgcgccgaggtggtgcgcgagccgacgcctcaaggcgcttcggatgagatcccgcgaggacgcccatcctttcgcgatctcgtccgcgattacgcccggaccgtgctgcaggcggcgctcgaggagacgcgcgggaacgtctcggaggcggcgcgaaggcttggcatgtcgcgccagaacctgcagtactggctgcgggaggtggcggtggatccagcgcggtaccgccgctga

SEQ ID NO: 2653 - protein, 242 aa, Alicyclobacillus acidocaldarius
MTKHPPSKQQVAYQTLKQRILEGTYGPGYRIVIDRIAKELGVSAIPIREAIRRLEAEGLVEVERFSGAKVTRIDAKMYEDILSALAVLEGYATAQAYRNLTDEDFDALRQTNEAMRQARSDFDLTLYSRLNQQFHEIILRRCNNRYLVDEIHAVRERMDAMRVSVFNLIPHRASDSIAEHDKLIQLMAVDVGEDAVERFARQHRLATLEAFRRWNEQHTRLVAERREWYRAPREIHRPGADS

SEQ ID NO: 2654 - DNA, 729 bp, Alicyclobacillus acidocaldarius
atgaccaaacatccaccaagcaaacaacaggtcgcctatcaaaccttgaagcagcggattctcgaaggaacctatgggcccggatatcgcatcgtgatcgaccgcatcgcgaaggaattgggggtgagtgcgattcccattcgtgaggccattcgccgcttggaagcggagggattggtggaggtcgagcgattcagcggagccaaggtgacccgcattgacgcgaaaatgtacgaggatattctctcggcactcgcggttctcgaaggctacgccacggcccaggcctatcgcaacctcacggatgaggacttcgatgcgcttcgacagacgaacgaggcgatgcgccaggcccgttcggattttgatctcacgctgtacagcaggctcaaccaacaatttcacgagattatcctgcgccgttgcaataaccgctatctcgtggatgaaattcacgccgtgcgggaacgaatggatgccatgcgggtgtccgtcttcaatctcatcccgcatcgggccagcgattccattgcagaacacgacaagctgattcagctgatggcggtggacgtcggagaggacgcggtggagcggtttgctcgccaacatcggttggcgacgctggaagccttcaggcgttggaacgagcaacacacccgtttggtggcggagcggagggagtggtatcgtgcgccacgcgagatacatcgaccgggggcggattcatga

SEQ ID NO: 2655 - protein, 207 aa, Geobacillus thermodenitrificans NG80-2
NKTQLAYEYILSHIESGAYGPGYRVVIDQIARELGLSSIPVREAIRQLEAEGLVEFKPYAGAVVSTINEKEYVETLSVLAVLEGYATALGSAKLTKEAIKQLEQLNEQMERALEELELERFSELNYAFHSLIYSHCGNAYLEEQIKQIWQRMKRIRVYGFTFVPQRAKASIGEHREMIRLLREQAPPHEVEQYARQHKMNTIEAFLR

SEQ ID NO: 2656 - protein, 207 aa, Geobacillus kaustophilus HTA426
NKTQLAYEYILSRIENGVYGPGYRVVIDQIARELGLSSIPVREAIRQLEAEGLVEFKPYTGAVVSNINEKEYIETLSVLAVLEGYATALGSAHLTKEAINELERLNEWMERALEELELERFSELNYEFHSLIYAHCGNAYLEEQIKQIWQRMKRIRAYGFTFVPQRAKASIEEHREIIRLLREQAPPHEIEQYVRQHKINTAEAFKR

SEQ ID NO: 2657 - protein, 205 aa, Arthrobacter sp. FB24
SKSEQAYAAVKARIVDGTYSPGYRLVLAKIAEDLGVSVVPVREAIRRLEAEGLVTFERNVGATVSGIDPTEYLYTMQTLSIVEGAATALSAPLIGSADVARARAVNEEMRECLEHFDPVRFTRLNQDFHSVLFEHCPNPHILDLVHRGWNRLASLRSSTFRFVPGRARDSVDEHEALLRLIESGAGADEIEKAARLHRSATLDAY

SEQ ID NO: 2658 - protein, 205 aa, Arthrobacter aurescens TC1
SKSQQAYAAVKARIVEGTYTPGYRLVLAKIAEDLGFSVVPVREAIRRLEAEGLVKFERNVGATVSGIDPTEYLYTMQTLSIVEGAATALSAPLIDSVAIARARAVNEEMRECLEHFDPVRFTALNQDFHSVLFEHCPNPHILDLVHRGWNRLASLRSSTFRFVPGRAQESVREHEALLRLIENAADADTIEKAARQHRAATLDAY

SEQ ID NO: 2659 - protein, 207 aa, Arthrobacter aurescens TC1
PGSKSEQAYQAVKARIVNGAYSPGYRLVLGSIAKDLGFSVVPVREAIRRLEAEGLVTFERNVGATVAGIDPTEYLYTMQTLSIVEGAATALSAPLIDSVAISRARAVNEEMRECLDHFDPVRFTRLNQDFHSVLFEHCPNPHILDLVHRGWNRLASLRSSTFRFVPGRARASVDEHEALLKLIETGADADTIEKAARLHRSATLNAY

SEQ ID NO: 2660 - protein, 242 aa, Artificial
  Substituion in SEQ ID NO 2653
MTKHPPSKQQVAYQTLKQRILEGTYGPGYRIVIDRIAKELGVSAIPIREAIRRLEAEGLVEVERFSGAKVTRIDAKMYEDILSALAVLEGYATAQAYRNLTDEDFDALRQTNEAMRQARSDFDLTLYSRLNQQFHEIILRRCNNRYLVDEIHAVRERMDAMRVSVFNLIPHRASDSIAEHDKLIQLMAVDVGEDAVERFARQHRLATLEAFKRWNEQHTRLVAERREWYRAPREIHRPGADS

SEQ ID NO: 2661 - protein, 242 aa, Artificial
  Substituion in SEQ ID NO 2653
MTKHPPSKQQVAYQTLKQRILEGTYGPGYRIVIDRIAKELGVSAIPIREAIRRLEAEGLVEVERFSGAKVTRIDAKMYEDILSALAVLEGYATAQAYRNLTDEDFDALRQTNEAMRQARSDFDLTLYSRLNQQFHEIILRRCNNRYLVDEIHAVRERMDAMRVSVFNLIPHRASDSIAEHDKLIQLMAVDVGEDAVERFARQHRLATLEAFRRWNEQHTRLVAERKEWYRAPREIHRPGADS

SEQ ID NO: 2662 - protein, 242 aa, Artificial
  Substituion in SEQ ID NO 2653
MTKHPPSKQQVAYQTLKQRILEGTYGPGYRIVIDRIAKELGVSAIPIREAIRRLEAEGLVEVERFSGAKVTRIDAKMYEDILSALAVLEGYATAQAYRNLTDEDFEALRQTNEAMRQARSDFDLTLYSRLNQQFHEIILRRCNNRYLVDEIHAVRERMDAMRVSVFNLIPHRASDSIAEHDKLIQLMAVDVGEDAVERFARQHRLATLEAFRRWNEQHTRLVAERREWYRAPREIHRPGADS

SEQ ID NO: 2663 - protein, 242 aa, Artificial
  Substituion in SEQ ID NO 2653
MTKHPPSKQQVAYQTLKQRILEGTYGPGYRIVIDRIAKELGVSAIPIREAIRRLEAEGLVEVERFSGAKVTRIDAKMYEDILSALAVLEGYATAQAYRNLTDEDFDALRQTNEAMRQARSDFDLTLYSRLNQQFHELILRRCNNRYLVDEIHAVRERMDAMRVSVFNLIPHRASDSIAEHDKLIQLMAVDVGEDAVERFARQHRLATLEAFRRWNEQHTRLVAERREWYRAPREIHRPGADS

SEQ ID NO: 2664 - protein, 242 aa, Artificial
  Substituion in SEQ ID NO 2653
MTKHPPSKQQVAYQTLKQRILEGTYGPGYRIVLDRIAKELGVSAIPIREAIRRLEAEGLVEVERFSGAKVTRIDAKMYEDILSALAVLEGYATAQAYRNLTDEDFDALRQTNEAMRQARSDFDLTLYSRLNQQFHEIILRRCNNRYLVDEIHAVRERMDAMRVSVFNLIPHRASDSIAEHDKLIQLMAVDVGEDAVERFARQHRLATLEAFRRWNEQHTRLVAERREWYRAPREIHRPGADS

SEQ ID NO: 2665 - DNA, 729 bp, Artificial
  Substituion in SEQ ID NO 2654
atgaccaaacatccaccaagcaaacaacaggtcgcctatcaaaccttgaagcagcggattctcgaaggaacctatgggcccggatatcgcatcgtgatcgaccgcatcgcgaaggaattgggggtgagtgcgattcccattcgtgaggccattcgccgcttggaagcggagggattggtggaggtcgagcgattcagcggagccaaggtgacccgcattgacgcgaaaatgtacgaggatattctctcggcactcgcggttctcgaaggctacgccacggcccaggcctatcgcaacctcacggatgaggacttcgatgcgcttcgacagacgaacgaggcgatgcgccaggcccgttcggattttgatctcacgctgtacagcaggctcaaccaacaatttcacgagattatcctgcgccgttgcaataaccgctatctcgtggatgaaattcacgccgtgcgggaacgaatggatgccatgcgggtgtccgtcttcaatctcatcccgcatcgggccagcgattccattgcagaacacgacaagctgattcagctgatggcggtggacgtcggagaggacgcggtggagcggtttgctcgccaacatcggttggcgacgctggaagccttcaaacgttggaacgagcaacacacccgtttggtggcggagcggagggagtggtatcgtgcgccacgcgagatacatcgaccgggggcggattcatga

SEQ ID NO: 2666 - DNA, 729 bp, Artificial
  Substituion in SEQ ID NO 2654
atgaccaaacatccaccaagcaaacaacaggtcgcctatcaaaccttgaagcagcggattctcgaaggaacctatgggcccggatatcgcatcgtgatcgaccgcatcgcgaaggaattgggggtgagtgcgattcccattcgtgaggccattcgccgcttggaagcggagggattggtggaggtcgagcgattcagcggagccaaggtgacccgcattgacgcgaaaatgtacgaggatattctctcggcactcgcggttctcgaaggctacgccacggcccaggcctatcgcaacctcacggatgaggacttcgatgcgcttcgacagacgaacgaggcgatgcgccaggcccgttcggattttgatctcacgctgtacagcaggctcaaccaacaatttcacgagattatcctgcgccgttgcaataaccgctatctcgtggatgaaattcacgccgtgcgggaacgaatggatgccatgcgggtgtccgtcttcaatctcatcccgcatcgggccagcgattccattgcagaacacgacaagctgattcagctgatggcggtggacgtcggagaggacgcggtggagcggtttgctcgccaacatcggttggcgacgctggaagccttcaggcgttggaacgagcaacacacccgtttggtggcggagcggaaagagtggtatcgtgcgccacgcgagatacatcgaccgggggcggattcatga

SEQ ID NO: 2667 - DNA, 729 bp, Artificial
  Substituion in SEQ ID NO 2654
atgaccaaacatccaccaagcaaacaacaggtcgcctatcaaaccttgaagcagcggattctcgaaggaacctatgggcccggatatcgcatcgtgatcgaccgcatcgcgaaggaattgggggtgagtgcgattcccattcgtgaggccattcgccgcttggaagcggagggattggtggaggtcgagcgattcagcggagccaaggtgacccgcattgacgcgaaaatgtacgaggatattctctcggcactcgcggttctcgaaggctacgccacggcccaggcctatcgcaacctcacggatgaggacttcgaagcgcttcgacagacgaacgaggcgatgcgccaggcccgttcggattttgatctcacgctgtacagcaggctcaaccaacaatttcacgagattatcctgcgccgttgcaataaccgctatctcgtggatgaaattcacgccgtgcgggaacgaatggatgccatgcgggtgtccgtcttcaatctcatcccgcatcgggccagcgattccattgcagaacacgacaagctgattcagctgatggcggtggacgtcggagaggacgcggtggagcggtttgctcgccaacatcggttggcgacgctggaagccttcaggcgttggaacgagcaacacacccgtttggtggcggagcggagggagtggtatcgtgcgccacgcgagatacatcgaccgggggcggattcatga

SEQ ID NO: 2668 - DNA, 729 bp, Artificial
  Substituion in SEQ ID NO 2654
atgaccaaacatccaccaagcaaacaacaggtcgcctatcaaaccttgaagcagcggattctcgaaggaacctatgggcccggatatcgcatcgtgatcgaccgcatcgcgaaggaattgggggtgagtgcgattcccattcgtgaggccattcgccgcttggaagcggagggattggtggaggtcgagcgattcagcggagccaaggtgacccgcattgacgcgaaaatgtacgaggatattctctcggcactcgcggttctcgaaggctacgccacggcccaggcctatcgcaacctcacggatgaggacttcgatgcgcttcgacagacgaacgaggcgatgcgccaggcccgttcggattttgatctcacgctgtacagcaggctcaaccaacaatttcacgagttaatcctgcgccgttgcaataaccgctatctcgtggatgaaattcacgccgtgcgggaacgaatggatgccatgcgggtgtccgtcttcaatctcatcccgcatcgggccagcgattccattgcagaacacgacaagctgattcagctgatggcggtggacgtcggagaggacgcggtggagcggtttgctcgccaacatcggttggcgacgctggaagccttcaggcgttggaacgagcaacacacccgtttggtggcggagcggagggagtggtatcgtgcgccacgcgagatacatcgaccgggggcggattcatga

SEQ ID NO: 2669 - DNA, 729 bp, Artificial
  Substituion in SEQ ID NO 2654
atgaccaaacatccaccaagcaaacaacaggtcgcctatcaaaccttgaagcagcggattctcgaaggaacctatgggcccggatatcgcatcgtgttagaccgcatcgcgaaggaattgggggtgagtgcgattcccattcgtgaggccattcgccgcttggaagcggagggattggtggaggtcgagcgattcagcggagccaaggtgacccgcattgacgcgaaaatgtacgaggatattctctcggcactcgcggttctcgaaggctacgccacggcccaggcctatcgcaacctcacggatgaggacttcgatgcgcttcgacagacgaacgaggcgatgcgccaggcccgttcggattttgatctcacgctgtacagcaggctcaaccaacaatttcacgagattatcctgcgccgttgcaataaccgctatctcgtggatgaaattcacgccgtgcgggaacgaatggatgccatgcgggtgtccgtcttcaatctcatcccgcatcgggccagcgattccattgcagaacacgacaagctgattcagctgatggcggtggacgtcggagaggacgcggtggagcggtttgctcgccaacatcggttggcgacgctggaagccttcaggcgttggaacgagcaacacacccgtttggtggcggagcggagggagtggtatcgtgcgccacgcgagatacatcgaccgggggcggattcatga

SEQ ID NO: 2670 - protein, 201 aa, Alicyclobacillus acidocaldarius
MRGHEKFLLPSDTKCQLPVPNCSGTREMKSTQLLYYTTITLKMHPKEADMDQANMDSFEALEREMAIFARRLEGARQSWRKHREIDRSAYLILLALREEGELTAGQLAARFLLDISTISRQITPLVEAGWIAKERDEDDKRQLRLSITEAGVEALEATRASRIELYRELVGDWTEEERRTFLGLLRRLNERIRARQQAERT

SEQ ID NO: 2671 - DNA, 606 bp, Alicyclobacillus acidocaldarius
ttgcgcggacacgaaaagttcctccttccgtcggataccaagtgccaactaccagtcccgaattgttcagggacacgagaaatgaagtctacacaactattgtattatacaactatcacgctgaaaatgcacccaaaggaggccgacatggatcaggccaacatggactcgttcgaagcgctggagcgcgagatggccatcttcgcgcgccggctcgagggcgcgcgccagtcgtggcgcaagcatcgggagatcgaccgctcggcgtatctgattctgctcgcgctgcgcgaggagggggagctcaccgccgggcagctcgccgcgcggtttttgctcgacatttcgactatcagccggcagattacgcccctcgttgaggcgggttggattgccaaggagcgagatgaggacgacaagcgtcagcttcgcctgtccatcaccgaggcgggggtggaggcgctcgaggccacgcgcgcatcccgcatcgagctgtatcgagagcttgtgggggattggacagaagaggagcgaaggacgttccttggccttttgcgccgtctcaacgagcgaattcgcgcgaggcagcaggcggagcgcacatga

SEQ ID NO: 2672 - protein, 139 aa, Streptomyces coelicolor A3(2)
ETLQHEVALFARRAEQTRLGGVGQVRNSMDRAAYLLLNRLDKEGPMGVKALAASMGIDSSTVTRQVAPLVDTGLVKRTSHPEDGRAVVLQLSPRGVARLEEVRSSRRQLMAELTHDWAPQERETFCALLARFNGALSAR

SEQ ID NO: 2673 - protein, 139 aa, Streptomyces avermitilis MA-4680
DTLQHEVAVFARRAEQTRLGGVGQVRNSMDRAAYLLLNRLDKEGPMGVKALAASMGIDSSTVTRQVAPLVDTGLVKRTSHPEDGRAVVLQLSPRGMSRLEEVRSSRRQLMSELTHDWAPQEREAFTALLTRFNTALSDR

SEQ ID NO: 2674 - protein, 141 aa, Frankia sp. EAN1pec
DSLRDLERELMLLARHHIAPNAARRGRTRHLDRSAYLLLSRLEAQGPMTIGQLAEAFSLDVSTVNRQTAAVLQAGLAERIPDPDGGLARKLSITPEGARRVADDRAFVIGELSGLVSTWSEDELRLFASMLERLNTSIETK

SEQ ID NO: 2675 - protein, 140 aa, Bacillus sp. NRRL B-14911
MSKEKQNDVELIEYELATFIRKAVYLEQSEKKIGQLERSAYLLLRQLDEFGPARVKELAEAFKLDISTLSRQAASLESKDLIKRCSDPKDGRVSVFSITDLGKEKLEADIANRRAHYFKVLNDWTEEEKEIFGKLVVRLN

SEQ ID NO: 2676 - protein, 140 aa, Streptomyces coelicolor A3(2)
ETIQREMTVFARRARASAGRMHPELSLVSYTLLGHLEERDGRRATDLAAHYALDKSTVSRQVSALERAGLIERRVDPDDHRVQVLHLTESGRDVLDRVTERRRAAFRERLADWPEEELLRFAAYLERYNAWPDAAPGAER

SEQ ID NO: 2677 - protein, 201 aa, Artificial
  Substituion in SEQ ID NO 2670
MRGHEKFLLPSDTKCQLPVPNCSGTREMKSTQLLYYTTITLKMHPKEADMDQANMDSFEAIEREMAIFARRLEGARQSWRKHREIDRSAYLILLALREEGELTAGQLAARFLLDISTISRQITPLVEAGWIAKERDEDDKRQLRLSITEAGVEALEATRASRIELYRELVGDWTEEERRTFLGLLRRLNERIRARQQAERT

SEQ ID NO: 2678 - protein, 201 aa, Artificial
  Substituion in SEQ ID NO 2670
MRGHEKFLLPSDTKCQLPVPNCSGTREMKSTQLLYYTTITLKMHPKEADMDQANMDSFEALEREMAIFARRLEGARQSWRKHREIDRSAYLILLALREEGELTAGQLAARFLLDISTISRQITPLVEAGWIAKERDEDDKRQLRLSITEAGVEALEATRASRIDLYRELVGDWTEEERRTFLGLLRRLNERIRARQQAERT

SEQ ID NO: 2679 - protein, 201 aa, Artificial
  Substituion in SEQ ID NO 2670
MRGHEKFLLPSDTKCQLPVPNCSGTREMKSTQLLYYTTITLKMHPKEADMDQANMDSFEALEREMAIFARRLEGARQSWRKHREIDRSAYLILLALREEGELTAGQLAARFLLDISTISRQITPLVEAGWIAKERDEDDKRQLRLSITEAGVEALEATRASRIELYRELVGDWTEEERRTFLGLLRRLNDRIRARQQAERT

SEQ ID NO: 2680 - protein, 201 aa, Artificial
  Substituion in SEQ ID NO 2670
MRGHEKFLLPSDTKCQLPVPNCSGTREMKSTQLLYYTTITLKMHPKEADMDQANMDSFEALEREMAIFARRLEGARQSWRKHREIDKSAYLILLALREEGELTAGQLAARFLLDISTISRQITPLVEAGWIAKERDEDDKRQLRLSITEAGVEALEATRASRIELYRELVGDWTEEERRTFLGLLRRLNERIRARQQAERT

SEQ ID NO: 2681 - protein, 201 aa, Artificial
  Substituion in SEQ ID NO 2670
MRGHEKFLLPSDTKCQLPVPNCSGTREMKSTQLLYYTTITLKMHPKEADMDQANMDSFEALEREMAIFARRLEGARQSWRKHREIDRSAYLILLALREEGELTAGQLAARFLLDISTISRQITPLVEAGWIAKERDEDDKRQLRLSITEAGVEALEATRASRIELYRELVGDWTEEERRTFLGLLRRLNERLRARQQAERT

SEQ ID NO: 2682 - DNA, 606 bp, Artificial
  Substituion in SEQ ID NO 2671
ttgcgcggacacgaaaagttcctccttccgtcggataccaagtgccaactaccagtcccgaattgttcagggacacgagaaatgaagtctacacaactattgtattatacaactatcacgctgaaaatgcacccaaaggaggccgacatggatcaggccaacatggactcgttcgaagcgattgagcgcgagatggccatcttcgcgcgccggctcgagggcgcgcgccagtcgtggcgcaagcatcgggagatcgaccgctcggcgtatctgattctgctcgcgctgcgcgaggagggggagctcaccgccgggcagctcgccgcgcggtttttgctcgacatttcgactatcagccggcagattacgcccctcgttgaggcgggttggattgccaaggagcgagatgaggacgacaagcgtcagcttcgcctgtccatcaccgaggcgggggtggaggcgctcgaggccacgcgcgcatcccgcatcgagctgtatcgagagcttgtgggggattggacagaagaggagcgaaggacgttccttggccttttgcgccgtctcaacgagcgaattcgcgcgaggcagcaggcggagcgcacatga

SEQ ID NO: 2683 - DNA, 606 bp, Artificial
  Substituion in SEQ ID NO 2671
ttgcgcggacacgaaaagttcctccttccgtcggataccaagtgccaactaccagtcccgaattgttcagggacacgagaaatgaagtctacacaactattgtattatacaactatcacgctgaaaatgcacccaaaggaggccgacatggatcaggccaacatggactcgttcgaagcgctggagcgcgagatggccatcttcgcgcgccggctcgagggcgcgcgccagtcgtggcgcaagcatcgggagatcgaccgctcggcgtatctgattctgctcgcgctgcgcgaggagggggagctcaccgccgggcagctcgccgcgcggtttttgctcgacatttcgactatcagccggcagattacgcccctcgttgaggcgggttggattgccaaggagcgagatgaggacgacaagcgtcagcttcgcctgtccatcaccgaggcgggggtggaggcgctcgaggccacgcgcgcatcccgcatcgatctgtatcgagagcttgtgggggattggacagaagaggagcgaaggacgttccttggccttttgcgccgtctcaacgagcgaattcgcgcgaggcagcaggcggagcgcacatga

SEQ ID NO: 2684 - DNA, 606 bp, Artificial
  Substituion in SEQ ID NO 2671
ttgcgcggacacgaaaagttcctccttccgtcggataccaagtgccaactaccagtcccgaattgttcagggacacgagaaatgaagtctacacaactattgtattatacaactatcacgctgaaaatgcacccaaaggaggccgacatggatcaggccaacatggactcgttcgaagcgctggagcgcgagatggccatcttcgcgcgccggctcgagggcgcgcgccagtcgtggcgcaagcatcgggagatcgaccgctcggcgtatctgattctgctcgcgctgcgcgaggagggggagctcaccgccgggcagctcgccgcgcggtttttgctcgacatttcgactatcagccggcagattacgcccctcgttgaggcgggttggattgccaaggagcgagatgaggacgacaagcgtcagcttcgcctgtccatcaccgaggcgggggtggaggcgctcgaggccacgcgcgcatcccgcatcgagctgtatcgagagcttgtgggggattggacagaagaggagcgaaggacgttccttggccttttgcgccgtctcaacgatcgaattcgcgcgaggcagcaggcggagcgcacatga

SEQ ID NO: 2685 - DNA, 606 bp, Artificial
  Substituion in SEQ ID NO 2671
ttgcgcggacacgaaaagttcctccttccgtcggataccaagtgccaactaccagtcccgaattgttcagggacacgagaaatgaagtctacacaactattgtattatacaactatcacgctgaaaatgcacccaaaggaggccgacatggatcaggccaacatggactcgttcgaagcgctggagcgcgagatggccatcttcgcgcgccggctcgagggcgcgcgccagtcgtggcgcaagcatcgggagatcgacaaatcggcgtatctgattctgctcgcgctgcgcgaggagggggagctcaccgccgggcagctcgccgcgcggtttttgctcgacatttcgactatcagccggcagattacgcccctcgttgaggcgggttggattgccaaggagcgagatgaggacgacaagcgtcagcttcgcctgtccatcaccgaggcgggggtggaggcgctcgaggccacgcgcgcatcccgcatcgagctgtatcgagagcttgtgggggattggacagaagaggagcgaaggacgttccttggccttttgcgccgtctcaacgagcgaattcgcgcgaggcagcaggcggagcgcacatga

SEQ ID NO: 2686 - DNA, 606 bp, Artificial
  Substituion in SEQ ID NO 2671
ttgcgcggacacgaaaagttcctccttccgtcggataccaagtgccaactaccagtcccgaattgttcagggacacgagaaatgaagtctacacaactattgtattatacaactatcacgctgaaaatgcacccaaaggaggccgacatggatcaggccaacatggactcgttcgaagcgctggagcgcgagatggccatcttcgcgcgccggctcgagggcgcgcgccagtcgtggcgcaagcatcgggagatcgaccgctcggcgtatctgattctgctcgcgctgcgcgaggagggggagctcaccgccgggcagctcgccgcgcggtttttgctcgacatttcgactatcagccggcagattacgcccctcgttgaggcgggttggattgccaaggagcgagatgaggacgacaagcgtcagcttcgcctgtccatcaccgaggcgggggtggaggcgctcgaggccacgcgcgcatcccgcatcgagctgtatcgagagcttgtgggggattggacagaagaggagcgaaggacgttccttggccttttgcgccgtctcaacgagcgattacgcgcgaggcagcaggcggagcgcacatga

SEQ ID NO: 2687 - protein, 404 aa, Alicyclobacillus acidocaldarius
MVVRSLRGFVIAIVIAIIVIGVPVLQLVRPIPQAASDVAAPLPRAIPGEKPVIHWPSQGEAALMADGVGSFGSSGPQVPVPIASVTKVMTAYLVLQKHPLQLGQQGPSITITPDDVKVYERDKALGQSVVKVAAGEQITEYQALEGLLLPSGNNMGTLLAKWCDGSVQAFVQEMNATAKRLGMTETHYADPTGYSPASQSDAVDQMKLFALAMQNPVFRQIVGEAQAELPVAGLVYNVDSVVGHGTIIGGKTGSTLEAGGCFVFAARKVIGNREVLIIGAVLGQKGPQPLAEALTAAVAMSQDAQKALRSVQLVSAGQTVGTLSAPWAKPVSLVATEPVQVIGWGGLPVQQTYRADVLDPKKPIAADQVVGQLQIQVGAQTVRVPVAAASSVPAPTLSWRMKRL

SEQ ID NO: 2688 - DNA, 1215 bp, Alicyclobacillus acidocaldarius
atggttgtgcgtagtttgcgcggtttcgtcattgctatcgtgattgccatcatcgtcatcggcgtgccggttctccagttggtgcgccccatcccgcaggcggcctccgatgtggccgcgccactgccgcgcgccattccgggtgagaagcccgtcatccattggccttcgcagggcgaggccgcgctgatggccgacggcgtgggcagcttcggatcgtccgggcctcaggttcctgtgcccatcgcaagcgtgaccaaggtcatgacggcgtaccttgtgcttcagaagcacccgctgcagctggggcaacaggggccttccatcaccatcacgccggatgacgtgaaggtgtatgagagagacaaggccctgggacaatccgtggtgaaggtggccgcaggagaacaaatcacggaatatcaggcgctcgaggggctgcttttgccttccggcaacaacatgggcacgctcttggcgaagtggtgcgatggctccgtgcaggcgttcgtccaggagatgaacgcgaccgcgaaaaggcttggcatgaccgagacgcactacgcggatcccacgggatactcgcccgcgagccagagcgacgcggtggatcaaatgaagctgtttgcgctggcgatgcagaacccggtgttccgacagattgtgggtgaggcgcaagcagagctccctgtcgcggggcttgtgtacaatgtcgattcggtggtggggcatggaaccatcatcggaggcaagacgggatcgacgctcgaggcgggcggctgttttgtgtttgccgcgcgcaaggtcatcggcaaccgcgaggtgctgatcatcggcgcggtgctgggtcagaagggcccgcagccccttgctgaggcgttgaccgcggccgtcgcgatgtcgcaggacgcccagaaggcgctgcgatccgtccaactcgtctccgccgggcagacggtggggacgctgtctgcgccctgggccaagcccgtctcgctcgtcgcgacggagccggtgcaggtcatcggctggggaggactccccgtgcagcagacgtatcgggcggatgtgctggatccgaagaagccgattgcggccgaccaagtggtgggccaactccaaattcaggtgggggcgcagacggtgcgcgtgccggttgcggccgcatcgtccgttccggcgcccacgctcagttggcgcatgaagcgactctga

SEQ ID NO: 2689 - protein, 332 aa, Streptomyces coelicolor A3(2)
VVQSMRPLPAPTLDLTAQDSFSFDGGKPQIPWPESGQAALDVQGIGSFGSSGDQKPVPIASVAKVMTAYLVLRDHPLKSGAEGPKIKIDQAAEDQSQAGQESTVDVFAGDSISQREALQAILIASANNVARLLARWDAGSEKAFVEKMNGAAKDLGMTNTTYTDPSGLNNTTVSTAVDQVKLAKAAMKEPAFREVAAMMSYNDYKGENHGNWNQLVGHNGVVGIKTGTTTSALGNLVFAAKKEVGGETRTIVGAVVRQPDVGGGILDAALDASDELIRAAQDTLKSSTIIKKGSVVGYVDDGLGGRTPVVASQDVKAVGWGGLTVKLTFTAD

SEQ ID NO: 2690 - protein, 323 aa, Hydrogenobaculum sp. Y04AAS1
ISWPTDIRYGVIGTLQSGIISKNPNQGQWPLASVAKIMTAYIILKDHPLPIGQDGPTITVTQKEVNEYEAFKKDGQSVVKVALGEKLTERQLLEGLMIPSANNFAYILARWDAGSVKAFVDKMNKTAQSLGLKDTRYEDPSGASAGTVSTPKDQFKLTQLAMQIPTFRHMVAMPQVNLPIAGIQYNVNYDLGKDNIVGVKTGSSLPAGANFVFDSKQGNIDILGVIFGASGKSSLMTALKDAIILIDTTKTQISTEKLISKNQQIGFIKVSWMKKEIPMLASQDFSTVVYPGMKITYSLYPIKDMKFPIKSNEVIGTLVINYG

SEQ ID NO: 2691 - protein, 359 aa, Streptomyces avermitilis MA-4680
VAQAVRPLPTPTLGLTADETYTFEGGKLDLPWPGQGQSAVEVEGVGTVGTAGKQAPKPIASVAKIMTAYVILEEHPLKGTAAGDKITVDQQAEDESKNEDESTAAMTKGQKFTERQMLQMLMIPSGNNAARLLARWDSDSETFVGKMNAAAKKLGMTNSTYTDPSGLEKTTVSTATDQLKLAKAVMQKEVFRSIVGMAKADIPGLKGTIYNNNDLLVKQVGVIGLKTGSSTPAGGNLVWAATKTVNGKVRTIYGAVLNQDAGTGRVWDSLQLALTNSQKLIDKVQQGLISAPVVKKGQVVGYVDDQLGGRTPVVATENMTAVGWPGLKTKISIGAGDTTVPHEAKAGKVVGELTVGDGS

SEQ ID NO: 2692 - protein, 391 aa, Streptomyces clavuligerus
VQLLRPLPDPVLTLRDSASSTTLGGDRISIPWPKEGQGAVTVAGSGVYETFGPEKSVPTASTAKIMTAYVLLRKHPLKRGEPGPTITVDAQTVAEGKAKDESRIEGLTEGQTFSQQDMLKMLMIPSGNNIGRLLARWSTKTDDQTAFVREMNEAAKDLGMKNTVYTDPSGLDKGTVSTAVDQLKLAEAVMEYDVFRDVVALPNAEIPGHGRIYNNNDRLILAGLGIVGIKTGSNTPAGGTLSWAAYKTFDGEDRLILGTMMAQHAPGPDINGGDSLVLVQDNSRKVVASVREMLTSANVVKKGEVVGHVDDRFGRRIPVVTTKSLDLVGLSGQKVTLTYGRKGDGALSRTARAGAVVGELTVGNGPDAHRIPLALKEGLTEPSLGTRLTRL

SEQ ID NO: 2693 - protein, 391 aa, Streptomyces clavuligerus; identical to SEQ ID NO: 2692

SEQ ID NO: 2694 - protein, 404 aa, Artificial
  Substituion in SEQ ID NO 2687
MVVRSLRGFVIAIVIAIIVIGVPVLQLVRPIPQAASDVAAPIPRAIPGEKPVIHWPSQGEAALMADGVGSFGSSGPQVPVPIASVTKVMTAYLVLQKHPLQLGQQGPSITITPDDVKVYERDKALGQSVVKVAAGEQITEYQALEGLLLPSGNNMGTLLAKWCDGSVQAFVQEMNATAKRLGMTETHYADPTGYSPASQSDAVDQMKLFALAMQNPVFRQIVGEAQAELPVAGLVYNVDSVVGHGTIIGGKTGSTLEAGGCFVFAARKVIGNREVLIIGAVLGQKGPQPLAEALTAAVAMSQDAQKALRSVQLVSAGQTVGTLSAPWAKPVSLVATEPVQVIGWGGLPVQQTYRADVLDPKKPIAADQVVGQLQIQVGAQTVRVPVAAASSVPAPTLSWRMKRL

SEQ ID NO: 2695 - protein, 404 aa, Artificial
  Substituion in SEQ ID NO 2687
MVVRSLRGFVIAIVIAIIVIGVPVLQLVRPIPQAASDVAAPLPRAIPGEKPVIHWPSQGEAALMADGVGSFGSSGPQVPVPIASVTKVMTAYLVLQKHPLQLGQQGPSITITPDDVKVYERDKALGQSVVKVAAGEQITEYQALEGLLLPSGNNMGTLLAKWCDGSVQAFVQEMNATAKRLGMTETHYADPTGYSPASQSDAVDQMKLFALAMQNPVFRQIVGEAQAELPVAGLVYNVDSVVGHGTIIGGKTGSTLEAGGCFVFAARKVIGNREVLIIGAVLGQKGPQPLAEALTAAVAMSQDAQKALRSVQLVSAGQTVGTLSAPWAKPVSLVATEPVQVIGWGGLPVQQTYRADVLDPKKPIAADQVVGQLQIQVGAQTVRIPVAAASSVPAPTLSWRMKRL

SEQ ID NO: 2696 - protein, 404 aa, Artificial
  Substituion in SEQ ID NO 2687
MVVRSLRGFVIAIVIAIIVIGVPVLQLVRPIPQAASDVAAPLPRAIPGEKPVIHWPSQGEAALMADGVGSFGSSGPQVPVPIASVTKVMTAYLVLQKHPLQLGQQGPSITITPDDVKVYERDKALGQSVVKVAAGEQITEYQALEGLLLPSGNNMGTLLAKWCDGSVQAFVQEMNATAKRLGMTETHYADPTGYSPASQSDAVDQMKLFALAMQNPVFRQIVGEAQAELPVAGLVYNVDSVVGHGTIIGGKTGSTLEAGGCFVFAARKVIGNREVLIIGAVLGQKGPQPLAEALTAAVAMSQDAQKALRSVQLVSAGQTVGTLSAPWARPVSLVATEPVQVIGWGGLPVQQTYRADVLDPKKPIAADQVVGQLQIQVGAQTVRVPVAAASSVPAPTLSWRMKRL

SEQ ID NO: 2697 - protein, 404 aa, Artificial
  Substituion in SEQ ID NO 2687
MVVRSLRGFVIAIVIAIIVIGVPVLQLVRPIPQAASDVAAPLPRAIPGEKPVIHWPSQGEAALMADGVGSFGSSGPQVPVPIASVTKVMTAYLVLQKHPLQLGQQGPSITITPDDVKVYERDKALGQSVVKVAAGEQITEYQALEGLLLPSGNNMGTLLAKWCDGSVQAFVQEMNATAKRLGMTETHYADPTGYSPASQSDAVDQMKLFALAMQNPVFRQIVGEAQAELPVAGLVYNVDSVVGHGTIIGGKTGSTLEAGGCFVFAARKVIGNREVLIIGAVLGQKGPQPLAEALTAAVAMSQDAQKALRSVNLVSAGQTVGTLSAPWAKPVSLVATEPVQVIGWGGLPVQQTYRADVLDPKKPIAADQVVGQLQIQVGAQTVRVPVAAASSVPAPTLSWRMKRL

SEQ ID NO: 2698 - protein, 404 aa, Artificial
  Substituion in SEQ ID NO 2687
MVVRSLRGFVIAIVIAIIVIGVPVLQLVRPIPQAASDVAAPLPRAIPGERPVIHWPSQGEAALMADGVGSFGSSGPQVPVPIASVTKVMTAYLVLQKHPLQLGQQGPSITITPDDVKVYERDKALGQSVVKVAAGEQITEYQALEGLLLPSGNNMGTLLAKWCDGSVQAFVQEMNATAKRLGMTETHYADPTGYSPASQSDAVDQMKLFALAMQNPVFRQIVGEAQAELPVAGLVYNVDSVVGHGTIIGGKTGSTLEAGGCFVFAARKVIGNREVLIIGAVLGQKGPQPLAEALTAAVAMSQDAQKALRSVQLVSAGQTVGTLSAPWAKPVSLVATEPVQVIGWGGLPVQQTYRADVLDPKKPIAADQVVGQLQIQVGAQTVRVPVAAASSVPAPTLSWRMKRL

SEQ ID NO: 2699 - DNA, 1215 bp, Artificial
  Substituion in SEQ ID NO 2688
atggttgtgcgtagtttgcgcggtttcgtcattgctatcgtgattgccatcatcgtcatcggcgtgccggttctccagttggtgcgccccatcccgcaggcggcctccgatgtggccgcgccaattccgcgcgccattccgggtgagaagcccgtcatccattggccttcgcagggcgaggccgcgctgatggccgacggcgtgggcagcttcggatcgtccgggcctcaggttcctgtgcccatcgcaagcgtgaccaaggtcatgacggcgtaccttgtgcttcagaagcacccgctgcagctggggcaacaggggccttccatcaccatcacgccggatgacgtgaaggtgtatgagagagacaaggccctgggacaatccgtggtgaaggtggccgcaggagaacaaatcacggaatatcaggcgctcgaggggctgcttttgccttccggcaacaacatgggcacgctcttggcgaagtggtgcgatggctccgtgcaggcgttcgtccaggagatgaacgcgaccgcgaaaaggcttggcatgaccgagacgcactacgcggatcccacgggatactcgcccgcgagccagagcgacgcggtggatcaaatgaagctgtttgcgctggcgatgcagaacccggtgttccgacagattgtgggtgaggcgcaagcagagctccctgtcgcggggcttgtgtacaatgtcgattcggtggtggggcatggaaccatcatcggaggcaagacgggatcgacgctcgaggcgggcggctgttttgtgtttgccgcgcgcaaggtcatcggcaaccgcgaggtgctgatcatcggcgcggtgctgggtcagaagggcccgcagccccttgctgaggcgttgaccgcggccgtcgcgatgtcgcaggacgcccagaaggcgctgcgatccgtccaactcgtctccgccgggcagacggtggggacgctgtctgcgccctgggccaagcccgtctcgctcgtcgcgacggagccggtgcaggtcatcggctggggaggactccccgtgcagcagacgtatcgggcggatgtgctggatccgaagaagccgattgcggccgaccaagtggtgggccaactccaaattcaggtgggggcgcagacggtgcgcgtgccggttgcggccgcatcgtccgttccggcgcccacgctcagttggcgcatgaagcgactctga

SEQ ID NO: 2700 - DNA, 1215 bp, Artificial
  Substituion in SEQ ID NO 2688
atggttgtgcgtagtttgcgcggtttcgtcattgctatcgtgattgccatcatcgtcatcggcgtgccggttctccagttggtgcgccccatcccgcaggcggcctccgatgtggccgcgccactgccgcgcgccattccgggtgagaagcccgtcatccattggccttcgcagggcgaggccgcgctgatggccgacggcgtgggcagcttcggatcgtccgggcctcaggttcctgtgcccatcgcaagcgtgaccaaggtcatgacggcgtaccttgtgcttcagaagcacccgctgcagctggggcaacaggggccttccatcaccatcacgccggatgacgtgaaggtgtatgagagagacaaggccctgggacaatccgtggtgaaggtggccgcaggagaacaaatcacggaatatcaggcgctcgaggggctgcttttgccttccggcaacaacatgggcacgctcttggcgaagtggtgcgatggctccgtgcaggcgttcgtccaggagatgaacgcgaccgcgaaaaggcttggcatgaccgagacgcactacgcggatcccacgggatactcgcccgcgagccagagcgacgcggtggatcaaatgaagctgtttgcgctggcgatgcagaacccggtgttccgacagattgtgggtgaggcgcaagcagagctccctgtcgcggggcttgtgtacaatgtcgattcggtggtggggcatggaaccatcatcggaggcaagacgggatcgacgctcgaggcgggcggctgttttgtgtttgccgcgcgcaaggtcatcggcaaccgcgaggtgctgatcatcggcgcggtgctgggtcagaagggcccgcagccccttgctgaggcgttgaccgcggccgtcgcgatgtcgcaggacgcccagaaggcgctgcgatccgtccaactcgtctccgccgggcagacggtggggacgctgtctgcgccctgggccaagcccgtctcgctcgtcgcgacggagccggtgcaggtcatcggctggggaggactccccgtgcagcagacgtatcgggcggatgtgctggatccgaagaagccgattgcggccgaccaagtggtgggccaactccaaattcaggtgggggcgcagacggtgcgcattccggttgcggccgcatcgtccgttccggcgcccacgctcagttggcgcatgaagcgactctga

SEQ ID NO: 2701 - DNA, 1215 bp, Artificial
  Substituion in SEQ ID NO 2688
atggttgtgcgtagtttgcgcggtttcgtcattgctatcgtgattgccatcatcgtcatcggcgtgccggttctccagttggtgcgccccatcccgcaggcggcctccgatgtggccgcgccactgccgcgcgccattccgggtgagaagcccgtcatccattggccttcgcagggcgaggccgcgctgatggccgacggcgtgggcagcttcggatcgtccgggcctcaggttcctgtgcccatcgcaagcgtgaccaaggtcatgacggcgtaccttgtgcttcagaagcacccgctgcagctggggcaacaggggccttccatcaccatcacgccggatgacgtgaaggtgtatgagagagacaaggccctgggacaatccgtggtgaaggtggccgcaggagaacaaatcacggaatatcaggcgctcgaggggctgcttttgccttccggcaacaacatgggcacgctcttggcgaagtggtgcgatggctccgtgcaggcgttcgtccaggagatgaacgcgaccgcgaaaaggcttggcatgaccgagacgcactacgcggatcccacgggatactcgcccgcgagccagagcgacgcggtggatcaaatgaagctgtttgcgctggcgatgcagaacccggtgttccgacagattgtgggtgaggcgcaagcagagctccctgtcgcggggcttgtgtacaatgtcgattcggtggtggggcatggaaccatcatcggaggcaagacgggatcgacgctcgaggcgggcggctgttttgtgtttgccgcgcgcaaggtcatcggcaaccgcgaggtgctgatcatcggcgcggtgctgggtcagaagggcccgcagccccttgctgaggcgttgaccgcggccgtcgcgatgtcgcaggacgcccagaaggcgctgcgatccgtccaactcgtctccgccgggcagacggtggggacgctgtctgcgccctgggcccgtcccgtctcgctcgtcgcgacggagccggtgcaggtcatcggctggggaggactccccgtgcagcagacgtatcgggcggatgtgctggatccgaagaagccgattgcggccgaccaagtggtgggccaactccaaattcaggtgggggcgcagacggtgcgcgtgccggttgcggccgcatcgtccgttccggcgcccacgctcagttggcgcatgaagcgactctga

SEQ ID NO: 2702 - DNA, 1215 bp, Artificial
  Substituion in SEQ ID NO 2688
atggttgtgcgtagtttgcgcggtttcgtcattgctatcgtgattgccatcatcgtcatcggcgtgccggttctccagttggtgcgccccatcccgcaggcggcctccgatgtggccgcgccactgccgcgcgccattccgggtgagaagcccgtcatccattggccttcgcagggcgaggccgcgctgatggccgacggcgtgggcagcttcggatcgtccgggcctcaggttcctgtgcccatcgcaagcgtgaccaaggtcatgacggcgtaccttgtgcttcagaagcacccgctgcagctggggcaacaggggccttccatcaccatcacgccggatgacgtgaaggtgtatgagagagacaaggccctgggacaatccgtggtgaaggtggccgcaggagaacaaatcacggaatatcaggcgctcgaggggctgcttttgccttccggcaacaacatgggcacgctcttggcgaagtggtgcgatggctccgtgcaggcgttcgtccaggagatgaacgcgaccgcgaaaaggcttggcatgaccgagacgcactacgcggatcccacgggatactcgcccgcgagccagagcgacgcggtggatcaaatgaagctgtttgcgctggcgatgcagaacccggtgttccgacagattgtgggtgaggcgcaagcagagctccctgtcgcggggcttgtgtacaatgtcgattcggtggtggggcatggaaccatcatcggaggcaagacgggatcgacgctcgaggcgggcggctgttttgtgtttgccgcgcgcaaggtcatcggcaaccgcgaggtgctgatcatcggcgcggtgctgggtcagaagggcccgcagccccttgctgaggcgttgaccgcggccgtcgcgatgtcgcaggacgcccagaaggcgctgcgatccgtcaatctcgtctccgccgggcagacggtggggacgctgtctgcgccctgggccaagcccgtctcgctcgtcgcgacggagccggtgcaggtcatcggctggggaggactccccgtgcagcagacgtatcgggcggatgtgctggatccgaagaagccgattgcggccgaccaagtggtgggccaactccaaattcaggtgggggcgcagacggtgcgcgtgccggttgcggccgcatcgtccgttccggcgcccacgctcagttggcgcatgaagcgactctga

SEQ ID NO: 2703 - DNA, 1215 bp, Artificial
  Substituion in SEQ ID NO 2688
atggttgtgcgtagtttgcgcggtttcgtcattgctatcgtgattgccatcatcgtcatcggcgtgccggttctccagttggtgcgccccatcccgcaggcggcctccgatgtggccgcgccactgccgcgcgccattccgggtgagcgtcccgtcatccattggccttcgcagggcgaggccgcgctgatggccgacggcgtgggcagcttcggatcgtccgggcctcaggttcctgtgcccatcgcaagcgtgaccaaggtcatgacggcgtaccttgtgcttcagaagcacccgctgcagctggggcaacaggggccttccatcaccatcacgccggatgacgtgaaggtgtatgagagagacaaggccctgggacaatccgtggtgaaggtggccgcaggagaacaaatcacggaatatcaggcgctcgaggggctgcttttgccttccggcaacaacatgggcacgctcttggcgaagtggtgcgatggctccgtgcaggcgttcgtccaggagatgaacgcgaccgcgaaaaggcttggcatgaccgagacgcactacgcggatcccacgggatactcgcccgcgagccagagcgacgcggtggatcaaatgaagctgtttgcgctggcgatgcagaacccggtgttccgacagattgtgggtgaggcgcaagcagagctccctgtcgcggggcttgtgtacaatgtcgattcggtggtggggcatggaaccatcatcggaggcaagacgggatcgacgctcgaggcgggcggctgttttgtgtttgccgcgcgcaaggtcatcggcaaccgcgaggtgctgatcatcggcgcggtgctgggtcagaagggcccgcagccccttgctgaggcgttgaccgcggccgtcgcgatgtcgcaggacgcccagaaggcgctgcgatccgtccaactcgtctccgccgggcagacggtggggacgctgtctgcgccctgggccaagcccgtctcgctcgtcgcgacggagccggtgcaggtcatcggctggggaggactccccgtgcagcagacgtatcgggcggatgtgctggatccgaagaagccgattgcggccgaccaagtggtgggccaactccaaattcaggtgggggcgcagacggtgcgcgtgccggttgcggccgcatcgtccgttccggcgcccacgctcagttggcgcatgaagcgactctga

SEQ ID NO: 2704 - protein, 539 aa, Alicyclobacillus acidocaldarius
MSAAGGIHSSEVCVRRDVGCGMSWTANYEFKRLVKRLILNYFAGSVIAVLGVGGVLIFTTLHLSQEDLWVICGILGGSLVLMLTADSIAFRVQIRPIRKALLTAHPTEDVLAKGYKRALHLPALAVLRVMGPHWLSFLIPGLVSSSILVRRGLLHLPMAYVWLASLGTLIVACMHAVIEFFLTSRSIEPTLVTIRRRSEHMYGASVLLRGQVVVPLAFKFAMSAVVFGALPLLLFGLANAVRLTHEGLGSSTYWTWAGGILALGSLFSAFGGYLLASDVQRPIRRLEALMRRVERGDFSLRADDTYMDEFSDLIQGFNLMLNGLAHRDAMNRQLIDSYFATLAAALDARDPYTAGHSQRVARYAEAIGRKVNLSPQTVRELRQSALLHDIGKIGIRDEILLKEGKLTDEEFAIIKQHPVIGENIIRQIQPDDAMKPLLPGIRSHHERYDGKGYPDGLAGEEIPLFGRILAVADAFDAMTSDRPYRSGMPVERAIQVLREGRGTQWDPHFVDAFIEVYREVYIPDEAKSAAREAAASTSQ

SEQ ID NO: 2705 - DNA, 1620 bp, Alicyclobacillus acidocaldarius
ttgagcgcagcaggtggaattcattcgagtgaggtatgcgttcgacgggatgtggggtgcggtatgagctggacggcgaactacgaattcaagcgcttggtcaagcggctcatcctgaactacttcgcgggttccgtcatcgccgtcctcggcgtgggcggcgtgctcatcttcaccaccctccacctgagtcaagaagacctgtgggtcatctgcggcatcctcggcgggtcgctcgtgctgatgctcacggcggactccatcgcgtttcgcgtgcaaattcgcccgattcggaaagcgcttctcacagcccatccgacagaagacgtgcttgcgaagggatacaaacgagcgctgcacctgccggcgctggccgtgctccgcgtcatggggccgcactggctgtcgttcctcatcccagggctcgtgtcgtcgtccatcctcgtgcgccgaggactcctgcatctgccgatggcctacgtgtggctggcttcgctcggcacgctgattgtcgcctgcatgcacgccgtgatcgaattttttctcacctcgcgctccatcgagccgacgctcgtcaccatccggcgcaggagcgagcacatgtatggcgcgtccgtcttgctccgcggccaggtggtggtgccgcttgcgttcaaattcgcgatgagcgccgtcgtgtttggcgccctcccgctgctcttgttcggattggcgaacgccgttcgtctgacccacgagggactcggatcgtccacctactggacgtgggccggcggcatcctggcgctcggttcgctgttttccgccttcggcggatacctgttggcgagcgacgttcagcggcccatccgcaggctcgaggcgctgatgcgccgcgtggagcgtggggatttttccctgcgcgcggacgacacctacatggacgagttctccgatctcatccagggcttcaacctgatgctgaacggcctcgcgcaccgcgacgcgatgaaccgccagctcatcgacagctatttcgccacactggccgcggccctggacgcgcgagatccgtacaccgccggccattcgcagcgcgtcgcgcgctacgccgaggccatcggccgaaaagtgaacctgtccccacagaccgtgcgcgaactgaggcagtctgcgctcctgcacgacatcgggaagatcggcatccgcgacgagatcctgctaaaggaaggcaagctgacggacgaggagttcgccatcatcaaacagcaccccgtgatcggggaaaacatcatccgacagattcagccggacgacgccatgaagccgctgctgccgggcatccgctcgcaccacgagcggtatgacggcaaggggtatccggacggcctcgccggcgaggagattccgctgtttggccgcatcctcgccgtggccgacgcctttgacgccatgacgtccgaccgcccctaccgctccggcatgcccgtggagcgggccatccaggtgcttcgagaagggcgcggaacccagtgggatccgcatttcgtggatgcgttcatcgaggtgtatcgggaggtctacatcccggacgaggccaagtccgccgcgcgcgaggcggctgcctccacgagccagtga

SEQ ID NO: 2706 - protein, 488 aa, Bacillus sp. NRRL B-14911
YNRFLKKLLINYIFGSLIAVLAIGATFIFTTIDARGYDKALIWLILAGSMVIMFFTEGFFFRQHIRPIRAVFLSDGMDAESVRKAILRLKQFPVLTVKRIMLPHLLGLTIPAASASLYLISAGELKLSYYMVLYAAIAAFLVASMHALVEFYLTLRAIKPVLAHFKAANKSGWLVQETPSTIPIKKKFRLTVLVIGVLPVLIFMVAAQIKLEGMGMETAVFWQWAAVVIFITVCYAMLTAKYMAEDIEEPISRLQTLMSEAENQNFAYLKDNVYTDEFSEVFTGFNIMIAALKQREETNRQLLESFMTVLSAALDARDPYTSGHSMRVASFSRDIGKRLGLHDEELKQLYQTALLHDIGKIGVPDGVLQKEGKLSDEEFEYIKAHPVIGETILKQVQPAGEVASLLPGIRSHHERIDGKGYPDGLQGEEIPYFGRIIAVADSYDAMTSDRPYRKGMPPEKALHILESGKGTQWDPQVADAFIELARKM

SEQ ID NO: 2707 - protein, 486 aa, Exiguobacterium sibiricum 255-15
QKFERQLLKNYLIGSFVAVFGVGCLFIFETLTFDARERVTLLTIMFLSVVLMFSFEYTIYRKHMRPLYQFFQTSTPSQAQLTAAFRTTHRFPLLTIKRILGPHFLGLSIPSSSLTALAIHFQWLEMPYYLIGLACFGAILVAILHALIEFFLTYRVTESMLAELTVQSQQYGHGELILTKKDFISLRKKMLISTLIIGVFPILLFVLASAVQLTENESLRSYWSWSTLILIVILCLATFCSLLLYENIQKPILALQEGVAQIESGQLNTINNPFSDEFSQLVGGFNLMVEGIQGRDQENEQLLDSLFTLFAATLDARDPYTAGHSLRVAEYSVEIARAAGLADDQVELLRKSALLHDIGKIGIRDDVLLKEGRLTGEEFDKIKQHPVIGVHILSQVHLPEKLQPILPGVKYHHERYDGKGYPEGLAGESIPVFGRIMAIADAYDAMTSDRPYRKGMPVAKALAILEEGSGTQWDASFTQLFLDLKR

SEQ ID NO: 2708 - protein, 473 aa, Bacillus selenitireducens MLS10
RMLINYMVGSLIAVFGVGSVFIFHTLTLSSEETLILLGIMVLSGLIMISLELFVYSKHIRPLVHFFKKGMNPQDAYMTAHSFPFMTVRRIMGPHLLGLSIPATVMTLFALSLGFLTLPHLYVLYAWIGAILIATLHAMIEFFMTSRAVQPLIASICARTDENLKLDGVKVISMKWKLLLSMLLIAVFPAALFLLAGQIRESAETTTAYWNWAFLVIVVILFVSIAGAVVLYRNMEQPILELRKNLEQVQHGEFHEMPNYYADEFSTLINGFNSMVSGIKSRDAENERLLESFFSVFAATLDARDSYTAGHTTRVADYSTQIARRSGLSGDELDLLRKSALLHDIGKIGIPDSVLLKDGKLTDEEFDKIKEHPVIGGDILEKVNLPEHLRPLLDGVRHHHERFDGKGYPDGLSGDRIPLYGRIIAVADAFDAMTSNRPYRKAMSYEQARNILQNGRGSQWDPAFIDHFMDFYEE

SEQ ID NO: 2709 - protein, 189 aa, Planctomyces maris DSM 8797
AQQEELMLSFVKSFISTLDAKDPYTRGHSERVALIAQQLAKQLGYSGEFIQDIYLSGLLHDIGKIGVDDGILRKEGKLTDEEFSQIQKHPMIGYKILTGIKKLKNILPGIRNHHEQIDGRGYPDGLRGSDIPLMARIIAVADAYDAMGSDRPYRNGMPLERLENIFREGKGLQWDSDVIDAYFEIRDEI

SEQ ID NO: 2710 - protein, 183 aa, Desulfotomaculum reducens MI-1
KTMFKSFLVALASAIDARDPYTRGHSERVSQYSLMMGKALGLPEQDLELLERAAFLHDIGKIGIRDHILLKESPLDNEEFIIMKTHTTIGQNILQQIEPNYLVQEISQGAACHHERYDGKGYPQGLQREEIPLAARIMAIADTFDAMVTDRPYRKGLPVKLALQEIKRCAGSQFDPQLAEIFL

SEQ ID NO: 2711 - protein, 539 aa, Artificial
  Substituion in SEQ ID NO 2704
MSAAGGIHSSEVCVRRDVGCGMSWTANYEFKRLVKRLILNYFAGSVIAVLGVGGVLIFTTLHLSQEDLWVICGILGGSLVLMLTADSIAFRVQIRPIRKALLTAHPTEDVLAKGYKRALHLPALAVLRVMGPHWLSFLIPGLVSSSILVRRGLLHLPMAYVWLASLGTLIVACMHAVIEFFLTSRSIEPTLVTIRRRSEHMYGASVLLRGQVVVPLAFKFAMSAVVFGALPLLLFGLANAVRLTHEGLGSSTYWTWAGGILALGSLFSAFGGYLLASDVQKPIRRLEALMRRVERGDFSLRADDTYMDEFSDLIQGFNLMLNGLAHRDAMNRQLIDSYFATLAAALDARDPYTAGHSQRVARYAEAIGRKVNLSPQTVRELRQSALLHDIGKIGIRDEILLKEGKLTDEEFAIIKQHPVIGENIIRQIQPDDAMKPLLPGIRSHHERYDGKGYPDGLAGEEIPLFGRILAVADAFDAMTSDRPYRSGMPVERAIQVLREGRGTQWDPHFVDAFIEVYREVYIPDEAKSAAREAAASTSQ

SEQ ID NO: 2712 - protein, 539 aa, Artificial
  Substituion in SEQ ID NO 2704
MSAAGGIHSSEVCVRRDVGCGMSWTANYEFKRLVKRLILNYFAGSVIAVLGVGGVLIFTTLHLSQEDLWVICGILGGSLVLMLTADSIAFRVQIRPIRKALLTAHPTEDVLAKGYKRALHLPALAVLRVMGPHWLSFLIPGLVSSSILVRRGLLHLPMAYVWLASLGTLIVACMHAVIEFFLTSRSIEPTLVTIRRRSEHMYGASVLLRGQVVVPLAFKFAMSAVVFGALPLLLFGLANAVRLTHEGLGSSTYWTWAGGILALGSLFSAFGGYLLASDVQRPIRRLEALMRRVERGDFSLRADDTYMDEFSDLIQGFNLMLNGLAHRDAMNRQLIDSYFATLAAALDARDPYTAGHSQRVARYAEAIGRKVNLSPQTVREIRQSALLHDIGKIGIRDEILLKEGKLTDEEFAIIKQHPVIGENIIRQIQPDDAMKPLLPGIRSHHERYDGKGYPDGLAGEEIPLFGRILAVADAFDAMTSDRPYRSGMPVERAIQVLREGRGTQWDPHFVDAFIEVYREVYIPDEAKSAAREAAASTSQ

SEQ ID NO: 2713 - protein, 539 aa, Artificial
  Substituion in SEQ ID NO 2704
MSAAGGIHSSEVCVRRDVGCGMSWTANYEFKRLVKRLILNYFAGSVIAVLGVGGVLIFTTLHLSQEDLWVICGILGGSLVLMLTADSIAFRVQIRPIRKALLTAHPTEDVLAKGYKRALHLPALAVLRVMGPHWLSFLIPGLVSSSILVRRGLLHLPMAYVWLASLGTLIVACMHAVIEFFLTSRSIEPTLVTIRRRSEHMYGASVLLRGQVVVPLAFKFAMSAVVFGALPLLLFGLANAVRLTHEGLGSSTYWTWAGGILALGSLFSAFGGYLLASDVQRPIRRLEALMKRVERGDFSLRADDTYMDEFSDLIQGFNLMLNGLAHRDAMNRQLIDSYFATLAAALDARDPYTAGHSQRVARYAEAIGRKVNLSPQTVRELRQSALLHDIGKIGIRDEILLKEGKLTDEEFAIIKQHPVIGENIIRQIQPDDAMKPLLPGIRSHHERYDGKGYPDGLAGEEIPLFGRILAVADAFDAMTSDRPYRSGMPVERAIQVLREGRGTQWDPHFVDAFIEVYREVYIPDEAKSAAREAAASTSQ

SEQ ID NO: 2714 - protein, 539 aa, Artificial
  Substituion in SEQ ID NO 2704
MSAAGGIHSSEVCVRRDVGCGMSWTANYEFKRLVKRLILNYFAGSVIAVLGVGGVLIFTTLHLSQEDLWVICGILGGSLVLMLTADSIAFRVQIRPIRKALLTAHPTEDVLAKGYKRALHLPALAVLRVMGPHWLSFLIPGLVSSSILVRKGLLHLPMAYVWLASLGTLIVACMHAVIEFFLTSRSIEPTLVTIRRRSEHMYGASVLLRGQVVVPLAFKFAMSAVVFGALPLLLFGLANAVRLTHEGLGSSTYWTWAGGILALGSLFSAFGGYLLASDVQRPIRRLEALMRRVERGDFSLRADDTYMDEFSDLIQGFNLMLNGLAHRDAMNRQLIDSYFATLAAALDARDPYTAGHSQRVARYAEAIGRKVNLSPQTVRELRQSALLHDIGKIGIRDEILLKEGKLTDEEFAIIKQHPVIGENIIRQIQPDDAMKPLLPGIRSHHERYDGKGYPDGLAGEEIPLFGRILAVADAFDAMTSDRPYRSGMPVERAIQVLREGRGTQWDPHFVDAFIEVYREVYIPDEAKSAAREAAASTSQ

SEQ ID NO: 2715 - protein, 539 aa, Artificial
  Substituion in SEQ ID NO 2704
MSAAGGIHSSEVCVRRDVGCGMSWTANYEFKRLVKRLILNYFAGSVIAVLGVGGVLIFTTLHLSQEDLWVICGILGGSLVLMLTADSIAFRVQIRPIRKALLTAHPTEDVLAKGYKRALHLPALAVLRVMGPHWLSFLIPGLVSSSILVRRGLLHLPMAYVWLASLGTLIVACMHAVIEFFLTSRSIEPTLVTIRRRSEHMYGASVLLRGQVVVPLAFKFAMSAVVFGALPLLLFGLANAVRLTHEGLGSSTYWTWAGGILALGSLFSAFGGYLLASDVQRPIRRLEALMRRVERGDFSLRADDTYMDEFSDLIQGFNLMLNGLAHRDAMNRQLIDSYFATLAAALDAKDPYTAGHSQRVARYAEAIGRKVNLSPQTVRELRQSALLHDIGKIGIRDEILLKEGKLTDEEFAIIKQHPVIGENIIRQIQPDDAMKPLLPGIRSHHERYDGKGYPDGLAGEEIPLFGRILAVADAFDAMTSDRPYRSGMPVERAIQVLREGRGTQWDPHFVDAFIEVYREVYIPDEAKSAAREAAASTSQ

SEQ ID NO: 2716 - DNA, 1620 bp, Artificial
  Substituion in SEQ ID NO 2705
ttgagcgcagcaggtggaattcattcgagtgaggtatgcgttcgacgggatgtggggtgcggtatgagctggacggcgaactacgaattcaagcgcttggtcaagcggctcatcctgaactacttcgcgggttccgtcatcgccgtcctcggcgtgggcggcgtgctcatcttcaccaccctccacctgagtcaagaagacctgtgggtcatctgcggcatcctcggcgggtcgctcgtgctgatgctcacggcggactccatcgcgtttcgcgtgcaaattcgcccgattcggaaagcgcttctcacagcccatccgacagaagacgtgcttgcgaagggatacaaacgagcgctgcacctgccggcgctggccgtgctccgcgtcatggggccgcactggctgtcgttcctcatcccagggctcgtgtcgtcgtccatcctcgtgcgccgaggactcctgcatctgccgatggcctacgtgtggctggcttcgctcggcacgctgattgtcgcctgcatgcacgccgtgatcgaattttttctcacctcgcgctccatcgagccgacgctcgtcaccatccggcgcaggagcgagcacatgtatggcgcgtccgtcttgctccgcggccaggtggtggtgccgcttgcgttcaaattcgcgatgagcgccgtcgtgtttggcgccctcccgctgctcttgttcggattggcgaacgccgttcgtctgacccacgagggactcggatcgtccacctactggacgtgggccggcggcatcctggcgctcggttcgctgttttccgccttcggcggatacctgttggcgagcgacgttcagaaacccatccgcaggctcgaggcgctgatgcgccgcgtggagcgtggggatttttccctgcgcgcggacgacacctacatggacgagttctccgatctcatccagggcttcaacctgatgctgaacggcctcgcgcaccgcgacgcgatgaaccgccagctcatcgacagctatttcgccacactggccgcggccctggacgcgcgagatccgtacaccgccggccattcgcagcgcgtcgcgcgctacgccgaggccatcggccgaaaagtgaacctgtccccacagaccgtgcgcgaactgaggcagtctgcgctcctgcacgacatcgggaagatcggcatccgcgacgagatcctgctaaaggaaggcaagctgacggacgaggagttcgccatcatcaaacagcaccccgtgatcggggaaaacatcatccgacagattcagccggacgacgccatgaagccgctgctgccgggcatccgctcgcaccacgagcggtatgacggcaaggggtatccggacggcctcgccggcgaggagattccgctgtttggccgcatcctcgccgtggccgacgcctttgacgccatgacgtccgaccgcccctaccgctccggcatgcccgtggagcgggccatccaggtgcttcgagaagggcgcggaacccagtgggatccgcatttcgtggatgcgttcatcgaggtgtatcgggaggtctacatcccggacgaggccaagtccgccgcgcgcgaggcggctgcctccacgagccagtga

SEQ ID NO: 2717 - DNA, 1620 bp, Artificial
  Substituion in SEQ ID NO 2705
ttgagcgcagcaggtggaattcattcgagtgaggtatgcgttcgacgggatgtggggtgcggtatgagctggacggcgaactacgaattcaagcgcttggtcaagcggctcatcctgaactacttcgcgggttccgtcatcgccgtcctcggcgtgggcggcgtgctcatcttcaccaccctccacctgagtcaagaagacctgtgggtcatctgcggcatcctcggcgggtcgctcgtgctgatgctcacggcggactccatcgcgtttcgcgtgcaaattcgcccgattcggaaagcgcttctcacagcccatccgacagaagacgtgcttgcgaagggatacaaacgagcgctgcacctgccggcgctggccgtgctccgcgtcatggggccgcactggctgtcgttcctcatcccagggctcgtgtcgtcgtccatcctcgtgcgccgaggactcctgcatctgccgatggcctacgtgtggctggcttcgctcggcacgctgattgtcgcctgcatgcacgccgtgatcgaattttttctcacctcgcgctccatcgagccgacgctcgtcaccatccggcgcaggagcgagcacatgtatggcgcgtccgtcttgctccgcggccaggtggtggtgccgcttgcgttcaaattcgcgatgagcgccgtcgtgtttggcgccctcccgctgctcttgttcggattggcgaacgccgttcgtctgacccacgagggactcggatcgtccacctactggacgtgggccggcggcatcctggcgctcggttcgctgttttccgccttcggcggatacctgttggcgagcgacgttcagcggcccatccgcaggctcgaggcgctgatgcgccgcgtggagcgtggggatttttccctgcgcgcggacgacacctacatggacgagttctccgatctcatccagggcttcaacctgatgctgaacggcctcgcgcaccgcgacgcgatgaaccgccagctcatcgacagctatttcgccacactggccgcggccctggacgcgcgagatccgtacaccgccggccattcgcagcgcgtcgcgcgctacgccgaggccatcggccgaaaagtgaacctgtccccacagaccgtgcgcgaaattaggcagtctgcgctcctgcacgacatcgggaagatcggcatccgcgacgagatcctgctaaaggaaggcaagctgacggacgaggagttcgccatcatcaaacagcaccccgtgatcggggaaaacatcatccgacagattcagccggacgacgccatgaagccgctgctgccgggcatccgctcgcaccacgagcggtatgacggcaaggggtatccggacggcctcgccggcgaggagattccgctgtttggccgcatcctcgccgtggccgacgcctttgacgccatgacgtccgaccgcccctaccgctccggcatgcccgtggagcgggccatccaggtgcttcgagaagggcgcggaacccagtgggatccgcatttcgtggatgcgttcatcgaggtgtatcgggaggtctacatcccggacgaggccaagtccgccgcgcgcgaggcggctgcctccacgagccagtga

SEQ ID NO: 2718 - DNA, 1620 bp, Artificial
  Substituion in SEQ ID NO 2705
ttgagcgcagcaggtggaattcattcgagtgaggtatgcgttcgacgggatgtggggtgcggtatgagctggacggcgaactacgaattcaagcgcttggtcaagcggctcatcctgaactacttcgcgggttccgtcatcgccgtcctcggcgtgggcggcgtgctcatcttcaccaccctccacctgagtcaagaagacctgtgggtcatctgcggcatcctcggcgggtcgctcgtgctgatgctcacggcggactccatcgcgtttcgcgtgcaaattcgcccgattcggaaagcgcttctcacagcccatccgacagaagacgtgcttgcgaagggatacaaacgagcgctgcacctgccggcgctggccgtgctccgcgtcatggggccgcactggctgtcgttcctcatcccagggctcgtgtcgtcgtccatcctcgtgcgccgaggactcctgcatctgccgatggcctacgtgtggctggcttcgctcggcacgctgattgtcgcctgcatgcacgccgtgatcgaattttttctcacctcgcgctccatcgagccgacgctcgtcaccatccggcgcaggagcgagcacatgtatggcgcgtccgtcttgctccgcggccaggtggtggtgccgcttgcgttcaaattcgcgatgagcgccgtcgtgtttggcgccctcccgctgctcttgttcggattggcgaacgccgttcgtctgacccacgagggactcggatcgtccacctactggacgtgggccggcggcatcctggcgctcggttcgctgttttccgccttcggcggatacctgttggcgagcgacgttcagcggcccatccgcaggctcgaggcgctgatgaaacgcgtggagcgtggggatttttccctgcgcgcggacgacacctacatggacgagttctccgatctcatccagggcttcaacctgatgctgaacggcctcgcgcaccgcgacgcgatgaaccgccagctcatcgacagctatttcgccacactggccgcggccctggacgcgcgagatccgtacaccgccggccattcgcagcgcgtcgcgcgctacgccgaggccatcggccgaaaagtgaacctgtccccacagaccgtgcgcgaactgaggcagtctgcgctcctgcacgacatcgggaagatcggcatccgcgacgagatcctgctaaaggaaggcaagctgacggacgaggagttcgccatcatcaaacagcaccccgtgatcggggaaaacatcatccgacagattcagccggacgacgccatgaagccgctgctgccgggcatccgctcgcaccacgagcggtatgacggcaaggggtatccggacggcctcgccggcgaggagattccgctgtttggccgcatcctcgccgtggccgacgcctttgacgccatgacgtccgaccgcccctaccgctccggcatgcccgtggagcgggccatccaggtgcttcgagaagggcgcggaacccagtgggatccgcatttcgtggatgcgttcatcgaggtgtatcgggaggtctacatcccggacgaggccaagtccgccgcgcgcgaggcggctgcctccacgagccagtga

SEQ ID NO: 2719 - DNA, 1620 bp, Artificial
  Substituion in SEQ ID NO 2705
ttgagcgcagcaggtggaattcattcgagtgaggtatgcgttcgacgggatgtggggtgcggtatgagctggacggcgaactacgaattcaagcgcttggtcaagcggctcatcctgaactacttcgcgggttccgtcatcgccgtcctcggcgtgggcggcgtgctcatcttcaccaccctccacctgagtcaagaagacctgtgggtcatctgcggcatcctcggcgggtcgctcgtgctgatgctcacggcggactccatcgcgtttcgcgtgcaaattcgcccgattcggaaagcgcttctcacagcccatccgacagaagacgtgcttgcgaagggatacaaacgagcgctgcacctgccggcgctggccgtgctccgcgtcatggggccgcactggctgtcgttcctcatcccagggctcgtgtcgtcgtccatcctcgtgcgcaaaggactcctgcatctgccgatggcctacgtgtggctggcttcgctcggcacgctgattgtcgcctgcatgcacgccgtgatcgaattttttctcacctcgcgctccatcgagccgacgctcgtcaccatccggcgcaggagcgagcacatgtatggcgcgtccgtcttgctccgcggccaggtggtggtgccgcttgcgttcaaattcgcgatgagcgccgtcgtgtttggcgccctcccgctgctcttgttcggattggcgaacgccgttcgtctgacccacgagggactcggatcgtccacctactggacgtgggccggcggcatcctggcgctcggttcgctgttttccgccttcggcggatacctgttggcgagcgacgttcagcggcccatccgcaggctcgaggcgctgatgcgccgcgtggagcgtggggatttttccctgcgcgcggacgacacctacatggacgagttctccgatctcatccagggcttcaacctgatgctgaacggcctcgcgcaccgcgacgcgatgaaccgccagctcatcgacagctatttcgccacactggccgcggccctggacgcgcgagatccgtacaccgccggccattcgcagcgcgtcgcgcgctacgccgaggccatcggccgaaaagtgaacctgtccccacagaccgtgcgcgaactgaggcagtctgcgctcctgcacgacatcgggaagatcggcatccgcgacgagatcctgctaaaggaaggcaagctgacggacgaggagttcgccatcatcaaacagcaccccgtgatcggggaaaacatcatccgacagattcagccggacgacgccatgaagccgctgctgccgggcatccgctcgcaccacgagcggtatgacggcaaggggtatccggacggcctcgccggcgaggagattccgctgtttggccgcatcctcgccgtggccgacgcctttgacgccatgacgtccgaccgcccctaccgctccggcatgcccgtggagcgggccatccaggtgcttcgagaagggcgcggaacccagtgggatccgcatttcgtggatgcgttcatcgaggtgtatcgggaggtctacatcccggacgaggccaagtccgccgcgcgcgaggcggctgcctccacgagccagtga

SEQ ID NO: 2720 - DNA, 1620 bp, Artificial
  Substituion in SEQ ID NO 2705
ttgagcgcagcaggtggaattcattcgagtgaggtatgcgttcgacgggatgtggggtgcggtatgagctggacggcgaactacgaattcaagcgcttggtcaagcggctcatcctgaactacttcgcgggttccgtcatcgccgtcctcggcgtgggcggcgtgctcatcttcaccaccctccacctgagtcaagaagacctgtgggtcatctgcggcatcctcggcgggtcgctcgtgctgatgctcacggcggactccatcgcgtttcgcgtgcaaattcgcccgattcggaaagcgcttctcacagcccatccgacagaagacgtgcttgcgaagggatacaaacgagcgctgcacctgccggcgctggccgtgctccgcgtcatggggccgcactggctgtcgttcctcatcccagggctcgtgtcgtcgtccatcctcgtgcgccgaggactcctgcatctgccgatggcctacgtgtggctggcttcgctcggcacgctgattgtcgcctgcatgcacgccgtgatcgaattttttctcacctcgcgctccatcgagccgacgctcgtcaccatccggcgcaggagcgagcacatgtatggcgcgtccgtcttgctccgcggccaggtggtggtgccgcttgcgttcaaattcgcgatgagcgccgtcgtgtttggcgccctcccgctgctcttgttcggattggcgaacgccgttcgtctgacccacgagggactcggatcgtccacctactggacgtgggccggcggcatcctggcgctcggttcgctgttttccgccttcggcggatacctgttggcgagcgacgttcagcggcccatccgcaggctcgaggcgctgatgcgccgcgtggagcgtggggatttttccctgcgcgcggacgacacctacatggacgagttctccgatctcatccagggcttcaacctgatgctgaacggcctcgcgcaccgcgacgcgatgaaccgccagctcatcgacagctatttcgccacactggccgcggccctggacgcgaaagatccgtacaccgccggccattcgcagcgcgtcgcgcgctacgccgaggccatcggccgaaaagtgaacctgtccccacagaccgtgcgcgaactgaggcagtctgcgctcctgcacgacatcgggaagatcggcatccgcgacgagatcctgctaaaggaaggcaagctgacggacgaggagttcgccatcatcaaacagcaccccgtgatcggggaaaacatcatccgacagattcagccggacgacgccatgaagccgctgctgccgggcatccgctcgcaccacgagcggtatgacggcaaggggtatccggacggcctcgccggcgaggagattccgctgtttggccgcatcctcgccgtggccgacgcctttgacgccatgacgtccgaccgcccctaccgctccggcatgcccgtggagcgggccatccaggtgcttcgagaagggcgcggaacccagtgggatccgcatttcgtggatgcgttcatcgaggtgtatcgggaggtctacatcccggacgaggccaagtccgccgcgcgcgaggcggctgcctccacgagccagtga

SEQ ID NO: 2721 - protein, 137 aa, Alicyclobacillus acidocaldarius
MMVIDVTNEEVLTCLHALADKSRFQILQMMAKGSIATCCDRIEAYENGCCVADVVAVTGLSQPTVSHHLKVLEKAGLVRRESRGPWTCYFPNSQALEEVVKALTSELMMPANVHNHEKGECCPCPDGSPMSPSTCET

SEQ ID NO: 2722 - DNA, 414 bp, Alicyclobacillus acidocaldarius
ttgatggtgatcgatgtgacgaacgaggaagtcttaacttgtcttcatgcattagcggacaaaagtcgatttcaaattcttcaaatgatggcgaagggctcaatcgcgacgtgttgtgatcggattgaggcgtatgaaaacggatgttgtgttgcggatgtggtagccgtcaccggactttcgcagccaaccgtctcacatcacctcaaagttcttgagaaggcgggattggttcgccgagaatcccgaggtccttggacgtgttattttccaaattcacaagcgttggaggaggtggtgaaagcactcacgtccgagctgatgatgccggccaacgtccacaatcatgagaagggagaatgttgtccatgtccagatggaagccccatgtcgccatcaacgtgcgaaacttag

SEQ ID NO: 2723 - protein, 92 aa, Mycobacterium vanbaalenii PYR-1
VPAERLAATFKALADPARVKLLSLIAAARDGEACICDLTAPLGLSQPTVSHHMKLLVDAGLVSRQQRGKWAYYRIQRDALDRVAQDVAALTS

SEQ ID NO: 2724 - protein, 82 aa, Kineococcus radiotolerans SRS30216
LKALADPARLRLLSLVAAHEGGEACVCDLTEPLGLSQPTVSHHLKVLVEAGLLTRDKRGVWAYFAVVPETLNALAAVLVTPA

SEQ ID NO: 2725 - protein, 85 aa, Salinispora tropica CNB-440
ERLAGVLKALADPARLRLLSLIQSAPEGEACVCDLTAPLGLSQPTVSHHLRILTEAGLLEREKRGVWAYYRLVPTAIATIADLLT

SEQ ID NO: 2726 - protein, 84 aa, Magnetospirillum magnetotacticum MS-1
ELARTFKALADPTRVQLLAIVAAQEGHEACVCDLTGPVGLSQPTVSHHLKILVDAGLLTREQRGRWAYYSLVPGALARVAGSLT

SEQ ID NO: 2727 - protein, 88 aa, Acidobacteria bacterium Ellin345
LRAVADPTRRRILRMLGEKGHCSIGESTGLCARDIEAKIKLSQPTVSHHMKILADAGLITGQRRGQWTWYRRDETAVRQMTKKFREEL

SEQ ID NO: 2728 - protein, 137 aa, Artificial
  Substituion in SEQ ID NO 2721
MMVIDVTNEEVLTCLHALADKSRFQILQMMAKGSIATCCDKIEAYENGCCVADVVAVTGLSQPTVSHHLKVLEKAGLVRRESRGPWTCYFPNSQALEEVVKALTSELMMPANVHNHEKGECCPCPDGSPMSPSTCET

SEQ ID NO: 2729 - protein, 137 aa, Artificial
  Substituion in SEQ ID NO 2721
MMVIDVTNEEVLTCLHALADKSRFQILQMMAKGSIATCCDRIEAYENGCCVADVVAVTGLSQPTVSHHLKVLEKAGLVRRESRGPWTCYFPNSQALEEVVKALTSELMMPANVHQHEKGECCPCPDGSPMSPSTCET

SEQ ID NO: 2730 - protein, 137 aa, Artificial
  Substituion in SEQ ID NO 2721
MMVIDVTNEEVLTCLHALADKSRFQILQMMAKGSIATCCDRIEAYENGCCVADVVAVTGLSQPTVSHHLKVLEKAGLVRRESRGPWTCYFPNSQALEEVVKALTSELMMPANVHNHEKGDCCPCPDGSPMSPSTCET

SEQ ID NO: 2731 - protein, 137 aa, Artificial
  Substituion in SEQ ID NO 2721
MMVIDVTNEEVLTCLHALADKSRFQILQMMAKGSIATCCDRIEAYENGCCVADVVAVTGLSQPTVSHHLKVLEKAGLVRRESRGPWTCYFPNSQALEEVVRALTSELMMPANVHNHEKGECCPCPDGSPMSPSTCET

SEQ ID NO: 2732 - protein, 137 aa, Artificial
  Substituion in SEQ ID NO 2721
MMVIDVTNEEVLTCLHALADKSRFQILQMMAKGSIATCCDRIEAYENGCCVADVVAITGLSQPTVSHHLKVLEKAGLVRRESRGPWTCYFPNSQALEEVVKALTSELMMPANVHNHEKGECCPCPDGSPMSPSTCET

SEQ ID NO: 2733 - DNA, 414 bp, Artificial
  Substituion in SEQ ID NO 2722
ttgatggtgatcgatgtgacgaacgaggaagtcttaacttgtcttcatgcattagcggacaaaagtcgatttcaaattcttcaaatgatggcgaagggctcaatcgcgacgtgttgtgataaaattgaggcgtatgaaaacggatgttgtgttgcggatgtggtagccgtcaccggactttcgcagccaaccgtctcacatcacctcaaagttcttgagaaggcgggattggttcgccgagaatcccgaggtccttggacgtgttattttccaaattcacaagcgttggaggaggtggtgaaagcactcacgtccgagctgatgatgccggccaacgtccacaatcatgagaagggagaatgttgtccatgtccagatggaagccccatgtcgccatcaacgtgcgaaacttag

SEQ ID NO: 2734 - DNA, 414 bp, Artificial
  Substituion in SEQ ID NO 2722
ttgatggtgatcgatgtgacgaacgaggaagtcttaacttgtcttcatgcattagcggacaaaagtcgatttcaaattcttcaaatgatggcgaagggctcaatcgcgacgtgttgtgatcggattgaggcgtatgaaaacggatgttgtgttgcggatgtggtagccgtcaccggactttcgcagccaaccgtctcacatcacctcaaagttcttgagaaggcgggattggttcgccgagaatcccgaggtccttggacgtgttattttccaaattcacaagcgttggaggaggtggtgaaagcactcacgtccgagctgatgatgccggccaacgtccaccaacatgagaagggagaatgttgtccatgtccagatggaagccccatgtcgccatcaacgtgcgaaacttag

SEQ ID NO: 2735 - DNA, 414 bp, Artificial
  Substituion in SEQ ID NO 2722
ttgatggtgatcgatgtgacgaacgaggaagtcttaacttgtcttcatgcattagcggacaaaagtcgatttcaaattcttcaaatgatggcgaagggctcaatcgcgacgtgttgtgatcggattgaggcgtatgaaaacggatgttgtgttgcggatgtggtagccgtcaccggactttcgcagccaaccgtctcacatcacctcaaagttcttgagaaggcgggattggttcgccgagaatcccgaggtccttggacgtgttattttccaaattcacaagcgttggaggaggtggtgaaagcactcacgtccgagctgatgatgccggccaacgtccacaatcatgagaagggagattgttgtccatgtccagatggaagccccatgtcgccatcaacgtgcgaaacttag

SEQ ID NO: 2736 - DNA, 414 bp, Artificial
  Substituion in SEQ ID NO 2722
ttgatggtgatcgatgtgacgaacgaggaagtcttaacttgtcttcatgcattagcggacaaaagtcgatttcaaattcttcaaatgatggcgaagggctcaatcgcgacgtgttgtgatcggattgaggcgtatgaaaacggatgttgtgttgcggatgtggtagccgtcaccggactttcgcagccaaccgtctcacatcacctcaaagttcttgagaaggcgggattggttcgccgagaatcccgaggtccttggacgtgttattttccaaattcacaagcgttggaggaggtggtgcgtgcactcacgtccgagctgatgatgccggccaacgtccacaatcatgagaagggagaatgttgtccatgtccagatggaagccccatgtcgccatcaacgtgcgaaacttag

SEQ ID NO: 2737 - DNA, 414 bp, Artificial
  Substituion in SEQ ID NO 2722
ttgatggtgatcgatgtgacgaacgaggaagtcttaacttgtcttcatgcattagcggacaaaagtcgatttcaaattcttcaaatgatggcgaagggctcaatcgcgacgtgttgtgatcggattgaggcgtatgaaaacggatgttgtgttgcggatgtggtagccattaccggactttcgcagccaaccgtctcacatcacctcaaagttcttgagaaggcgggattggttcgccgagaatcccgaggtccttggacgtgttattttccaaattcacaagcgttggaggaggtggtgaaagcactcacgtccgagctgatgatgccggccaacgtccacaatcatgagaagggagaatgttgtccatgtccagatggaagccccatgtcgccatcaacgtgcgaaacttag

SEQ ID NO: 2738 - protein, 82 aa, Alicyclobacillus acidocaldarius
MSSFPERLSELLSATNSTKRALARAIGISERMIQYYITGAKSPTLDVLVAMADYFNVGLDYLAGRSDDPTPPPRSPSSGWDP

SEQ ID NO: 2739 - DNA, 249 bp, Alicyclobacillus acidocaldarius
atgtcctcatttccggaacgcttgtcagaacttttgtctgcgaccaattcaacaaaacgtgccctagcgcgcgcgattgggatatcagagcgcatgattcagtactacatcactggcgctaagagccccactctcgatgttcttgtggcgatggccgactactttaatgtggggctcgactacttagccgggcgttccgatgaccccacgcccccaccccgctccccctcatctgggtgggatccgtag

SEQ ID NO: 2740 - protein, 59 aa, Thermoanaerobacter pseudethanolicus ATCC 33223
KRIKELRKKKGITQKELASYLGISDRAVGYYESGQRTPPPDILQKIADFFNVSTDYLLG

SEQ ID NO: 2741 - protein, 61 aa, Pelotomaculum thermopropionicum SI
FAKRLSFLITKNKLSKQAVANAINVSRPAVSQFANGENLPSVEKLIALADFFDVSLDYLVG

SEQ ID NO: 2742 - protein, 61 aa, Bacillus halodurans C-125
FPERLRYLRKKHGLTMKELGKKINVAESTISGYENGNRKPDMDTLVKMAEYFNSSTDYLLG

SEQ ID NO: 2743 - protein, 59 aa, Bacteroides capillosus ATCC 29799
FEERLYQLRRERGISQEELANIIGVSRQAVQKWESGASQPNIDNLVAISEYFGVTLDYL

SEQ ID NO: 2744 - protein, 58 aa, Bacillus cereus E33L
RIKSLRKKENLTQKQLAEKIGVSQRMIGYYESEERFPPHDVLSKLADCFSVSADYLLG

SEQ ID NO: 2745 - protein, 82 aa, Artificial
  Substituion in SEQ ID NO 2738
MSSFPERLSELLSATNSTKRALARAIGISERMIQYYITGAKSPTLEVLVAMADYFNVGLDYLAGRSDDPTPPPRSPSSGWDP

SEQ ID NO: 2746 - protein, 82 aa, Artificial
  Substituion in SEQ ID NO 2738
MSSFPERLSELISATNSTKRALARAIGISERMIQYYITGAKSPTLDVLVAMADYFNVGLDYLAGRSDDPTPPPRSPSSGWDP

SEQ ID NO: 2747 - protein, 82 aa, Artificial
  Substituion in SEQ ID NO 2738
MSSFPERLSELLSATNSTKRALARAIGISERMIQYYITGAKSPTLDVLVAMADYFNVGIDYLAGRSDDPTPPPRSPSSGWDP

SEQ ID NO: 2748 - protein, 82 aa, Artificial
  Substituion in SEQ ID NO 2738
MSSFPERLSELLSATNSTKRALARAIGISERMIQYYITGAKSPTLDVLVAMADYFQVGLDYLAGRSDDPTPPPRSPSSGWDP

SEQ ID NO: 2749 - protein, 82 aa, Artificial
  Substituion in SEQ ID NO 2738
MSSFPERLSELLSATNSTKRAIARAIGISERMIQYYITGAKSPTLDVLVAMADYFNVGLDYLAGRSDDPTPPPRSPSSGWDP

SEQ ID NO: 2750 - DNA, 249 bp, Artificial
  Substituion in SEQ ID NO 2739
atgtcctcatttccggaacgcttgtcagaacttttgtctgcgaccaattcaacaaaacgtgccctagcgcgcgcgattgggatatcagagcgcatgattcagtactacatcactggcgctaagagccccactctcgaagttcttgtggcgatggccgactactttaatgtggggctcgactacttagccgggcgttccgatgaccccacgcccccaccccgctccccctcatctgggtgggatccgtag

SEQ ID NO: 2751 - DNA, 249 bp, Artificial
  Substituion in SEQ ID NO 2739
atgtcctcatttccggaacgcttgtcagaacttatttctgcgaccaattcaacaaaacgtgccctagcgcgcgcgattgggatatcagagcgcatgattcagtactacatcactggcgctaagagccccactctcgatgttcttgtggcgatggccgactactttaatgtggggctcgactacttagccgggcgttccgatgaccccacgcccccaccccgctccccctcatctgggtgggatccgtag

SEQ ID NO: 2752 - DNA, 249 bp, Artificial
  Substituion in SEQ ID NO 2739
atgtcctcatttccggaacgcttgtcagaacttttgtctgcgaccaattcaacaaaacgtgccctagcgcgcgcgattgggatatcagagcgcatgattcagtactacatcactggcgctaagagccccactctcgatgttcttgtggcgatggccgactactttaatgtggggattgactacttagccgggcgttccgatgaccccacgcccccaccccgctccccctcatctgggtgggatccgtag

SEQ ID NO: 2753 - DNA, 249 bp, Artificial
  Substituion in SEQ ID NO 2739
atgtcctcatttccggaacgcttgtcagaacttttgtctgcgaccaattcaacaaaacgtgccctagcgcgcgcgattgggatatcagagcgcatgattcagtactacatcactggcgctaagagccccactctcgatgttcttgtggcgatggccgactactttcaagtggggctcgactacttagccgggcgttccgatgaccccacgcccccaccccgctccccctcatctgggtgggatccgtag

SEQ ID NO: 2754 - DNA, 249 bp, Artificial
  Substituion in SEQ ID NO 2739
atgtcctcatttccggaacgcttgtcagaacttttgtctgcgaccaattcaacaaaacgtgccattgcgcgcgcgattgggatatcagagcgcatgattcagtactacatcactggcgctaagagccccactctcgatgttcttgtggcgatggccgactactttaatgtggggctcgactacttagccgggcgttccgatgaccccacgcccccaccccgctccccctcatctgggtgggatccgtag

SEQ ID NO: 2755 - protein, 201 aa, Alicyclobacillus acidocaldarius
MILFDISNILIHMNIMKIVSNNLRALRLARGWSISELERRSGVAKGTISQLESGYGNPTVATLWSLASALSVPFSDLIQTAKETESVHESPVLAEPSGTTRFVDRVTMEGMIEIYEMVLSKDDERVSEAHPLGIMEHILVVQGRMEVGPIGQEIALNPGSYTTFPGYVRHVYRSLDEEARAVLWLVYPSIRAGHEGEGATL

SEQ ID NO: 2756 - DNA, 606 bp, Alicyclobacillus acidocaldarius
ttgattttgttcgatatatcgaatatactcatccacatgaatatcatgaaaattgtttcaaacaacttgagggcgctgcgcctagctcgcggatggtccatctcggaactcgaacgccgatcgggtgtggccaagggcacgatttcgcaacttgaatctggatatggcaaccccacggttgcgactctgtggtcgctcgcctcggccctgtcggtcccgttcagcgatctcatacaaacagcgaaggagaccgagtcagtacacgaatctcctgtgctcgcagagccatcaggcaccacgcgttttgtcgaccgtgtgacgatggagggaatgatcgagatctatgagatggtgttgtcgaaggacgacgaacgcgtttcggaagcgcacccgctcggcattatggagcacattcttgtcgttcaaggtcgcatggaagtaggaccgataggtcaagagattgcactcaatccaggcagctacacgacgttccctggctacgtccgacatgtgtaccgctcgctcgatgaagaggctcgagccgttctctggctcgtgtatccctctatccgagcaggtcacgagggagaaggtgctacgctatga

SEQ ID NO: 2757 - protein, 175 aa, Saccharopolyspora erythraea NRRL 2338
MLAANLRALRERAGLSLSEVARRSGIAKGTLSQLESGAGNPTIETVFSLSNALSVPVSSLLTERLDPEVVLVRSRGLEVLSSNAVDLRMLRRMDLTETVFELYDQRVRPGEVQRSEGHPGREHVVVTSGVLRVGPPDSPFELEAGDYVCFPARQPHIYETVGGPVVSVLLLEYPA

SEQ ID NO: 2758 - protein, 175 aa, Nocardia farcinica IFM 10152
VIAASLRRERTRAGLSLSEVAARAGIAKSTLSQLESGSGNPSLETLWALCVALDMPFSRLLDPPRPVVHVIRAGEGPAVAAERSDYHATLLAAGPSNTRRDLFRITAEPGQPRESQPHIPGVIEHILLAAGRALVGPTGEPVELAPGDYIAYPGDAPHVFEALEPGTWATLVIEY

SEQ ID NO: 2759 - protein, 173 aa, Acinetobacter sp. ADP1
IEIVAKGLHRERQKAGLSLAELARRAGIAKSTLSQLEAAQGNPSLETLWSLCVALEIPFAKLMESNIPQTQVIRFGEGPSVASEIAHYQAILLANCPTGARRDVYILNTQPGEPRLSHPHPIGSIEHIIIMKGCAKVGLTAEPVVLNEGDYICYPADQEHIFEALDEDTRAIL

SEQ ID NO: 2760 - protein, 170 aa, Rhodococcus sp. RHA1
IGPSLRRERERSGMSLTEVARRAGVAKSTLSQLESGGGNPSVETLWALCVALDVQMSQLLDPPRPRVQVIRADEGPELTSDRSDYRATLVASSPPSARRDLYRLAVEPGPARESEPHMPGVVEHVILSAGRALVGVAGDPVELGPGDYIAYPGDVAHVFEALEAGTRAVL

SEQ ID NO: 2761 - protein, 173 aa, Klebsiella pneumoniae subsp. pneumoniae MGH 78578
ISVIAKSLVRERARTGLSLAEVARRAGIAKSTLSQLESGNGNPSLETLWSLCVALDIPFARLLEPQVNKTQVIRRGEGTKVVAEQANYQAILLAACPPGARRDIYLLLTQPGADRISHPHPPGSVEHIIVTQGRARVGLTSAPEELGEGDYICYPADQEHVFQALEPDTQALL

SEQ ID NO: 2762 - protein, 201 aa, Artificial
  Substituion in SEQ ID NO 2755
MILFDISNILIHMNIMKIVSNNLRALRLARGWSISELERRSGVAKGTISQLESGYGNPTVATLWSLASALSVPFSDLIQTAKETESVHESPVLAEPSGTTRFVDRVTMEGMIEIYEMVLSKDDERVSEAHPLGIMEHILIVQGRMEVGPIGQEIALNPGSYTTFPGYVRHVYRSLDEEARAVLWLVYPSIRAGHEGEGATL

SEQ ID NO: 2763 - protein, 201 aa, Artificial
  Substituion in SEQ ID NO 2755
MILFDISNILIHMNIMKIVSNNLRALRLARGWSISELERRSGVAKGTISQLESGYGNPTVATLWSLASALSVPFSDLLQTAKETESVHESPVLAEPSGTTRFVDRVTMEGMIEIYEMVLSKDDERVSEAHPLGIMEHILVVQGRMEVGPIGQEIALNPGSYTTFPGYVRHVYRSLDEEARAVLWLVYPSIRAGHEGEGATL

SEQ ID NO: 2764 - protein, 201 aa, Artificial
  Substituion in SEQ ID NO 2755
MILFDISQILIHMNIMKIVSNNLRALRLARGWSISELERRSGVAKGTISQLESGYGNPTVATLWSLASALSVPFSDLIQTAKETESVHESPVLAEPSGTTRFVDRVTMEGMIEIYEMVLSKDDERVSEAHPLGIMEHILVVQGRMEVGPIGQEIALNPGSYTTFPGYVRHVYRSLDEEARAVLWLVYPSIRAGHEGEGATL

SEQ ID NO: 2765 - protein, 201 aa, Artificial
  Substituion in SEQ ID NO 2755
MILFDISNILIHMNIMKIVSNNLRALRLARGWSISELERRSGVAKGTISQLESGYGNPTVATLWSLASALSVPFSDLIQTAKETESVHESPVLAEPSGTTRFVDRVTMEGMIEIYEMVLSKDDERVSEAHPLGIMEHILVVQGRMDVGPIGQEIALNPGSYTTFPGYVRHVYRSLDEEARAVLWLVYPSIRAGHEGEGATL

SEQ ID NO: 2766 - protein, 201 aa, Artificial
  Substituion in SEQ ID NO 2755
MILFDISNILIHMNLMKIVSNNLRALRLARGWSISELERRSGVAKGTISQLESGYGNPTVATLWSLASALSVPFSDLIQTAKETESVHESPVLAEPSGTTRFVDRVTMEGMIEIYEMVLSKDDERVSEAHPLGIMEHILVVQGRMEVGPIGQEIALNPGSYTTFPGYVRHVYRSLDEEARAVLWLVYPSIRAGHEGEGATL

SEQ ID NO: 2767 - DNA, 606 bp, Artificial
  Substituion in SEQ ID NO 2756
ttgattttgttcgatatatcgaatatactcatccacatgaatatcatgaaaattgtttcaaacaacttgagggcgctgcgcctagctcgcggatggtccatctcggaactcgaacgccgatcgggtgtggccaagggcacgatttcgcaacttgaatctggatatggcaaccccacggttgcgactctgtggtcgctcgcctcggccctgtcggtcccgttcagcgatctcatacaaacagcgaaggagaccgagtcagtacacgaatctcctgtgctcgcagagccatcaggcaccacgcgttttgtcgaccgtgtgacgatggagggaatgatcgagatctatgagatggtgttgtcgaaggacgacgaacgcgtttcggaagcgcacccgctcggcattatggagcacattcttattgttcaaggtcgcatggaagtaggaccgataggtcaagagattgcactcaatccaggcagctacacgacgttccctggctacgtccgacatgtgtaccgctcgctcgatgaagaggctcgagccgttctctggctcgtgtatccctctatccgagcaggtcacgagggagaaggtgctacgctatga

SEQ ID NO: 2768 - DNA, 606 bp, Artificial
  Substituion in SEQ ID NO 2756
ttgattttgttcgatatatcgaatatactcatccacatgaatatcatgaaaattgtttcaaacaacttgagggcgctgcgcctagctcgcggatggtccatctcggaactcgaacgccgatcgggtgtggccaagggcacgatttcgcaacttgaatctggatatggcaaccccacggttgcgactctgtggtcgctcgcctcggccctgtcggtcccgttcagcgatctcttacaaacagcgaaggagaccgagtcagtacacgaatctcctgtgctcgcagagccatcaggcaccacgcgttttgtcgaccgtgtgacgatggagggaatgatcgagatctatgagatggtgttgtcgaaggacgacgaacgcgtttcggaagcgcacccgctcggcattatggagcacattcttgtcgttcaaggtcgcatggaagtaggaccgataggtcaagagattgcactcaatccaggcagctacacgacgttccctggctacgtccgacatgtgtaccgctcgctcgatgaagaggctcgagccgttctctggctcgtgtatccctctatccgagcaggtcacgagggagaaggtgctacgctatga

SEQ ID NO: 2769 - DNA, 606 bp, Artificial
  Substituion in SEQ ID NO 2756
ttgattttgttcgatatatcgcaaatactcatccacatgaatatcatgaaaattgtttcaaacaacttgagggcgctgcgcctagctcgcggatggtccatctcggaactcgaacgccgatcgggtgtggccaagggcacgatttcgcaacttgaatctggatatggcaaccccacggttgcgactctgtggtcgctcgcctcggccctgtcggtcccgttcagcgatctcatacaaacagcgaaggagaccgagtcagtacacgaatctcctgtgctcgcagagccatcaggcaccacgcgttttgtcgaccgtgtgacgatggagggaatgatcgagatctatgagatggtgttgtcgaaggacgacgaacgcgtttcggaagcgcacccgctcggcattatggagcacattcttgtcgttcaaggtcgcatggaagtaggaccgataggtcaagagattgcactcaatccaggcagctacacgacgttccctggctacgtccgacatgtgtaccgctcgctcgatgaagaggctcgagccgttctctggctcgtgtatccctctatccgagcaggtcacgagggagaaggtgctacgctatga

SEQ ID NO: 2770 - DNA, 606 bp, Artificial
  Substituion in SEQ ID NO 2756
ttgattttgttcgatatatcgaatatactcatccacatgaatatcatgaaaattgtttcaaacaacttgagggcgctgcgcctagctcgcggatggtccatctcggaactcgaacgccgatcgggtgtggccaagggcacgatttcgcaacttgaatctggatatggcaaccccacggttgcgactctgtggtcgctcgcctcggccctgtcggtcccgttcagcgatctcatacaaacagcgaaggagaccgagtcagtacacgaatctcctgtgctcgcagagccatcaggcaccacgcgttttgtcgaccgtgtgacgatggagggaatgatcgagatctatgagatggtgttgtcgaaggacgacgaacgcgtttcggaagcgcacccgctcggcattatggagcacattcttgtcgttcaaggtcgcatggatgtaggaccgataggtcaagagattgcactcaatccaggcagctacacgacgttccctggctacgtccgacatgtgtaccgctcgctcgatgaagaggctcgagccgttctctggctcgtgtatccctctatccgagcaggtcacgagggagaaggtgctacgctatga

SEQ ID NO: 2771 - DNA, 606 bp, Artificial
  Substituion in SEQ ID NO 2756
ttgattttgttcgatatatcgaatatactcatccacatgaatttaatgaaaattgtttcaaacaacttgagggcgctgcgcctagctcgcggatggtccatctcggaactcgaacgccgatcgggtgtggccaagggcacgatttcgcaacttgaatctggatatggcaaccccacggttgcgactctgtggtcgctcgcctcggccctgtcggtcccgttcagcgatctcatacaaacagcgaaggagaccgagtcagtacacgaatctcctgtgctcgcagagccatcaggcaccacgcgttttgtcgaccgtgtgacgatggagggaatgatcgagatctatgagatggtgttgtcgaaggacgacgaacgcgtttcggaagcgcacccgctcggcattatggagcacattcttgtcgttcaaggtcgcatggaagtaggaccgataggtcaagagattgcactcaatccaggcagctacacgacgttccctggctacgtccgacatgtgtaccgctcgctcgatgaagaggctcgagccgttctctggctcgtgtatccctctatccgagcaggtcacgagggagaaggtgctacgctatga

SEQ ID NO: 2772 - protein, 155 aa, Alicyclobacillus acidocaldarius
MSGCVSSLPFILALCVSSAAPRVRALGGAWLRLGHRLAIGAAFTVCATASHCCPTRCRMDDHEAAKLRRRIRMLVTGYVRKVDHLGRLVIPKRLRKDLAIGQDDSIEIYVEGDAVVLSKYEPKCVFCGEKAEKVFHERGVCGTCLEELKAKSKVS

SEQ ID NO: 2773 - DNA, 468 bp, Alicyclobacillus acidocaldarius
gtgagcggttgtgtttcatcactaccattcatactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgatcatgaggcggcgaaattgaggaggagaattcgtatgcttgtgacaggttacgtgcggaaggtcgatcatctcgggcgactcgtgatcccgaagcgcctgcggaaagaccttgccattgggcaagatgattcgatcgagatctacgtggaaggcgacgccgtcgttctgagcaagtacgagcccaaatgcgtgttctgcggcgagaaagccgagaaggtctttcacgagcgaggcgtctgcgggacgtgcttggaggagttgaaggcgaagagcaaagtaagctga

SEQ ID NO: 2774 - protein, 75 aa, Thermoanaerobacter pseudethanolicus ATCC 33223
TGIVRKVDELGRVVIPIELRRTLNIAERDALEIYVDGEQIVLKKYEPACIFCGNAENVINYKGKNICKNCLEELK

SEQ ID NO: 2775 - protein, 78 aa, Alkaliphilus metalliredigens QYMF; identical to SEQ ID NO: 2302

SEQ ID NO: 2776 - protein, 75 aa, Thermoanaerobacter tengcongensis MB4; identical to SEQ ID NO: 2774

SEQ ID NO: 2777 - protein, 78 aa, Caldicellulosiruptor saccharolyticus DSM 8903; identical to SEQ ID NO: 2299

SEQ ID NO: 2778 - protein, 78 aa, Clostridium acetobutylicum ATCC 824; identical to SEQ ID NO: 2298

SEQ ID NO: 2779 - protein, 155 aa, Artificial
  Substituion in SEQ ID NO 2772
MSGCVSSLPFILALCVSSAAPRVRALGGAWLRLGHRLAIGAAFTVCATASHCCPTRCRMDDHEAAKLRRRIRMLVTGYVRKVDHLGRLVIPRRLRKDLAIGQDDSIEIYVEGDAVVLSKYEPKCVFCGEKAEKVFHERGVCGTCLEELKAKSKVS

SEQ ID NO: 2780 - protein, 155 aa, Artificial
  Substituion in SEQ ID NO 2772
MSGCVSSLPFILALCVSSAAPRVRALGGAWLRLGHRLAIGAAFTICATASHCCPTRCRMDDHEAAKLRRRIRMLVTGYVRKVDHLGRLVIPKRLRKDLAIGQDDSIEIYVEGDAVVLSKYEPKCVFCGEKAEKVFHERGVCGTCLEELKAKSKVS

SEQ ID NO: 2781 - protein, 155 aa, Artificial
  Substituion in SEQ ID NO 2772
MSGCVSSLPFILALCVSSAAPRVRALGGAWLRLGHRLAIGAAFTVCATASHCCPTRCRMDDHEAAKLRRRIRMLVTGYVRKVDHLGRLVIPKRLRKDLAIGQDDSIEIYVEGDAVVLSKYEPKCVFCGEKADKVFHERGVCGTCLEELKAKSKVS

SEQ ID NO: 2782 - protein, 155 aa, Artificial
  Substituion in SEQ ID NO 2772
MSGCVSSLPFILALCVSSAAPRVRALGGAWLRLGHRLAIGAAFTVCATASHCCPTRCRMDDHEAAKLRRRIRMLVTGYVRKVDHLGRLVIPKKLRKDLAIGQDDSIEIYVEGDAVVLSKYEPKCVFCGEKAEKVFHERGVCGTCLEELKAKSKVS

SEQ ID NO: 2783 - protein, 155 aa, Artificial
  Substituion in SEQ ID NO 2772
MSGCVSSLPFILALCVSSAAPRVRALGGAWLRLGHRLAIGAAFTVCATASHCCPTRCRMDDHEAAKLRRRIKMLVTGYVRKVDHLGRLVIPKRLRKDLAIGQDDSIEIYVEGDAVVLSKYEPKCVFCGEKAEKVFHERGVCGTCLEELKAKSKVS

SEQ ID NO: 2784 - DNA, 468 bp, Artificial
  Substituion in SEQ ID NO 2773
gtgagcggttgtgtttcatcactaccattcatactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgatcatgaggcggcgaaattgaggaggagaattcgtatgcttgtgacaggttacgtgcggaaggtcgatcatctcgggcgactcgtgatcccgcgtcgcctgcggaaagaccttgccattgggcaagatgattcgatcgagatctacgtggaaggcgacgccgtcgttctgagcaagtacgagcccaaatgcgtgttctgcggcgagaaagccgagaaggtctttcacgagcgaggcgtctgcgggacgtgcttggaggagttgaaggcgaagagcaaagtaagctga

SEQ ID NO: 2785 - DNA, 468 bp, Artificial
  Substituion in SEQ ID NO 2773
gtgagcggttgtgtttcatcactaccattcatactcgcattatgcgtatcatccgctgctccacgagttcgggcgctcggtggtgcatggcttcggctggggcatcggctggcaattggcgcggcatttaccatttgcgctactgcttctcattgttgtcctactcggtgtaggatggatgatcatgaggcggcgaaattgaggaggagaattcgtatgcttgtgacaggttacgtgcggaaggtcgatcatctcgggcgactcgtgatcccgaagcgcctgcggaaagaccttgccattgggcaagatgattcgatcgagatctacgtggaaggcgacgccgtcgttctgagcaagtacgagcccaaatgcgtgttctgcggcgagaaagccgagaaggtctttcacgagcgaggcgtctgcgggacgtgcttggaggagttgaaggcgaagagcaaagtaagctga

SEQ ID NO: 2786 - DNA, 468 bp, Artificial
  Substituion in SEQ ID NO 2773
gtgagcggttgtgtttcatcactaccattcatactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgatcatgaggcggcgaaattgaggaggagaattcgtatgcttgtgacaggttacgtgcggaaggtcgatcatctcgggcgactcgtgatcccgaagcgcctgcggaaagaccttgccattgggcaagatgattcgatcgagatctacgtggaaggcgacgccgtcgttctgagcaagtacgagcccaaatgcgtgttctgcggcgagaaagccgataaggtctttcacgagcgaggcgtctgcgggacgtgcttggaggagttgaaggcgaagagcaaagtaagctga

SEQ ID NO: 2787 - DNA, 468 bp, Artificial
  Substituion in SEQ ID NO 2773
gtgagcggttgtgtttcatcactaccattcatactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgatcatgaggcggcgaaattgaggaggagaattcgtatgcttgtgacaggttacgtgcggaaggtcgatcatctcgggcgactcgtgatcccgaagaaactgcggaaagaccttgccattgggcaagatgattcgatcgagatctacgtggaaggcgacgccgtcgttctgagcaagtacgagcccaaatgcgtgttctgcggcgagaaagccgagaaggtctttcacgagcgaggcgtctgcgggacgtgcttggaggagttgaaggcgaagagcaaagtaagctga

SEQ ID NO: 2788 - DNA, 468 bp, Artificial
  Substituion in SEQ ID NO 2773
gtgagcggttgtgtttcatcactaccattcatactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgatcatgaggcggcgaaattgaggaggagaattaaaatgcttgtgacaggttacgtgcggaaggtcgatcatctcgggcgactcgtgatcccgaagcgcctgcggaaagaccttgccattgggcaagatgattcgatcgagatctacgtggaaggcgacgccgtcgttctgagcaagtacgagcccaaatgcgtgttctgcggcgagaaagccgagaaggtctttcacgagcgaggcgtctgcgggacgtgcttggaggagttgaaggcgaagagcaaagtaagctga

SEQ ID NO: 2789 - protein, 223 aa, Alicyclobacillus acidocaldarius
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGDYIFPGDLVIVKYTSNFSPQDICVVAINGEEATLKRVKCQGDICILTPSNPSMEPMVYNSVDVHVIGVVVEVRRRLRNK

SEQ ID NO: 2790 - DNA, 672 bp, Alicyclobacillus acidocaldarius
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacttggtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgatgttcatgtcataggagtcgttgtcgaagtcagaagacgattacgtaacaaataa

SEQ ID NO: 2791 - protein, 83 aa, Bacillus subtilis
MSPFGQQLRELRRARKLTVNQLAVYSGISSATISKIENGKRGTPKPATIKKLAAVLKVPYENLMAAAGHIRAFPEEIREASES

SEQ ID NO: 2792 - protein, 83 aa, Bacillus amyloliquefaciens FZB42
MNTFGKQLRELRRARKLTVNQLAVYSGVSSATISRIENGHRGIPKPATIRKLADTLKIPYEELMARAGHIKAFQEEIRETSES

SEQ ID NO: 2793 - protein, 82 aa, Bacillus subtilis subsp. subtilis str. 168
MSPFGQQLRELRRARKLTVNQLAVYSGISSATISKIENGKRGTPKPATIKKLAAVLKVPYENLMAAAGHIQAFPEEIREASE

SEQ ID NO: 2794 - protein, 80 aa, Bacillus licheniformis ATCC 14580
MTNFGHHLRQLRERKKLTVNQLAMYSGVSSAGISRIENGKRGVPKPATIRKLADALKVPYEELMASAGYISASTVQEARS

SEQ ID NO: 2795 - protein, 72 aa, Bacillus subtilis subsp. subtilis str. 168
MESFGEQLRALREERKLTVNQLATYSGVSAAGISRIENGKRGVPKPATIKKLAEALKIPYEGLMYKAGYIEE

SEQ ID NO: 2796 - protein, 223 aa, Artificial
  Substituion in SEQ ID NO 2789
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGDYIFPGDIVIVKYTSNFSPQDICVVAINGEEATLKRVKCQGDICILTPSNPSMEPMVYNSVDVHVIGVVVEVRRRLRNK

SEQ ID NO: 2797 - protein, 223 aa, Artificial
  Substituion in SEQ ID NO 2789
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGDYIFPGDLVIVKYTSNFSPQDICVVAINGEEATLRRVKCQGDICILTPSNPSMEPMVYNSVDVHVIGVVVEVRRRLRNK

SEQ ID NO: 2798 - protein, 223 aa, Artificial
  Substituion in SEQ ID NO 2789
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGDYIFPGDLVIVKYTSNFSPQDICVVAINGEEATLKRVKCQGDICILTPSNPSMEPMVYNSVEVHVIGVVVEVRRRLRNK

SEQ ID NO: 2799 - protein, 223 aa, Artificial
  Substituion in SEQ ID NO 2789
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGDYIFPGDLVIVKYTSNFSPNDICVVAINGEEATLKRVKCQGDICILTPSNPSMEPMVYNSVDVHVIGVVVEVRRRLRNK

SEQ ID NO: 2800 - protein, 223 aa, Artificial
  Substituion in SEQ ID NO 2789
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGDYIFPGDLVIVKYTSNFSPQDICVVAINGEEATLKRVKCQGDICILTPSNPSMEPMVYNSVDVHVIGVVVEVRRRLKNK

SEQ ID NO: 2801 - DNA, 672 bp, Artificial
  Substituion in SEQ ID NO 2790
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacattgtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgatgttcatgtcataggagtcgttgtcgaagtcagaagacgattacgtaacaaataa

SEQ ID NO: 2802 - DNA, 672 bp, Artificial
  Substituion in SEQ ID NO 2790
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacttggtcatcgtcaagtatacgtccaacttctcaccacaagacatctgtgttgtagctatcaatggggaagaagccacgctccgtcgcgtcaagtgccaaggagacatttgtatcctgacaccaagcaatccctcaatggaaccgatggtctacaattctgtcgatgttcatgtcataggagtcgttgtcgaagtcagaagacgattacgtaacaaataa

SEQ ID NO: 2803 - DNA, 672 bp, Artificial
  Substituion in SEQ ID NO 2790
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacttggtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgaagttcatgtcataggagtcgttgtcgaagtcagaagacgattacgtaacaaataa

SEQ ID NO: 2804 - DNA, 672 bp, Artificial
  Substituion in SEQ ID NO 2790
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacttggtcatcgtcaagtatacgtccaacttctcaccaaatgacatctgtgttgtagctatcaatggggaagaagccacgctcaaacgcgtcaagtgccaaggagacatttgtatcctgacaccaagcaatccctcaatggaaccgatggtctacaattctgtcgatgttcatgtcataggagtcgttgtcgaagtcagaagacgattacgtaacaaataa

SEQ ID NO: 2805 - DNA, 672 bp, Artificial
  Substituion in SEQ ID NO 2790
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacttggtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgatgttcatgtcataggagtcgttgtcgaagtcagaagacgattaaaaaacaaataa

SEQ ID NO: 2806 - protein, 260 aa, Alicyclobacillus acidocaldarius
MERVGCTISVGLQKGGVGKSTTTALTSYILAEQGHRVLAVDFDSQGNLTQLLTQRSPYDFVHRTSLEACKERDPRPYIHAISDNLHLLPAEDFLSQFDKWIYTEVHVSQQMVILKNTLDVVKSDYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSVEGIKIQTKADREAIAMYESFVEELKARVSR

SEQ ID NO: 2807 - DNA, 783 bp, Alicyclobacillus acidocaldarius
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 2808 - protein, 259 aa, Geobacillus kaustophilus HTA426
TITMGIQKGGCGKSTTTGVLAYLLSRDGYRVLAVDMDSQGNLTELLSRKPSNEFTEKSVLEAMQERDPEPYIVKVNDRLDLLPANNFLATFPRWIYTGETYLGKYIRYKGKPTLILDDTLDKIRHRYDFIVIDTPPSLSEQTTNALCASQYVIMMFECSNWCYSAVPNFMESVEGARVHGRHNTRLLGILRTMNDVRRNDAKAFNEMIEEDYPNEVFKTIITRKAPIGRLSLYGFEENNELNQALEQYENFYKEMMERV

SEQ ID NO: 2809 - protein, 259 aa, Lactococcus lactis
TIIIGNQKGGVGKTTNTYLIAYTLAKLGIKTLVCDLDPQSNSTKALILTKSQNSNEIMTIDKTLMWGVQQRDLKDLPVSIIENLDLLPSYIDFEDFAKYLYKNTSNEYEETHLLEPLFEPLKEDYDIILIDVPPLSVEVTSNAVMFSDYVLISLQTQDDSMTGAIEYIKTLVKLKMKYELGIEVLGALPMLSNSRGSVDKLIIESAKEEWGEDLVFETVIPQMERIKRFSINGITDEDRFDRKVLEMYEKVVSEMLSKL

SEQ ID NO: 2810 - protein, 249 aa, Lactobacillus salivarius UCC118
MGTVIAIANQKGGVGKTTTSVNLGACLARAGQKVLLIDTDAQGNATSGIGVRKHNIENDVYDVIVSELPIREAIMPTYIDNLDVVPATIQLAGAEIELTAQMAREKKLYDAVQDVKEEYDFILIDCPPSLGLLTINAFTASDSILIPVQSEYYALEGLSQLMNTIQLVQKHFNPDLQIEGVLMTMLDARTNLGNQVVEEVKKFFKEKVYKTVIPRNVRLSEAPSHGMSIIDYDPRSRGAEEYEALAKEV

SEQ ID NO: 2811 - protein, 266 aa, Bacillus thuringiensis str. Al Hakam
MLKMAITITVGNYKGGVGKTTNAVLNSYEFAKKGKRTLLVDLDPQSNATKSLMLTKSILNPDEIVTVEKTLMKGIQEGNLDGLEVEITDNLYLIPSYVDFQDFAKFLYQNCASEAEEDHYFKGLLEKIKHKYDYIFIDVPPMSLEVTKNAVVASDYVLIALQTQERSLTGAENYVNELIKLKEQYDLDIEVVGILPVLLKNNGKVDEYIMENAREIFGEENLFKNIVPQMERIKRFDVNGITEKDRHDMNVIELYETISDELLSRI

SEQ ID NO: 2812 - protein, 221 aa, Leptospira borgpetersenii serovar Hardjo-bovis L550
MGKIVSISNQKGGVGKTTTSINLAANLASIGKKVLIIDMDPQGNSGSGLGIEINTLVKTSYELLLGESSTNECIQRTNVSNLHIIPSNINLSGAEADLLVEDQREYRLKNAVSELRSEYDYILIDCPPSLGILTINALCAADSVMITLQTEYFALEGLTQLMKIISLVQNQLNPSLELEGVLLTMFDKRTNLANQVAEDVKSYFKDKVYTTIIPRNVKLSE

SEQ ID NO: 2813 - protein, 260 aa, Artificial
  Substituion in SEQ ID NO 2806
MERVGCTISVGLQKGGVGKSTTTALTSYILAEQGHRVLAVDFDSQGNLTQLLTQRSPYDFVHRTSLEACKERDPRPYIHAISDNLHLLPAEDFLSQFDKWIYTEVHVSQQMVILKNTLDVVKSDYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSIEGIKIQTKADREAIAMYESFVEELKARVSR

SEQ ID NO: 2814 - protein, 260 aa, Artificial
  Substituion in SEQ ID NO 2806
MERVGCTISVGLQKGGVGKSTTTALTSYILAEQGHRVLAVDFDSQGNLTQLLTQRSPYDFVHRTSLEACKERDPRPYIHAISDNLHLLPAEDFLSQFDKWIYTEVHVSQQMVIIKNTLDVVKSDYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSVEGIKIQTKADREAIAMYESFVEELKARVSR

SEQ ID NO: 2815 - protein, 260 aa, Artificial
  Substituion in SEQ ID NO 2806
MERVGCTISVGLQKGGVGKSTTTALTSYILAEQGHRVLAVDFDSQGNLTQLLTQRSPYDFVHRTSLEACKERDPRPYIHAISDNLHLLPAEDFLSQFDKWIYTEVHVSQQMVILKNTLEVVKSDYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSVEGIKIQTKADREAIAMYESFVEELKARVSR

SEQ ID NO: 2816 - protein, 260 aa, Artificial
  Substituion in SEQ ID NO 2806
MERVGCTISVGLQKGGVGKSTTTALTSYILAEQGHRVLAVDFDSQGNITQLLTQRSPYDFVHRTSLEACKERDPRPYIHAISDNLHLLPAEDFLSQFDKWIYTEVHVSQQMVILKNTLDVVKSDYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSVEGIKIQTKADREAIAMYESFVEELKARVSR

SEQ ID NO: 2817 - protein, 260 aa, Artificial
  Substituion in SEQ ID NO 2806
MERVGCTISVGLQKGGVGKSTTTALTSYILAEQGHRVLAVDFDSQGNLTQLLTQRSPYDFVHRTSLEACKERDPRPYIHAISDNLHLLPAEDFLSQFDKWIYTEVHVSQQMVILKNTLDVVKSDYDYILIDLPPNLGGLTLNGVCASDYCVVVCQSEPFAYDAIDRYMEIIQAAQQRVNPNLRIAGILISLLDARTAIGNYITERIREEYQDFVFDTVIRRKSRIIEFSVEGIKIQTKADREAIAMYESFVEELKARVSR

SEQ ID NO: 2818 - DNA, 783 bp, Artificial
  Substituion in SEQ ID NO 2807
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcgattgaagggataaagattcaaaccaaggccgaccgagaagctatcgccatgtatgaatcgttcgtggaggagttgaaagcccgtgtcagccgctga

SEQ ID NO: 2819 - DNA, 783 bp, Artificial
  Substituion in SEQ ID NO 2807
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattattaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 2820 - DNA, 783 bp, Artificial
  Substituion in SEQ ID NO 2807
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgaagttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 2821 - DNA, 783 bp, Artificial
  Substituion in SEQ ID NO 2807
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacattacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 2822 - DNA, 783 bp, Artificial
  Substituion in SEQ ID NO 2807
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctattgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 2823 - protein, 91 aa, Alicyclobacillus acidocaldarius
MNKRDLIRKTAEETGLSQKDCEAVINTLFDTIRKTVESGEKVQIIGFGTFELRERAARTARNPRTGEAVEVPARRVPAFKPGAELKQAVQV

SEQ ID NO: 2824 - DNA, 276 bp, Alicyclobacillus acidocaldarius
atgaacaaacgggacctcattcgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcaggtgtga

SEQ ID NO: 2825 - protein, 90 aa, Bacillus cereus ATCC 14579
MNKTELIKNVAQSADISQKDASAAVQSVFDTIANALQSGDKVQLIGFGTFEVRERSARTGRNPQTGEEIQIAAGKVPAFKAGKELKEAVK

SEQ ID NO: 2826 - protein, 90 aa, Bacillus weihenstephanensis KBAB4
MNKTELVKNVAQSADISQKDASAAVQSVFDTIANALQSGDKVQLIGFGTFEVRERSARTGRNPQTGEEIQIAAGKVPAFKAGKELKEAVK

SEQ ID NO: 2827 - protein, 90 aa, Bacillus anthracis str. Ames
MNKTELIKNVAQSADISQKDASAAVQSVFDTIATALQSGDKVQLIGFGTFEVRERSARTGRNPQTGEEIQIAAGKVPAFKAGKELKEAVK

SEQ ID NO: 2828 - protein, 90 aa, Bacillus cereus subsp. cytotoxis NVH 391-98
MNKTELIKNVAQSADISQKDASVAVQSVFDTITNALQNGDKVQLIGFGTFEVRERAARTGRNPQTGEEIQIAAGKVPAFKAGKELKEAVK

SEQ ID NO: 2829 - protein, 89 aa, Lactobacillus salivarius UCC118; identical to SEQ ID NO: 1415

SEQ ID NO: 2830 - protein, 91 aa, Artificial
  Substituion in SEQ ID NO 2823
MNKRDLIRKTAEETGLSQKDCEAVINTLFDTIRKTVESGEKVQIIGFGTFELRERAARTARNPRTGEAVEVPARRVPAFKPGADLKQAVQV

SEQ ID NO: 2831 - protein, 91 aa, Artificial
  Substituion in SEQ ID NO 2823
MNKRDLLRKTAEETGLSQKDCEAVINTLFDTIRKTVESGEKVQIIGFGTFELRERAARTARNPRTGEAVEVPARRVPAFKPGAELKQAVQV

SEQ ID NO: 2832 - protein, 91 aa, Artificial
  Substituion in SEQ ID NO 2823
MNKRDLIRKTAEETGLSQKDCEAVINTLFDTIRKTVESGEKVQIIGFGTFELRERAARTARNPRTGEAVEVPARRVPAFKPGAELKQAVQI

SEQ ID NO: 2833 - protein, 91 aa, Artificial
  Substituion in SEQ ID NO 2823
MNKRDLIRKTAEETGLSQKDCEAVINTLFDTIRKTVESGEKVQIIGFGTFELRERAARTARNPRTGEAVEVPAKRVPAFKPGAELKQAVQV

SEQ ID NO: 2834 - protein, 91 aa, Artificial
  Substituion in SEQ ID NO 2823
MNKRDLIRKTAEETGLSQKDCEAVIQTLFDTIRKTVESGEKVQIIGFGTFELRERAARTARNPRTGEAVEVPARRVPAFKPGAELKQAVQV

SEQ ID NO: 2835 - DNA, 276 bp, Artificial
  Substituion in SEQ ID NO 2824
atgaacaaacgggacctcattcgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgatctcaaacaggccgtgcaggtgtga

SEQ ID NO: 2836 - DNA, 276 bp, Artificial
  Substituion in SEQ ID NO 2824
atgaacaaacgggacctcttacgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcaggtgtga

SEQ ID NO: 2837 - DNA, 276 bp, Artificial
  Substituion in SEQ ID NO 2824
atgaacaaacgggacctcattcgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcagatttga

SEQ ID NO: 2838 - DNA, 276 bp, Artificial
  Substituion in SEQ ID NO 2824
atgaacaaacgggacctcattcgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctaaacgtgtcccggcattcaagccaggtgccgaactcaaacaggccgtgcaggtgtga

SEQ ID NO: 2839 - DNA, 276 bp, Artificial
  Substituion in SEQ ID NO 2824
atgaacaaacgggacctcattcgaaaaaccgctgaagagacaggactatcccagaaagactgcgaagccgtgatccaaacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcaggtgtga

SEQ ID NO: 2840 - protein, 759 aa, Alicyclobacillus acidocaldarius
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 2841 - DNA, 2280 bp, Alicyclobacillus acidocaldarius
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 2842 - protein, 364 aa, Thermoanaerobacter tengcongensis MB4
LSLCLITKNEEKNISRCINSVKDIVDEIVVVDTGSTDRTIEIAKSFGAKVIQIKWEDDFSKARNTAIESATGDWILFLDADEEIKKEDVSKIKSLLYDDTVEAYLFKFVNYAGSSINSGLTEINYNYRLFRNNGKLKYIYPVHENLRNIEENRPPIAKKADVTILHYGYLADIRKEKNKSERYIKLISKYLESHPEDKFQHANLAVEYFNIGDYQKALKHLLIATKGMDVNSVNATRLLRYLIGCYIGLKDYSTALKIIKDAKDYYKDIPDFSFLEGLMYMDQKRYEKAIEAFKESLSIGEYDGLFITMGGTGSYRARYMIGLCKEKLNQLNDAVKEYIEVLKENPNYQEVFIKLFDLFIKNEP

SEQ ID NO: 2843 - protein, 358 aa, Listeria welshimeri serovar 6b str. SLCC5334
LISICMIVKNEAHILRQSLASFRKFTEEIIIVDTGSTDETKEIAKEFTDFVYDFEWTGNFSDARNFAAKHATGKWILAIDADECLEEESYLQLKKQLKAPTEPIQMAQIISFTGEKGRVTTTNQMARVYKNDGTICFRGVIHEQLEGIDKHAVETGFAPVKIYHYGYMSEIVEKQGKSDRNLRLLEKEVKNNKNSGFVHFNIGQEMNRLGDKKEALKEFTKAFRLRDNNQYIWAKLSAYHISELLEQEKRYEESLAIIEEAKVIWPNVPEFPLKKANILYLHHQLEDAKEIYHSLLDNKVIDYQPIVLYEATNFMPHKMLGTIYLEEKDYTRAMTHFSKAYAENSSDYGVMFQMIMLL

SEQ ID NO: 2844 - protein, 345 aa, Bacillus cereus subsp. cytotoxis NVH 391-98
ISACLIVKNEEDMLRKCLESLQGGVDEIVVVDTGSTDTTKEIAKEFTDKVYDFEWTNDFAEARNFAASKASGEWILAIDADECVDPKNLAAAIEEIQSHDNKFDVYAVEINSFSDKYGENLSMNHMQRIYKNNGEFHFSGAIHEQIVEKGEGRQELVFSALKLYHYGYLPNVVKKKNKRKRNMDILKKALKSNNNDGFTYFNYGQELRSLGKTKEALESFIKAYQNKEDVYEEWVSRCLYFIVEMLVELKRYEEAIVIINDAEEVFSTAPDFPFWKGEIYFKQKRFDDAKEVYTHIISNNMIYQNAVFNAGAKTFLPHVRLGEIYTQERQHQQALQHYVEALNEN

SEQ ID NO: 2845 - protein, 358 aa, Listeria innocua Clip11262
LISICMIVKNEAHILRQSLASFRKFTEEIIIVDTGSTDDTKEIAKEFTDFVYDFEWTGNFSDARNFAAKHATGKWILAIDADECLEEESYRKLEKQLKSPIEPIQMAQIISFTGEKGRVTTTNQMARVYKNDGTICFRGVIHEQLEAVDKHAIEAGLAEVKIYHYGYMSEIVEKQDKSDRNLRLLEKEVKNNKNSGFVHFNIGQEMNRLGNKKEALKEFSEAFRLRDNNHYIWAKLSAYHISELLEQEKRYDESLAIIEEAKVIWPNVPEFPLKKANILYVNHQLEDAKEIYKSLLENTAIDYQPIVLYEATNFMPHKMLGTIYLEEKDYTRAMTHFSKAYAENSSDYGVMFQMIMLL

SEQ ID NO: 2846 - protein, 358 aa, Listeria monocytogenes FSL N3-165
LISICMIVKNEAHILRQSLASFRKFTEEIIIVDTGSTDETKEIAQEFTDFVYDFEWTGNFSDARNFAAKHATGKWILAIDADECLEEESYRKLEKQLKSPTEPIQMAQIISFTGEKGRVTTTNQMARVYKNDGTICFRGVIHEQLEAIDKRPIAAGVAEVKIYHYGYMSEIVEKQDKSDRNLRLLEKEVKNNKNSGFVHFNIGQEMNRLGNKKEALKEFSEAFRLRDHNHYIWAKLSAYHIAELLEQEKRYDESLAIIEEARVIWPNVPEFPLKKANILYVNHQLEDAKEIYQSLLENAAIDYQPIVLYEATNFMPHKMLGTIYLEEKDYTRAMTHFSKAYAENSSDYGVMFQMIMLL

SEQ ID NO: 2847 - protein, 759 aa, Artificial
  Substituion in SEQ ID NO 2840
MRRIVVLLSACLIVKNEAHVLPRCLGSLQGVADEIVVVDTGSTDDTPRIAESFGARVYHFEWTGDFAVARNESLRYALGEYVLVIDADEFLPKDDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 2848 - protein, 759 aa, Artificial
  Substituion in SEQ ID NO 2840
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDKDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 2849 - protein, 759 aa, Artificial
  Substituion in SEQ ID NO 2840
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLDGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 2850 - protein, 759 aa, Artificial
  Substituion in SEQ ID NO 2840
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDDLLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 2851 - protein, 759 aa, Artificial
  Substituion in SEQ ID NO 2840
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGIRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 2852 - DNA, 2280 bp, Artificial
  Substituion in SEQ ID NO 2841
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggatgacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 2853 - DNA, 2280 bp, Artificial
  Substituion in SEQ ID NO 2841
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagacaaagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 2854 - DNA, 2280 bp, Artificial
  Substituion in SEQ ID NO 2841
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggatggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 2855 - DNA, 2280 bp, Artificial
  Substituion in SEQ ID NO 2841
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgatttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 2856 - DNA, 2280 bp, Artificial
  Substituion in SEQ ID NO 2841
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtattcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 2857 - DNA, 14 bp, Alicyclobacillus acidocaldarius
  misc_feature (3)..(3): n is a or t
  misc_feature (6)..(6): n is a, c, g, or t
  misc_feature (9)..(9): n is a, c, g, or t
  misc_feature (11)..(12): n is a or t
tgnaancgntnnca

SEQ ID NO: 2858 - DNA, 15 bp, Alicyclobacillus acidocaldarius
  misc_feature (1)..(1): n is a or t
  misc_feature (4)..(4): n is a, c, g, or t
  misc_feature (7)..(7): n is a, c, g, or t
  misc_feature (10)..(10): n is a, c, g, or t
  misc_feature (11)..(11): The "n" at position 11 may be "a" or "t"
  misc_feature (12)..(13): The "n"s at positions 12 and 13 may each be "a", "t", "g", or "c"
  misc_feature (15)..(15): n is a or t
ntgnaancgnnnncn

SEQ ID NO: 2859 - protein, 217 aa, Alicyclobacillus acidocaldarius
MYNSDVRGGESMDTLNFGEYLRSLRLARKLSINQLAEKTGISAAHISRLERNVREVPRPDTLRKLALGLGVPFDELLRAAGYSEEQYEYNTKVLSRRLQRLRESKGLSLSDVAHIAGISEAYLARLESAEGRLPGVTTLHRLAQVFDVTPAYLVGDTPDPKDNGPLDAWYQPKDLIQWLEESEVMFEGQPLTDEDKLKIKQILAVVFMDAKRKNQRP

SEQ ID NO: 2860 - DNA, 654 bp, Alicyclobacillus acidocaldarius
atgtacaattcagatgtacgaggaggtgagtcgatggacactctcaatttcggcgaatatctgcgttctctgcgcctcgcgaggaaactgtcaattaaccaactcgcggaaaagacagggattagcgcagctcatatttcccggcttgaaagaaatgttcgtgaagtaccgagaccagacacattgagaaaactggcgcttgggctaggagttccattcgatgaattgttacgcgcggcgggctattccgaagagcagtatgaatacaacacaaaggtgctgtcgcgtcgactacagcgtcttcgcgaatccaaaggactgtcgctgtcggatgttgctcatatagccggtatatccgaggcctatttggctcgtttagagtccgccgaaggtcggttgcctggagttacaacactgcaccgtttagcccaggtcttcgacgtcactccagcctatttggtaggcgatacaccggatccgaaggacaatggccctcttgatgcgtggtatcagccgaaagacttgattcagtggctagaagaatctgaagtcatgtttgaaggacagccgctcaccgacgaagacaaactcaaaataaagcaaatcctcgcagttgtattcatggatgctaagcgcaaaaatcagaggccgtag

SEQ ID NO: 2861 - protein, 98 aa, Bacillus subtilis subsp. subtilis str. 168
SFGEQLRALREERKLTVNQLATYSGVSAAGISRIENGKRGVPKPATIKKLAEALKIPYEGLMYKAGYIEEVHEARAPYETKCKLLEKAEAYDLKNLAL

SEQ ID NO: 2862 - protein, 71 aa, Bacillus pumilus SAFR-032
MKFGAYLRALREEKKLSVNQLAMYSEVSAAGISRIENGKRGIPKPPTIKKLASALKVPYEDMMQAAGYIEE

SEQ ID NO: 2863 - protein, 89 aa, Bacillus halodurans C-125
MEGKQFGSFIRALRKKKGFTVNQLALYSGVSSAQISRIENGLRGVPKPETIKKLSEALGHPYEDLMQAAGYIDDNTKTDLPALTERDER

SEQ ID NO: 2864 - protein, 134 aa, Desulfotomaculum reducens MI-1
GEITDSGLGLGEKIRIIRNETGLSLQELADKIGISLSYLSEIERGTVYPALNTLKRVAEGLGVPATALMGHEGSLGYKLKHLREEYGLTQAQLANLAGVTAGLIGQIEQGKVQPSLKTLEKLSEVMGVSPCYFI

SEQ ID NO: 2865 - protein, 126 aa, Moorella thermoacetica ATCC39073
GERIRLLRERAGKNLNTLAEAAGISVSYLSEIERGNVYPAIDTLKKITAALEVPLSSVIGTGGSLGHKLRQAREERGLTQAELARAAGVSAGLIGQIEQGKVQPSLKTLERVGAVLDISPCYFIAD

SEQ ID NO: 2866 - protein, 217 aa, Artificial
  Substitution in SEQ ID NO 2859
MYNSDVRGGESMDTLNFGEYLRSLRLARKLSINNLAEKTGISAAHISRLERNVREVPRPDTLRKLALGLGVPFDELLRAAGYSEEQYEYNTKVLSRRLQRLRESKGLSLSDVAHIAGISEAYLARLESAEGRLPGVTTLHRLAQVFDVTPAYLVGDTPDPKDNGPLDAWYQPKDLIQWLEESEVMFEGQPLTDEDKLKIKQILAVVFMDAKRKNQRP

SEQ ID NO: 2867 - protein, 217 aa, Artificial
  Substitution in SEQ ID NO 2859
MYNSDVKGGESMDTLNFGEYLRSLRLARKLSINQLAEKTGISAAHISRLERNVREVPRPDTLRKLALGLGVPFDELLRAAGYSEEQYEYNTKVLSRRLQRLRESKGLSLSDVAHIAGISEAYLARLESAEGRLPGVTTLHRLAQVFDVTPAYLVGDTPDPKDNGPLDAWYQPKDLIQWLEESEVMFEGQPLTDEDKLKIKQILAVVFMDAKRKNQRP

SEQ ID NO: 2868 - protein, 217 aa, Artificial
  Substitution in SEQ ID NO 2859
MYNSDVRGGESMDTLNFGEYLRSLRLARKLSINQLAEKTGISAAHISRLERNVREVPRPDTLRKLALGLGVPFDELLRAAGYSEEQYEYNTKVLSRRLQKLRESKGLSLSDVAHIAGISEAYLARLESAEGRLPGVTTLHRLAQVFDVTPAYLVGDTPDPKDNGPLDAWYQPKDLIQWLEESEVMFEGQPLTDEDKLKIKQILAVVFMDAKRKNQRP

SEQ ID NO: 2869 - protein, 217 aa, Artificial
  Substitution in SEQ ID NO 2859
MYNSDVRGGESMDTLNFGEYLRSLRLARKLSINQLAEKTGISAAHISRLERNVREVPRPDTLRKLALGLGVPFDELLRAAGYSEEQYEYNTKVLSRRLQRLRESKGLSLSEVAHIAGISEAYLARLESAEGRLPGVTTLHRLAQVFDVTPAYLVGDTPDPKDNGPLDAWYQPKDLIQWLEESEVMFEGQPLTDEDKLKIKQILAVVFMDAKRKNQRP

SEQ ID NO: 2870 - protein, 217 aa, Artificial
  Substitution in SEQ ID NO 2859
MYNSDVRGGESMDTLNFGEYLRSLRLARKLSINQLAEKTGISAAHISRLERNVREIPRPDTLRKLALGLGVPFDELLRAAGYSEEQYEYNTKVLSRRLQRLRESKGLSLSDVAHIAGISEAYLARLESAEGRLPGVTTLHRLAQVFDVTPAYLVGDTPDPKDNGPLDAWYQPKDLIQWLEESEVMFEGQPLTDEDKLKIKQILAVVFMDAKRKNQRP

SEQ ID NO: 2871 - DNA, 654 bp, Artificial
  Substitution in SEQ ID NO 2860
atgtacaattcagatgtacgaggaggtgagtcgatggacactctcaatttcggcgaatatctgcgttctctgcgcctcgcgaggaaactgtcaattaacaatctcgcggaaaagacagggattagcgcagctcatatttcccggcttgaaagaaatgttcgtgaagtaccgagaccagacacattgagaaaactggcgcttgggctaggagttccattcgatgaattgttacgcgcggcgggctattccgaagagcagtatgaatacaacacaaaggtgctgtcgcgtcgactacagcgtcttcgcgaatccaaaggactgtcgctgtcggatgttgctcatatagccggtatatccgaggcctatttggctcgtttagagtccgccgaaggtcggttgcctggagttacaacactgcaccgtttagcccaggtcttcgacgtcactccagcctatttggtaggcgatacaccggatccgaaggacaatggccctcttgatgcgtggtatcagccgaaagacttgattcagtggctagaagaatctgaagtcatgtttgaaggacagccgctcaccgacgaagacaaactcaaaataaagcaaatcctcgcagttgtattcatggatgctaagcgcaaaaatcagaggccgtag

SEQ ID NO: 2872 - DNA, 654 bp, Artificial
  Substitution in SEQ ID NO 2860
atgtacaattcagatgtaaaaggaggtgagtcgatggacactctcaatttcggcgaatatctgcgttctctgcgcctcgcgaggaaactgtcaattaaccaactcgcggaaaagacagggattagcgcagctcatatttcccggcttgaaagaaatgttcgtgaagtaccgagaccagacacattgagaaaactggcgcttgggctaggagttccattcgatgaattgttacgcgcggcgggctattccgaagagcagtatgaatacaacacaaaggtgctgtcgcgtcgactacagcgtcttcgcgaatccaaaggactgtcgctgtcggatgttgctcatatagccggtatatccgaggcctatttggctcgtttagagtccgccgaaggtcggttgcctggagttacaacactgcaccgtttagcccaggtcttcgacgtcactccagcctatttggtaggcgatacaccggatccgaaggacaatggccctcttgatgcgtggtatcagccgaaagacttgattcagtggctagaagaatctgaagtcatgtttgaaggacagccgctcaccgacgaagacaaactcaaaataaagcaaatcctcgcagttgtattcatggatgctaagcgcaaaaatcagaggccgtag

SEQ ID NO: 2873 - DNA, 654 bp, Artificial
  Substitution in SEQ ID NO 2860
atgtacaattcagatgtacgaggaggtgagtcgatggacactctcaatttcggcgaatatctgcgttctctgcgcctcgcgaggaaactgtcaattaaccaactcgcggaaaagacagggattagcgcagctcatatttcccggcttgaaagaaatgttcgtgaagtaccgagaccagacacattgagaaaactggcgcttgggctaggagttccattcgatgaattgttacgcgcggcgggctattccgaagagcagtatgaatacaacacaaaggtgctgtcgcgtcgactacagaaacttcgcgaatccaaaggactgtcgctgtcggatgttgctcatatagccggtatatccgaggcctatttggctcgtttagagtccgccgaaggtcggttgcctggagttacaacactgcaccgtttagcccaggtcttcgacgtcactccagcctatttggtaggcgatacaccggatccgaaggacaatggccctcttgatgcgtggtatcagccgaaagacttgattcagtggctagaagaatctgaagtcatgtttgaaggacagccgctcaccgacgaagacaaactcaaaataaagcaaatcctcgcagttgtattcatggatgctaagcgcaaaaatcagaggccgtag

SEQ ID NO: 2874 - DNA, 654 bp, Artificial
  Substitution in SEQ ID NO 2860
atgtacaattcagatgtacgaggaggtgagtcgatggacactctcaatttcggcgaatatctgcgttctctgcgcctcgcgaggaaactgtcaattaaccaactcgcggaaaagacagggattagcgcagctcatatttcccggcttgaaagaaatgttcgtgaagtaccgagaccagacacattgagaaaactggcgcttgggctaggagttccattcgatgaattgttacgcgcggcgggctattccgaagagcagtatgaatacaacacaaaggtgctgtcgcgtcgactacagcgtcttcgcgaatccaaaggactgtcgctgtcggaagttgctcatatagccggtatatccgaggcctatttggctcgtttagagtccgccgaaggtcggttgcctggagttacaacactgcaccgtttagcccaggtcttcgacgtcactccagcctatttggtaggcgatacaccggatccgaaggacaatggccctcttgatgcgtggtatcagccgaaagacttgattcagtggctagaagaatctgaagtcatgtttgaaggacagccgctcaccgacgaagacaaactcaaaataaagcaaatcctcgcagttgtattcatggatgctaagcgcaaaaatcagaggccgtag

SEQ ID NO: 2875 - DNA, 654 bp, Artificial
  Substitution in SEQ ID NO 2860
atgtacaattcagatgtacgaggaggtgagtcgatggacactctcaatttcggcgaatatctgcgttctctgcgcctcgcgaggaaactgtcaattaaccaactcgcggaaaagacagggattagcgcagctcatatttcccggcttgaaagaaatgttcgtgaaattccgagaccagacacattgagaaaactggcgcttgggctaggagttccattcgatgaattgttacgcgcggcgggctattccgaagagcagtatgaatacaacacaaaggtgctgtcgcgtcgactacagcgtcttcgcgaatccaaaggactgtcgctgtcggatgttgctcatatagccggtatatccgaggcctatttggctcgtttagagtccgccgaaggtcggttgcctggagttacaacactgcaccgtttagcccaggtcttcgacgtcactccagcctatttggtaggcgatacaccggatccgaaggacaatggccctcttgatgcgtggtatcagccgaaagacttgattcagtggctagaagaatctgaagtcatgtttgaaggacagccgctcaccgacgaagacaaactcaaaataaagcaaatcctcgcagttgtattcatggatgctaagcgcaaaaatcagaggccgtag

SEQ ID NO: 2876 - protein, 754 aa, Alicyclobacillus acidocaldarius
MTGGEVIRPTGGSGRRGRLRVFIGAAPGVGKTYTMLREARRLREEGTDVVIGWVETHGRPATEKLLEGLEVIPPRVLKVGQATFEEPDLDAIVARRPEVCVIDELAHTNPPGAMHEKRYEDVMYLLDRGISVMTAFNIQHLESVRDEVQQQLGIRVREVVPEWFLREADEVTVIDVTPETLRQRLRDGEIYPPEKVDAALQNFFRVDRLAWLRQMSLRAVADDVDERLEHSYERRAIPGPVGAKEVVLVCVSHPDRAATLIERGRRMAMRMKGDLHVVYAAETDEDRMTERARAEVDELRRLAEFHGAEWVLEPKRDRPVGEVILRVARRVNATQVVLGQPRKGASPRRLMAWHHPVQYLLKHLQYVDLRVVGWRPLSPAAREQRNWASERVVRERKLPGKLTLYIGAAPGVGKTYRMLQDAHDWKVRGIDVVIGLIETHGRPETEAQIGDLERIPKRRIEYGGKVYEEPDLAAILARRPQVVLMDELAHTNAPGSMFKKRYQDILYLLEHGVDVVSAVNVQHLESLKDRVEHITGATIRERVPDWFVKLASEVKLIDVSPETLVERLLEGKIYPPEKVEQALSNFFQLAHLAALREIALREVADVVDGRLAPPPPADPERILVCVNYRPHSEALIRRGWRIADRLQAKLYVLVVQTEFPLSSQSERDFAAVRDLAEQFGAEFLLRPALHKSVGQVIVETAESESVSQIVMGQPLNRGLGARFAHRPITYVLNRAEFVDLHIVAYAGRWSQPSA

SEQ ID NO: 2877 - DNA, 2265 bp, Alicyclobacillus acidocaldarius
atgacgggaggtgaggtcatccggcccacgggcggctcgggccgccgggggcgcctgcgcgtgttcatcggcgccgcgcccggggtgggaaagacctacaccatgctgcgcgaggcgcgccggcttcgcgaagagggaaccgacgtcgtgatcggatgggtggagacgcacggccgtcccgccaccgagaagctgctcgaggggttggaagtgattcctccgcgggtgctgaaggtggggcaggcgacgttcgaggagcctgatctcgacgcgattgtcgctcggcggccggaggtgtgcgtcatcgacgagctcgcgcacacgaacccgccgggcgccatgcacgagaagcgatacgaggacgtgatgtatcttttggatcgcgggatctcggtgatgacggcgttcaacattcagcacctggagtccgttcgcgacgaggttcagcaacaacttggcatccgcgtgcgggaggtcgtgcccgagtggtttttgcgcgaagcggacgaggtcaccgtcatcgacgtgacgcccgagacgctcaggcagcggctgcgagacggggagatctacccacccgagaaagtggacgccgccctgcaaaacttctttcgcgtggatcggctggcgtggcttcgccagatgtcgctccgggccgtggcggacgatgtcgacgaacgcctggagcattcctatgagcgtcgggcgattccggggcctgtcggcgcgaaggaggtcgtgcttgtctgcgtgagtcatccggatcgcgcggctacgctcatcgagcgcgggcggcgcatggcgatgcgaatgaaaggcgatctccatgtcgtgtacgcggccgaaacggacgaggaccgcatgaccgaacgcgcgcgggccgaggtggacgaattgaggaggctggccgagtttcacggcgcggagtgggtgctcgagcccaagcgggaccggcccgtgggtgaggtcatcctccgggtcgcgaggcgggtcaacgcgacgcaggtggtgctcggccagccaaggaagggcgcgtctccgcgccgcctgatggcgtggcatcatccggtgcagtacttgctgaagcacctgcagtacgtcgacctgcgcgtggtgggctggcggccgttgtcgccggcggcaagggagcagcgaaactgggcgagcgagcgggtggtccgggagcggaagcttcccggtaaactcacgctttacatcggcgcggcgccgggcgtcggcaagacgtatcgcatgttgcaggacgcgcacgactggaaggtccgcgggatcgacgtcgtgatcggcctcatcgagacccacgggcgcccggagacggaggctcagatcggcgatctcgagcggattccgaagcggcggatcgagtatggcgggaaggtgtacgaggagccggatctcgcggccatcctcgcccggcgcccgcaggtcgtcctgatggacgaactcgcacacaccaatgcgccgggcagcatgtttaagaagcggtatcaggacattttgtatctgttggagcacggggtcgacgtggtgtccgccgtgaacgtgcaacacctcgagagcctgaaagatcgcgtcgagcacatcacgggtgcgaccatccgcgagcgcgtgccggactggttcgtgaagctcgcgagcgaggtgaagctcatcgacgtgagcccggagacgctggtggagcggctcttggaaggcaagatctacccgccggaaaaggtggagcaggcgctgagcaacttctttcagcttgcgcatttggccgcgctgcgcgagatcgcgcttcgcgaggtggccgacgtggtggacgggcggttggcgccgcctccgcccgccgatccggagcggatcctggtctgcgtcaactaccgcccgcactccgaagcgctcattcggcgcggatggcgcatcgcggaccggctgcaggccaagctgtacgtgctcgtcgtgcagacggagttccctctatcgagccagagtgagcgcgactttgcggccgtgcgcgatctcgccgagcagttcggggcagagttccttcttcggcctgccctgcacaaatcggtcgggcaggtgatcgtcgagacggccgagagcgaatcggtctcccagatcgtgatgggacagcccttgaaccgaggtctcggcgcgcgattcgcccaccggcccatcacctacgtgctgaaccgcgcggagttcgtcgatctccacatcgtcgcgtacgcaggccgctggtcgcagccctccgcgtga

SEQ ID NO: 2878 - protein, 754 aa, Alicyclobacillus acidocaldarius; identical to SEQ ID NO: 2876

SEQ ID NO: 2879 - protein, 726 aa, Gloeobacter violaceus PCC 7421
RGRLKLYLGYTPGVGKTVRMLQEARRLRRRGVDLVVGWVETHGRPDTEALLADLEVMAPRQVAYQGVIIPELDLEAILQRRPATVLIDELAHTNAPGSRHRKRYEDVEVLLDAGVSVMSAMNIQHLESVAEAAGRLIGAVVHETVPDRLLRSAEEVQLVDASPEAVLERLQRGDAARYIPPGSPFLRRSTLVYLRELALRAVAEVVDADILSGKNGVAGPAGVRERVLAAVSTNPASARLIRRGARIAERLDAELFVAYVETGRPLAPPEAQTLQEHRAATEAAAGEFVQLQNRDVAGALIDFALQKNITQVIVGESLRSPAEELVRGSVINTLLRTTSNIDVLIVGEAESSMVGPLTPVAAQPPFAVGCLLVGADSRRAHGCGRHKIYLGAAPGVGKTFAMLQEAHHLHASGIDVVCGVIETHGRAETAALIENLEVVPKRAIGYQGRTFLELDVEAVLRRRPAVVLVDELAHTNIAGAGNTKRFQDVEVLLGAGIDVVSTLNIQHLESLNTLVERTTGVKVRETLPDLVVEAADEVVLVDLPTGELTQRLREGKIYAQAKVEQALANFFRPENLSALRELALREVADDCTTRKLEEAAHGPGGRVLVCINLRPNAEQLIRRGARIASRLSAPLVVAHIGAHDDGPTARAVERLGELTRQLGGEFIERPAAANQVPEQIDALAHEQGVTLLVMGESRRSRWEKLLHGCVIEQVVRRVRNLDVLIV

SEQ ID NO: 2880 - protein, 744 aa, Paenibacillus larvae subsp. larvae BRL-230010
RGRLKIYLGAVSGSGKTYHMLREAQSLKENGIDVVLCAVSTLNRPETARQASGLETIPSIDWTKDGVIQQDLNLVALVERNPEVVLVDGLAHRNRQGALFPTRLGDISFLLEKGISVITTVNVYELEGVRELARKLAGVEVKTTVPSGTLEMADEVRLIDVTPETILKRLEEGNLPGQKEHHLFLKGNIGVLRELALRLVAEDVNGSLEKYRKSKGLSGPSGAGERILVSTQYHWNGSIYVRRGQQIANRLNGDLYVICFQHTGKPLSKEQAAFKRSLKKLVDKIGAVFVELPFPGRRKLADSLLDYAMKNSVTRIVLGHSKHTRIQELWQGSIINDILRKMTRTDLFVVADRAERDGERILPAKRKVGTKKAELYRRHSKQEMQKEIEKIRRGVFKVYIGAAPGVGKTYTMLREGNDLARMGIDVIVGLLETHGRRETAEQLGNLGMIPRRKIDYRGTTLEEMDTDAIIERAPDVVLVDELAHTNVPGSRHNKRFEDVLDILNAGISVITTVNVQHLESLNDAVEQITGVRVRETVPDSILWMADEVELIDVPPQTLRQRMKEGRIYSMEKVEQALGHFFKIGNLIALRELALREIADDVDERLESWERKESLRGPWRREETIFVCVKLNDHAERIIRRGFRIAFRLKARWHVAYLHHGSGMEDEARLKELKGLTERLGGSFEVITGQGKKDPADLLLAKANEYNSTQMILGKSCSPSWRDRWQGSLVKRLLRGARHMDVLVV

SEQ ID NO: 2881 - protein, 654 aa, Leptospirillum sp. GroupII UBA
GRLKVYLGWAPGVGKSRRALLDLATLKKRGIVPVIGWLEDKGREEIRILAGEFRSVPPREVVVAGKSFREMDVEAILRESPPIVFVDELARDNPPVSGRLSRWEEVGRLLESGISVVTTLNAMHVHELAPTVSRLLERPVEVTLPLDFLRKADEIVVVDIPPAELRERIRKGLVFPPEQIDRALKGPYREPNLVRLRELTLDFAARVLDAQLVRQGGKKGVYERVLVLVSDHPEAFKSLLGYGGALSRRLGGELLVLHLRKISLLGKRPPLDRTVLEEMQQAVRENGGKMSVLWTRNFAWTLWRFIQKTGTTRLIMGHAGRVRPWRKSLVRNVLRYFPRIDVEILLLPSLVDLPPVPEPGGGEIPVPEREEGGGTFTLFLGAAAGIGKTYRMLAEAQHLLREGVNLVVGYLETHRRPETEKMATGLPFLPRIPVYYHGLVLEEMDLDGILARRPRLVLVDELAHSNPPGFRNPKRYQDVFEILSAGIDVFSTLNVQHLETLNDLIEFQTGIRVHETVPDSVLMRVDSLVLVDLTPEALQARLMEGNVYPPEKVQEALDNFFTKSNLTALRELAMRQVAETARFRLMIRGRGGILLVGVSDRLEDGALIRRGATLSERLGLSMVVLSITSGHTVPRWRNELESLTRTLSGTFSEE

SEQ ID NO: 2882 - protein, 367 aa, Geobacillus kaustophilus HTA426
RRMTPEEILKKIENMKKGRLKIYIGAAPGVGKTFHMLRDAHDVREKGIDIVIGIVETHGRAETEAEIKDLEIIPRKKIHYKGKEFAELDVDAVIRRNPDVVIVDELAHTNAPGSKNKKRYQDVQEILQAGIHVWTAMNIQHLESVHDIVEQVTGVQVNERVPDFMLREADEIEVIDITPEALRERIKEGKVYGKEKIDQALNHFFRKGNLVALRELTLREVADDIEMRLEKEREEQGIEEPTGIHEKILVCVNYRPNAEKLIRRGWRIAQRLNAELYILHIKQKRQSPERTIAEWEKMAKQFGATFLVREAASRRVAHQIVDVCREYKITQIVMGMSARTRWEEIWKGSLINVIMQQLKHVDVLVVS

SEQ ID NO: 2883 - protein, 754 aa, Artificial
  Substitution in SEQ ID NO 2876
MTGGEVIRPTGGSGRRGRLRVFIGAAPGVGKTYTMLREARRLREEGTDVVIGWVETHGRPATEKLLEGLEVIPPRVLKVGQATFEEPDLDAIVARRPEVCVIDELAHTNPPGAMHEKRYEDVMYLLDRGISVMTAFNIQHLESVRDEVQQQLGIRVREVVPEWFLREADEVTVIDVTPETLRQRLRDGEIYPPEKVDAALQNFFRVDRLAWLRQMSLRAVADDVDERLEHSYERRAIPGPVGAKEVVLVCVSHPDRAATLIERGRRMAMRMKGDLHVVYAAETDEDRMTERARAEVDELRRLAEFHGAEWVLEPKRDRPVGEVILRVARRVQATQVVLGQPRKGASPRRLMAWHHPVQYLLKHLQYVDLRVVGWRPLSPAAREQRNWASERVVRERKLPGKLTLYIGAAPGVGKTYRMLQDAHDWKVRGIDVVIGLIETHGRPETEAQIGDLERIPKRRIEYGGKVYEEPDLAAILARRPQVVLMDELAHTNAPGSMFKKRYQDILYLLEHGVDVVSAVNVQHLESLKDRVEHITGATIRERVPDWFVKLASEVKLIDVSPETLVERLLEGKIYPPEKVEQALSNFFQLAHLAALREIALREVADVVDGRLAPPPPADPERILVCVNYRPHSEALIRRGWRIADRLQAKLYVLVVQTEFPLSSQSERDFAAVRDLAEQFGAEFLLRPALHKSVGQVIVETAESESVSQIVMGQPLNRGLGARFAHRPITYVLNRAEFVDLHIVAYAGRWSQPSA

SEQ ID NO: 2884 - protein, 754 aa, Artificial
  Substitution in SEQ ID NO 2876
MTGGEVIRPTGGSGRRGRLRVFIGAAPGVGKTYTMLREARRLREEGTDVVIGWVETHGRPATEKLLEGLEVIPPRVLKVGQATFEEPDLDAIVARRPEVCVIDELAHTNPPGAMHEKRYEDVMYLLDRGISVMTAFNIQHLESVREEVQQQLGIRVREVVPEWFLREADEVTVIDVTPETLRQRLRDGEIYPPEKVDAALQNFFRVDRLAWLRQMSLRAVADDVDERLEHSYERRAIPGPVGAKEVVLVCVSHPDRAATLIERGRRMAMRMKGDLHVVYAAETDEDRMTERARAEVDELRRLAEFHGAEWVLEPKRDRPVGEVILRVARRVNATQVVLGQPRKGASPRRLMAWHHPVQYLLKHLQYVDLRVVGWRPLSPAAREQRNWASERVVRERKLPGKLTLYIGAAPGVGKTYRMLQDAHDWKVRGIDVVIGLIETHGRPETEAQIGDLERIPKRRIEYGGKVYEEPDLAAILARRPQVVLMDELAHTNAPGSMFKKRYQDILYLLEHGVDVVSAVNVQHLESLKDRVEHITGATIRERVPDWFVKLASEVKLIDVSPETLVERLLEGKIYPPEKVEQALSNFFQLAHLAALREIALREVADVVDGRLAPPPPADPERILVCVNYRPHSEALIRRGWRIADRLQAKLYVLVVQTEFPLSSQSERDFAAVRDLAEQFGAEFLLRPALHKSVGQVIVETAESESVSQIVMGQPLNRGLGARFAHRPITYVLNRAEFVDLHIVAYAGRWSQPSA

SEQ ID NO: 2885 - protein, 754 aa, Artificial
  Substitution in SEQ ID NO 2876
MTGGEVIRPTGGSGRRGRLRVFIGAAPGVGKTYTMLREARRLREEGTDVVIGWVETHGRPATEKLLEGLEVIPPRVLKVGQATFEEPDLDAIVARRPEVCVIDELAHTNPPGAMHEKRYEDVMYLLDRGISVMTAFNIQHLESVRDEVQQQLGIRVREVVPEWFLREADEVTVIDVTPETLRQRLRDGELYPPEKVDAALQNFFRVDRLAWLRQMSLRAVADDVDERLEHSYERRAIPGPVGAKEVVLVCVSHPDRAATLIERGRRMAMRMKGDLHVVYAAETDEDRMTERARAEVDELRRLAEFHGAEWVLEPKRDRPVGEVILRVARRVNATQVVLGQPRKGASPRRLMAWHHPVQYLLKHLQYVDLRVVGWRPLSPAAREQRNWASERVVRERKLPGKLTLYIGAAPGVGKTYRMLQDAHDWKVRGIDVVIGLIETHGRPETEAQIGDLERIPKRRIEYGGKVYEEPDLAAILARRPQVVLMDELAHTNAPGSMFKKRYQDILYLLEHGVDVVSAVNVQHLESLKDRVEHITGATIRERVPDWFVKLASEVKLIDVSPETLVERLLEGKIYPPEKVEQALSNFFQLAHLAALREIALREVADVVDGRLAPPPPADPERILVCVNYRPHSEALIRRGWRIADRLQAKLYVLVVQTEFPLSSQSERDFAAVRDLAEQFGAEFLLRPALHKSVGQVIVETAESESVSQIVMGQPLNRGLGARFAHRPITYVLNRAEFVDLHIVAYAGRWSQPSA

SEQ ID NO: 2886 - protein, 754 aa, Artificial
  Substitution in SEQ ID NO 2876
MTGGEVIRPTGGSGRRGRLRVFIGAAPGVGKTYTMLREARRLREEGTDVVIGWVETHGRPATEKLLEGLEVIPPRVLKVGQATFEEPDLDAIVARRPEVCVIDELAHTNPPGAMHEKRYEDVMYLLDRGISVMTAFNIQHLESVRDEVQQQLGIRVREVVPEWFLREADEVTVIDVTPETLRQRLRDGEIYPPEKVDAALQNFFRVDRLAWLRQMSLRAVADDVDERLEHSYERRAIPGPVGAKEVVLICVSHPDRAATLIERGRRMAMRMKGDLHVVYAAETDEDRMTERARAEVDELRRLAEFHGAEWVLEPKRDRPVGEVILRVARRVNATQVVLGQPRKGASPRRLMAWHHPVQYLLKHLQYVDLRVVGWRPLSPAAREQRNWASERVVRERKLPGKLTLYIGAAPGVGKTYRMLQDAHDWKVRGIDVVIGLIETHGRPETEAQIGDLERIPKRRIEYGGKVYEEPDLAAILARRPQVVLMDELAHTNAPGSMFKKRYQDILYLLEHGVDVVSAVNVQHLESLKDRVEHITGATIRERVPDWFVKLASEVKLIDVSPETLVERLLEGKIYPPEKVEQALSNFFQLAHLAALREIALREVADVVDGRLAPPPPADPERILVCVNYRPHSEALIRRGWRIADRLQAKLYVLVVQTEFPLSSQSERDFAAVRDLAEQFGAEFLLRPALHKSVGQVIVETAESESVSQIVMGQPLNRGLGARFAHRPITYVLNRAEFVDLHIVAYAGRWSQPSA

SEQ ID NO: 2887 - protein, 754 aa, Artificial
  Substitution in SEQ ID NO 2876
MTGGEVIRPTGGSGRRGRLRVFIGAAPGVGKTYTMLREARRLREEGTDVVIGWVETHGRPATEKLLEGLEVIPPRVLKVGQATFEEPDLDAIVARRPEVCVIDELAHTNPPGAMHEKRYEDVMYLLDRGISVMTAFNIQHLESVRDEVQQQLGIRIREVVPEWFLREADEVTVIDVTPETLRQRLRDGEIYPPEKVDAALQNFFRVDRLAWLRQMSLRAVADDVDERLEHSYERRAIPGPVGAKEVVLVCVSHPDRAATLIERGRRMAMRMKGDLHVVYAAETDEDRMTERARAEVDELRRLAEFHGAEWVLEPKRDRPVGEVILRVARRVNATQVVLGQPRKGASPRRLMAWHHPVQYLLKHLQYVDLRVVGWRPLSPAAREQRNWASERVVRERKLPGKLTLYIGAAPGVGKTYRMLQDAHDWKVRGIDVVIGLIETHGRPETEAQIGDLERIPKRRIEYGGKVYEEPDLAAILARRPQVVLMDELAHTNAPGSMFKKRYQDILYLLEHGVDVVSAVNVQHLESLKDRVEHITGATIRERVPDWFVKLASEVKLIDVSPETLVERLLEGKIYPPEKVEQALSNFFQLAHLAALREIALREVADVVDGRLAPPPPADPERILVCVNYRPHSEALIRRGWRIADRLQAKLYVLVVQTEFPLSSQSERDFAAVRDLAEQFGAEFLLRPALHKSVGQVIVETAESESVSQIVMGQPLNRGLGARFAHRPITYVLNRAEFVDLHIVAYAGRWSQPSA

SEQ ID NO: 2888 - DNA, 2265 bp, Artificial
  Substitution in SEQ ID NO 2877
atgacgggaggtgaggtcatccggcccacgggcggctcgggccgccgggggcgcctgcgcgtgttcatcggcgccgcgcccggggtgggaaagacctacaccatgctgcgcgaggcgcgccggcttcgcgaagagggaaccgacgtcgtgatcggatgggtggagacgcacggccgtcccgccaccgagaagctgctcgaggggttggaagtgattcctccgcgggtgctgaaggtggggcaggcgacgttcgaggagcctgatctcgacgcgattgtcgctcggcggccggaggtgtgcgtcatcgacgagctcgcgcacacgaacccgccgggcgccatgcacgagaagcgatacgaggacgtgatgtatcttttggatcgcgggatctcggtgatgacggcgttcaacattcagcacctggagtccgttcgcgacgaggttcagcaacaacttggcatccgcgtgcgggaggtcgtgcccgagtggtttttgcgcgaagcggacgaggtcaccgtcatcgacgtgacgcccgagacgctcaggcagcggctgcgagacggggagatctacccacccgagaaagtggacgccgccctgcaaaacttctttcgcgtggatcggctggcgtggcttcgccagatgtcgctccgggccgtggcggacgatgtcgacgaacgcctggagcattcctatgagcgtcgggcgattccggggcctgtcggcgcgaaggaggtcgtgcttgtctgcgtgagtcatccggatcgcgcggctacgctcatcgagcgcgggcggcgcatggcgatgcgaatgaaaggcgatctccatgtcgtgtacgcggccgaaacggacgaggaccgcatgaccgaacgcgcgcgggccgaggtggacgaattgaggaggctggccgagtttcacggcgcggagtgggtgctcgagcccaagcgggaccggcccgtgggtgaggtcatcctccgggtcgcgaggcgggtccaagcgacgcaggtggtgctcggccagccaaggaagggcgcgtctccgcgccgcctgatggcgtggcatcatccggtgcagtacttgctgaagcacctgcagtacgtcgacctgcgcgtggtgggctggcggccgttgtcgccggcggcaagggagcagcgaaactgggcgagcgagcgggtggtccgggagcggaagcttcccggtaaactcacgctttacatcggcgcggcgccgggcgtcggcaagacgtatcgcatgttgcaggacgcgcacgactggaaggtccgcgggatcgacgtcgtgatcggcctcatcgagacccacgggcgcccggagacggaggctcagatcggcgatctcgagcggattccgaagcggcggatcgagtatggcgggaaggtgtacgaggagccggatctcgcggccatcctcgcccggcgcccgcaggtcgtcctgatggacgaactcgcacacaccaatgcgccgggcagcatgtttaagaagcggtatcaggacattttgtatctgttggagcacggggtcgacgtggtgtccgccgtgaacgtgcaacacctcgagagcctgaaagatcgcgtcgagcacatcacgggtgcgaccatccgcgagcgcgtgccggactggttcgtgaagctcgcgagcgaggtgaagctcatcgacgtgagcccggagacgctggtggagcggctcttggaaggcaagatctacccgccggaaaaggtggagcaggcgctgagcaacttctttcagcttgcgcatttggccgcgctgcgcgagatcgcgcttcgcgaggtggccgacgtggtggacgggcggttggcgccgcctccgcccgccgatccggagcggatcctggtctgcgtcaactaccgcccgcactccgaagcgctcattcggcgcggatggcgcatcgcggaccggctgcaggccaagctgtacgtgctcgtcgtgcagacggagttccctctatcgagccagagtgagcgcgactttgcggccgtgcgcgatctcgccgagcagttcggggcagagttccttcttcggcctgccctgcacaaatcggtcgggcaggtgatcgtcgagacggccgagagcgaatcggtctcccagatcgtgatgggacagcccttgaaccgaggtctcggcgcgcgattcgcccaccggcccatcacctacgtgctgaaccgcgcggagttcgtcgatctccacatcgtcgcgtacgcaggccgctggtcgcagccctccgcgtga

SEQ ID NO: 2889 - DNA, 2265 bp, Artificial
  Substitution in SEQ ID NO 2877
atgacgggaggtgaggtcatccggcccacgggcggctcgggccgccgggggcgcctgcgcgtgttcatcggcgccgcgcccggggtgggaaagacctacaccatgctgcgcgaggcgcgccggcttcgcgaagagggaaccgacgtcgtgatcggatgggtggagacgcacggccgtcccgccaccgagaagctgctcgaggggttggaagtgattcctccgcgggtgctgaaggtggggcaggcgacgttcgaggagcctgatctcgacgcgattgtcgctcggcggccggaggtgtgcgtcatcgacgagctcgcgcacacgaacccgccgggcgccatgcacgagaagcgatacgaggacgtgatgtatcttttggatcgcgggatctcggtgatgacggcgttcaacattcagcacctggagtccgttcgcgaagaggttcagcaacaacttggcatccgcgtgcgggaggtcgtgcccgagtggtttttgcgcgaagcggacgaggtcaccgtcatcgacgtgacgcccgagacgctcaggcagcggctgcgagacggggagatctacccacccgagaaagtggacgccgccctgcaaaacttctttcgcgtggatcggctggcgtggcttcgccagatgtcgctccgggccgtggcggacgatgtcgacgaacgcctggagcattcctatgagcgtcgggcgattccggggcctgtcggcgcgaaggaggtcgtgcttgtctgcgtgagtcatccggatcgcgcggctacgctcatcgagcgcgggcggcgcatggcgatgcgaatgaaaggcgatctccatgtcgtgtacgcggccgaaacggacgaggaccgcatgaccgaacgcgcgcgggccgaggtggacgaattgaggaggctggccgagtttcacggcgcggagtgggtgctcgagcccaagcgggaccggcccgtgggtgaggtcatcctccgggtcgcgaggcgggtcaacgcgacgcaggtggtgctcggccagccaaggaagggcgcgtctccgcgccgcctgatggcgtggcatcatccggtgcagtacttgctgaagcacctgcagtacgtcgacctgcgcgtggtgggctggcggccgttgtcgccggcggcaagggagcagcgaaactgggcgagcgagcgggtggtccgggagcggaagcttcccggtaaactcacgctttacatcggcgcggcgccgggcgtcggcaagacgtatcgcatgttgcaggacgcgcacgactggaaggtccgcgggatcgacgtcgtgatcggcctcatcgagacccacgggcgcccggagacggaggctcagatcggcgatctcgagcggattccgaagcggcggatcgagtatggcgggaaggtgtacgaggagccggatctcgcggccatcctcgcccggcgcccgcaggtcgtcctgatggacgaactcgcacacaccaatgcgccgggcagcatgtttaagaagcggtatcaggacattttgtatctgttggagcacggggtcgacgtggtgtccgccgtgaacgtgcaacacctcgagagcctgaaagatcgcgtcgagcacatcacgggtgcgaccatccgcgagcgcgtgccggactggttcgtgaagctcgcgagcgaggtgaagctcatcgacgtgagcccggagacgctggtggagcggctcttggaaggcaagatctacccgccggaaaaggtggagcaggcgctgagcaacttctttcagcttgcgcatttggccgcgctgcgcgagatcgcgcttcgcgaggtggccgacgtggtggacgggcggttggcgccgcctccgcccgccgatccggagcggatcctggtctgcgtcaactaccgcccgcactccgaagcgctcattcggcgcggatggcgcatcgcggaccggctgcaggccaagctgtacgtgctcgtcgtgcagacggagttccctctatcgagccagagtgagcgcgactttgcggccgtgcgcgatctcgccgagcagttcggggcagagttccttcttcggcctgccctgcacaaatcggtcgggcaggtgatcgtcgagacggccgagagcgaatcggtctcccagatcgtgatgggacagcccttgaaccgaggtctcggcgcgcgattcgcccaccggcccatcacctacgtgctgaaccgcgcggagttcgtcgatctccacatcgtcgcgtacgcaggccgctggtcgcagccctccgcgtga

SEQ ID NO: 2890 - DNA, 2265 bp, Artificial
  Substitution in SEQ ID NO 2877
atgacgggaggtgaggtcatccggcccacgggcggctcgggccgccgggggcgcctgcgcgtgttcatcggcgccgcgcccggggtgggaaagacctacaccatgctgcgcgaggcgcgccggcttcgcgaagagggaaccgacgtcgtgatcggatgggtggagacgcacggccgtcccgccaccgagaagctgctcgaggggttggaagtgattcctccgcgggtgctgaaggtggggcaggcgacgttcgaggagcctgatctcgacgcgattgtcgctcggcggccggaggtgtgcgtcatcgacgagctcgcgcacacgaacccgccgggcgccatgcacgagaagcgatacgaggacgtgatgtatcttttggatcgcgggatctcggtgatgacggcgttcaacattcagcacctggagtccgttcgcgacgaggttcagcaacaacttggcatccgcgtgcgggaggtcgtgcccgagtggtttttgcgcgaagcggacgaggtcaccgtcatcgacgtgacgcccgagacgctcaggcagcggctgcgagacggggagttatacccacccgagaaagtggacgccgccctgcaaaacttctttcgcgtggatcggctggcgtggcttcgccagatgtcgctccgggccgtggcggacgatgtcgacgaacgcctggagcattcctatgagcgtcgggcgattccggggcctgtcggcgcgaaggaggtcgtgcttgtctgcgtgagtcatccggatcgcgcggctacgctcatcgagcgcgggcggcgcatggcgatgcgaatgaaaggcgatctccatgtcgtgtacgcggccgaaacggacgaggaccgcatgaccgaacgcgcgcgggccgaggtggacgaattgaggaggctggccgagtttcacggcgcggagtgggtgctcgagcccaagcgggaccggcccgtgggtgaggtcatcctccgggtcgcgaggcgggtcaacgcgacgcaggtggtgctcggccagccaaggaagggcgcgtctccgcgccgcctgatggcgtggcatcatccggtgcagtacttgctgaagcacctgcagtacgtcgacctgcgcgtggtgggctggcggccgttgtcgccggcggcaagggagcagcgaaactgggcgagcgagcgggtggtccgggagcggaagcttcccggtaaactcacgctttacatcggcgcggcgccgggcgtcggcaagacgtatcgcatgttgcaggacgcgcacgactggaaggtccgcgggatcgacgtcgtgatcggcctcatcgagacccacgggcgcccggagacggaggctcagatcggcgatctcgagcggattccgaagcggcggatcgagtatggcgggaaggtgtacgaggagccggatctcgcggccatcctcgcccggcgcccgcaggtcgtcctgatggacgaactcgcacacaccaatgcgccgggcagcatgtttaagaagcggtatcaggacattttgtatctgttggagcacggggtcgacgtggtgtccgccgtgaacgtgcaacacctcgagagcctgaaagatcgcgtcgagcacatcacgggtgcgaccatccgcgagcgcgtgccggactggttcgtgaagctcgcgagcgaggtgaagctcatcgacgtgagcccggagacgctggtggagcggctcttggaaggcaagatctacccgccggaaaaggtggagcaggcgctgagcaacttctttcagcttgcgcatttggccgcgctgcgcgagatcgcgcttcgcgaggtggccgacgtggtggacgggcggttggcgccgcctccgcccgccgatccggagcggatcctggtctgcgtcaactaccgcccgcactccgaagcgctcattcggcgcggatggcgcatcgcggaccggctgcaggccaagctgtacgtgctcgtcgtgcagacggagttccctctatcgagccagagtgagcgcgactttgcggccgtgcgcgatctcgccgagcagttcggggcagagttccttcttcggcctgccctgcacaaatcggtcgggcaggtgatcgtcgagacggccgagagcgaatcggtctcccagatcgtgatgggacagcccttgaaccgaggtctcggcgcgcgattcgcccaccggcccatcacctacgtgctgaaccgcgcggagttcgtcgatctccacatcgtcgcgtacgcaggccgctggtcgcagccctccgcgtga

SEQ ID NO: 2891 - DNA, 2265 bp, Artificial
  Substitution in SEQ ID NO 2877
atgacgggaggtgaggtcatccggcccacgggcggctcgggccgccgggggcgcctgcgcgtgttcatcggcgccgcgcccggggtgggaaagacctacaccatgctgcgcgaggcgcgccggcttcgcgaagagggaaccgacgtcgtgatcggatgggtggagacgcacggccgtcccgccaccgagaagctgctcgaggggttggaagtgattcctccgcgggtgctgaaggtggggcaggcgacgttcgaggagcctgatctcgacgcgattgtcgctcggcggccggaggtgtgcgtcatcgacgagctcgcgcacacgaacccgccgggcgccatgcacgagaagcgatacgaggacgtgatgtatcttttggatcgcgggatctcggtgatgacggcgttcaacattcagcacctggagtccgttcgcgacgaggttcagcaacaacttggcatccgcgtgcgggaggtcgtgcccgagtggtttttgcgcgaagcggacgaggtcaccgtcatcgacgtgacgcccgagacgctcaggcagcggctgcgagacggggagatctacccacccgagaaagtggacgccgccctgcaaaacttctttcgcgtggatcggctggcgtggcttcgccagatgtcgctccgggccgtggcggacgatgtcgacgaacgcctggagcattcctatgagcgtcgggcgattccggggcctgtcggcgcgaaggaggtcgtgcttatttgcgtgagtcatccggatcgcgcggctacgctcatcgagcgcgggcggcgcatggcgatgcgaatgaaaggcgatctccatgtcgtgtacgcggccgaaacggacgaggaccgcatgaccgaacgcgcgcgggccgaggtggacgaattgaggaggctggccgagtttcacggcgcggagtgggtgctcgagcccaagcgggaccggcccgtgggtgaggtcatcctccgggtcgcgaggcgggtcaacgcgacgcaggtggtgctcggccagccaaggaagggcgcgtctccgcgccgcctgatggcgtggcatcatccggtgcagtacttgctgaagcacctgcagtacgtcgacctgcgcgtggtgggctggcggccgttgtcgccggcggcaagggagcagcgaaactgggcgagcgagcgggtggtccgggagcggaagcttcccggtaaactcacgctttacatcggcgcggcgccgggcgtcggcaagacgtatcgcatgttgcaggacgcgcacgactggaaggtccgcgggatcgacgtcgtgatcggcctcatcgagacccacgggcgcccggagacggaggctcagatcggcgatctcgagcggattccgaagcggcggatcgagtatggcgggaaggtgtacgaggagccggatctcgcggccatcctcgcccggcgcccgcaggtcgtcctgatggacgaactcgcacacaccaatgcgccgggcagcatgtttaagaagcggtatcaggacattttgtatctgttggagcacggggtcgacgtggtgtccgccgtgaacgtgcaacacctcgagagcctgaaagatcgcgtcgagcacatcacgggtgcgaccatccgcgagcgcgtgccggactggttcgtgaagctcgcgagcgaggtgaagctcatcgacgtgagcccggagacgctggtggagcggctcttggaaggcaagatctacccgccggaaaaggtggagcaggcgctgagcaacttctttcagcttgcgcatttggccgcgctgcgcgagatcgcgcttcgcgaggtggccgacgtggtggacgggcggttggcgccgcctccgcccgccgatccggagcggatcctggtctgcgtcaactaccgcccgcactccgaagcgctcattcggcgcggatggcgcatcgcggaccggctgcaggccaagctgtacgtgctcgtcgtgcagacggagttccctctatcgagccagagtgagcgcgactttgcggccgtgcgcgatctcgccgagcagttcggggcagagttccttcttcggcctgccctgcacaaatcggtcgggcaggtgatcgtcgagacggccgagagcgaatcggtctcccagatcgtgatgggacagcccttgaaccgaggtctcggcgcgcgattcgcccaccggcccatcacctacgtgctgaaccgcgcggagttcgtcgatctccacatcgtcgcgtacgcaggccgctggtcgcagccctccgcgtga

SEQ ID NO: 2892 - DNA, 2265 bp, Artificial
  Substitution in SEQ ID NO 2877
atgacgggaggtgaggtcatccggcccacgggcggctcgggccgccgggggcgcctgcgcgtgttcatcggcgccgcgcccggggtgggaaagacctacaccatgctgcgcgaggcgcgccggcttcgcgaagagggaaccgacgtcgtgatcggatgggtggagacgcacggccgtcccgccaccgagaagctgctcgaggggttggaagtgattcctccgcgggtgctgaaggtggggcaggcgacgttcgaggagcctgatctcgacgcgattgtcgctcggcggccggaggtgtgcgtcatcgacgagctcgcgcacacgaacccgccgggcgccatgcacgagaagcgatacgaggacgtgatgtatcttttggatcgcgggatctcggtgatgacggcgttcaacattcagcacctggagtccgttcgcgacgaggttcagcaacaacttggcatccgcattcgggaggtcgtgcccgagtggtttttgcgcgaagcggacgaggtcaccgtcatcgacgtgacgcccgagacgctcaggcagcggctgcgagacggggagatctacccacccgagaaagtggacgccgccctgcaaaacttctttcgcgtggatcggctggcgtggcttcgccagatgtcgctccgggccgtggcggacgatgtcgacgaacgcctggagcattcctatgagcgtcgggcgattccggggcctgtcggcgcgaaggaggtcgtgcttgtctgcgtgagtcatccggatcgcgcggctacgctcatcgagcgcgggcggcgcatggcgatgcgaatgaaaggcgatctccatgtcgtgtacgcggccgaaacggacgaggaccgcatgaccgaacgcgcgcgggccgaggtggacgaattgaggaggctggccgagtttcacggcgcggagtgggtgctcgagcccaagcgggaccggcccgtgggtgaggtcatcctccgggtcgcgaggcgggtcaacgcgacgcaggtggtgctcggccagccaaggaagggcgcgtctccgcgccgcctgatggcgtggcatcatccggtgcagtacttgctgaagcacctgcagtacgtcgacctgcgcgtggtgggctggcggccgttgtcgccggcggcaagggagcagcgaaactgggcgagcgagcgggtggtccgggagcggaagcttcccggtaaactcacgctttacatcggcgcggcgccgggcgtcggcaagacgtatcgcatgttgcaggacgcgcacgactggaaggtccgcgggatcgacgtcgtgatcggcctcatcgagacccacgggcgcccggagacggaggctcagatcggcgatctcgagcggattccgaagcggcggatcgagtatggcgggaaggtgtacgaggagccggatctcgcggccatcctcgcccggcgcccgcaggtcgtcctgatggacgaactcgcacacaccaatgcgccgggcagcatgtttaagaagcggtatcaggacattttgtatctgttggagcacggggtcgacgtggtgtccgccgtgaacgtgcaacacctcgagagcctgaaagatcgcgtcgagcacatcacgggtgcgaccatccgcgagcgcgtgccggactggttcgtgaagctcgcgagcgaggtgaagctcatcgacgtgagcccggagacgctggtggagcggctcttggaaggcaagatctacccgccggaaaaggtggagcaggcgctgagcaacttctttcagcttgcgcatttggccgcgctgcgcgagatcgcgcttcgcgaggtggccgacgtggtggacgggcggttggcgccgcctccgcccgccgatccggagcggatcctggtctgcgtcaactaccgcccgcactccgaagcgctcattcggcgcggatggcgcatcgcggaccggctgcaggccaagctgtacgtgctcgtcgtgcagacggagttccctctatcgagccagagtgagcgcgactttgcggccgtgcgcgatctcgccgagcagttcggggcagagttccttcttcggcctgccctgcacaaatcggtcgggcaggtgatcgtcgagacggccgagagcgaatcggtctcccagatcgtgatgggacagcccttgaaccgaggtctcggcgcgcgattcgcccaccggcccatcacctacgtgctgaaccgcgcggagttcgtcgatctccacatcgtcgcgtacgcaggccgctggtcgcagccctccgcgtga

SEQ ID NO: 2893 - protein, 312 aa, Alicyclobacillus acidocaldarius
MHEQLGQILRARRESLGLTVEDIEERTKIRKRYIEALESGQWDVLPGRVYARGFVRSYAEVLGLDGSELLEKYVDGGDAGSAEPGVRAESPALTSENRAADRKPAARMVEPRSLNEMERTRSRAHERHERSRRETYDRPVRSVGSWVGQGLLIVGALVVVGGLYVLLHHHHGQATHRTNTTTSSPQKTQATKPATHQTAPPKRTTQPIQKAQTVVVALPYANGMYTYKVLHAASLQVVVTVNSGELWFSATADGQAVAPNVILNQGQSKSFSAQNNVTFHLGHVQGVSITVDGQPVQLPNITWAPVVVIERG

SEQ ID NO: 2894 - DNA, 939 bp, Alicyclobacillus acidocaldarius
gtgcacgagcagttggggcaaattctgcgcgccaggcgcgaatcgctcggactcacggtcgaagatatcgaggagcggacgaaaatccgcaagcgctacattgaggcgctggaatcggggcagtgggatgtcctgcccggccgcgtgtatgcgcgcggttttgtccggagttacgccgaggttctcgggctggacggaagcgagcttttggaaaaatacgtggacggtggcgacgctggcagcgccgagccgggagtgagggccgagtctcccgcgctgacctcggaaaaccgggccgcggaccgaaagccggcggcgcggatggtggagccgagatcgctgaacgagatggagcggacgaggtcccgcgcgcacgaacggcacgagcggtctcggcgggagacgtatgatcggcccgtccgatcggtgggatcctgggtcggacaaggacttctcatcgtcggcgcgctggtggtggtcggagggctgtatgttctcctgcatcaccaccatggccaggcgacccataggacgaataccaccacgtccagcccgcagaagacgcaggcgacgaagcctgccacgcatcagacggctccgcccaagcggacgacgcagcctatccagaaagctcagactgtggtggtggcgttgccgtacgcgaacgggatgtacacgtacaaggtgcttcacgccgcgagcctccaggtggtggtcaccgtgaattccggcgagttgtggttcagcgcgaccgcggacggtcaagcggtggcgccgaacgtcatcctgaaccaaggtcagtcgaagtcgttctcggcccagaacaacgtcacgttccacctgggtcacgtccagggcgtgtccatcacggtggacgggcagccggtccagctcccgaatatcacgtgggcgccggtggtcgtgatcgaacgagggtga

SEQ ID NO: 2895 - protein, 296 aa, Symbiobacterium thermophilum IAM 14863
EEIGRRLKAARLAKGLTLEQVEEETRIRKKYLDALESGRTVLIPGEVYVKGFLRSYGNFLGLDGEGLVEEYKALKARPAAEDGAGNGGPAEAPAREPEAAIAASAPRASAEPRQPAFATPPRRSSRSRPKRRRNGPGPGVYFLRRLMVALILILPLAAAGWWFWGRQAAAPPPQEPGQVAQEPGTTAQQPEPEPEPEPEPEPEPEQPPASGQPVPAKPVITVGAPQGDEVDITITASEVQLEMDFTQGFPWLEVYSGGETLYWSKASGPLSFTGKDFRIRIGFVAGFQLALNGEPV

SEQ ID NO: 2896 - protein, 71 aa, Thermoanaerobacter sp. X514
KELGEFLKSERIKMGLTLEEIQEITKIRIRYLKAIEDGDFSVMPALVYAKGFVKSYAEALGLDGNELVKKY

SEQ ID NO: 2897 - protein, 71 aa, Thermoanaerobacter pseudethanolicus ATCC 33223; identical to SEQ ID NO: 2896

SEQ ID NO: 2898 - protein, 278 aa, Solibacter usitatus Ellin6076
QVGETLRRERVKRNLDFEQISRELKISTRFLEAIENDQYEKLPGGVFAKSFVRQYARLLGLDEEELATQLQGVIAPPLEPLLSPEKRPASVAPIQVPKVEEWQTVGDRGFRWTGSLSAAAMVVVVMLVCSAVYAWLQRPKATAATQAAAPVHTAPSPVAAQPVPPPPAPPAAQTTEPTQAAASTAVPVPAGEQKPVEAAAVAAKPAETKPLAPNPDATVHVQIVADEPVWISARADGKYTFSGTLNPGDTKSVEGVKDVVLRLGNAGGVSISLNGKPV

SEQ ID NO: 2899 - protein, 278 aa, Solibacter usitatus Ellin6076; identical to SEQ ID NO: 2898

SEQ ID NO: 2900 - protein, 312 aa, Artificial
  Substitution in SEQ ID NO 2893
MHEQLGQILRARRESLGLTVEDIEERTKIRKRYIEALESGQWDVLPGRVYARGFVRSYAEVLGLDGSELLEKYVDGGDAGSAEPGVRAESPALTSENRAADRKPAARMVEPRSLNEMERTRSRAHERHERSRRETYDRPVRSVGSWVGQGLLIVGALVVVGGLYVLLHHHHGQATHRTNTTTSSPQKTQATKPATHQTAPPKRTTQPIQKAQTVVVALPYANGMYTYKVLHAASLQVVVTVNSGELWFSATADGQAVAPNVILNQGQSKSFSAQNNVTFHLGHVQGVSITVDGQPVQLPNITWAPVVVIEKG

SEQ ID NO: 2901 - protein, 312 aa, Artificial
  Substitution in SEQ ID NO 2893
MHEQLGQILRARRESLGLTVEDIEERTKIRKRYIEALESGQWDVLPGRVYARGFVRSYAEVLGLDGSELLEKYVDGGDAGSAEPGVRAESPALTSENRAADRKPAARMVEPRSLNEMERTRSRAHERHERSRRETYDRPVRSVGSWVGQGLLIVGALVVVGGLYVLLHHHHGQATHRTNTTTSSPNKTQATKPATHQTAPPKRTTQPIQKAQTVVVALPYANGMYTYKVLHAASLQVVVTVNSGELWFSATADGQAVAPNVILNQGQSKSFSAQNNVTFHLGHVQGVSITVDGQPVQLPNITWAPVVVIERG

SEQ ID NO: 2902 - protein, 312 aa, Artificial
  Substitution in SEQ ID NO 2893
MHEQLGQILRARRESLGLTVEDIEERTKIRKRYIEALESGQWDVLPGRVYARGFVRSYAEVLGLDGSELLEKYVDGGDAGSAEPGVRAESPALTSENRAADRKPAARMVEPRSLNEMERTRSRAHERHERSRRETYDRPVRSVGSWVGQGLLIVGALVVVGGLYVLLHHHHGQATHRTNTTTSSPQKTQATKPATHQTAPPKRTTQPIQKAQTVVVALPYANGMYTYKVLHAASLQVVVTVNSGELWFSATADGQAVAPNVILNQGQSKSFSAQNNITFHLGHVQGVSITVDGQPVQLPNITWAPVVVIERG

SEQ ID NO: 2903 - protein, 312 aa, Artificial
  Substitution in SEQ ID NO 2893
MHEQLGQILRARRESLGLTVEDIEERTKIRKRYIEALESGQWDVLPGRVYARGFVRSYAEVLGLDGSELLEKYVDGGDAGSAEPGVRAESPALTSENRAADRKPAARMVEPRSLNEMERTRSRAHERHERSRRETYDRPVRSVGSWVGQGLLIVGALVVVGGLYVLLHHHHGQATHRTNTTTSSPQKTQATKPATHQTAPPKRTTQPIQKAQTVVVALPYANGMYTYKVLHAASLQVVVTVNSGELWFSATADGQAVAPNVILQQGQSKSFSAQNNVTFHLGHVQGVSITVDGQPVQLPNITWAPVVVIERG

SEQ ID NO: 2904 - protein, 312 aa, Artificial
  Substitution in SEQ ID NO 2893
MHEQLGQILRARRESLGLTVEDIEERTKIRKRYIEALESGQWDVLPGRVYARGFVRSYAEVLGLDGSELLEKYVDGGDAGSAEPGVRAESPALTSENRAADRKPAARMVEPRSLNEMERTRSRAHERHERSRRETYDRPVRSVGSWVGQGLLIVGALVVVGGLYVLLHHHHGQATHRTNTTTSSPQKTQATKPATHQTAPPKRTTQPIQKAQTVVVALPYANGMYTYKVLHAASLQVVVTVNSGELWFSATADGQAVAPNVILNQGQSKSFSAQNNVTFHLGHVQGISITVDGQPVQLPNITWAPVVVIERG

SEQ ID NO: 2905 - DNA, 939 bp, Artificial
  Substitution in SEQ ID NO 2894
gtgcacgagcagttggggcaaattctgcgcgccaggcgcgaatcgctcggactcacggtcgaagatatcgaggagcggacgaaaatccgcaagcgctacattgaggcgctggaatcggggcagtgggatgtcctgcccggccgcgtgtatgcgcgcggttttgtccggagttacgccgaggttctcgggctggacggaagcgagcttttggaaaaatacgtggacggtggcgacgctggcagcgccgagccgggagtgagggccgagtctcccgcgctgacctcggaaaaccgggccgcggaccgaaagccggcggcgcggatggtggagccgagatcgctgaacgagatggagcggacgaggtcccgcgcgcacgaacggcacgagcggtctcggcgggagacgtatgatcggcccgtccgatcggtgggatcctgggtcggacaaggacttctcatcgtcggcgcgctggtggtggtcggagggctgtatgttctcctgcatcaccaccatggccaggcgacccataggacgaataccaccacgtccagcccgcagaagacgcaggcgacgaagcctgccacgcatcagacggctccgcccaagcggacgacgcagcctatccagaaagctcagactgtggtggtggcgttgccgtacgcgaacgggatgtacacgtacaaggtgcttcacgccgcgagcctccaggtggtggtcaccgtgaattccggcgagttgtggttcagcgcgaccgcggacggtcaagcggtggcgccgaacgtcatcctgaaccaaggtcagtcgaagtcgttctcggcccagaacaacgtcacgttccacctgggtcacgtccagggcgtgtccatcacggtggacgggcagccggtccagctcccgaatatcacgtgggcgccggtggtcgtgatcgaaaaagggtga

SEQ ID NO: 2906 - DNA, 939 bp, Artificial
  Substitution in SEQ ID NO 2894
gtgcacgagcagttggggcaaattctgcgcgccaggcgcgaatcgctcggactcacggtcgaagatatcgaggagcggacgaaaatccgcaagcgctacattgaggcgctggaatcggggcagtgggatgtcctgcccggccgcgtgtatgcgcgcggttttgtccggagttacgccgaggttctcgggctggacggaagcgagcttttggaaaaatacgtggacggtggcgacgctggcagcgccgagccgggagtgagggccgagtctcccgcgctgacctcggaaaaccgggccgcggaccgaaagccggcggcgcggatggtggagccgagatcgctgaacgagatggagcggacgaggtcccgcgcgcacgaacggcacgagcggtctcggcgggagacgtatgatcggcccgtccgatcggtgggatcctgggtcggacaaggacttctcatcgtcggcgcgctggtggtggtcggagggctgtatgttctcctgcatcaccaccatggccaggcgacccataggacgaataccaccacgtccagcccgaataagacgcaggcgacgaagcctgccacgcatcagacggctccgcccaagcggacgacgcagcctatccagaaagctcagactgtggtggtggcgttgccgtacgcgaacgggatgtacacgtacaaggtgcttcacgccgcgagcctccaggtggtggtcaccgtgaattccggcgagttgtggttcagcgcgaccgcggacggtcaagcggtggcgccgaacgtcatcctgaaccaaggtcagtcgaagtcgttctcggcccagaacaacgtcacgttccacctgggtcacgtccagggcgtgtccatcacggtggacgggcagccggtccagctcccgaatatcacgtgggcgccggtggtcgtgatcgaacgagggtga

SEQ ID NO: 2907 - DNA, 939 bp, Artificial
  Substitution in SEQ ID NO 2894
gtgcacgagcagttggggcaaattctgcgcgccaggcgcgaatcgctcggactcacggtcgaagatatcgaggagcggacgaaaatccgcaagcgctacattgaggcgctggaatcggggcagtgggatgtcctgcccggccgcgtgtatgcgcgcggttttgtccggagttacgccgaggttctcgggctggacggaagcgagcttttggaaaaatacgtggacggtggcgacgctggcagcgccgagccgggagtgagggccgagtctcccgcgctgacctcggaaaaccgggccgcggaccgaaagccggcggcgcggatggtggagccgagatcgctgaacgagatggagcggacgaggtcccgcgcgcacgaacggcacgagcggtctcggcgggagacgtatgatcggcccgtccgatcggtgggatcctgggtcggacaaggacttctcatcgtcggcgcgctggtggtggtcggagggctgtatgttctcctgcatcaccaccatggccaggcgacccataggacgaataccaccacgtccagcccgcagaagacgcaggcgacgaagcctgccacgcatcagacggctccgcccaagcggacgacgcagcctatccagaaagctcagactgtggtggtggcgttgccgtacgcgaacgggatgtacacgtacaaggtgcttcacgccgcgagcctccaggtggtggtcaccgtgaattccggcgagttgtggttcagcgcgaccgcggacggtcaagcggtggcgccgaacgtcatcctgaaccaaggtcagtcgaagtcgttctcggcccagaacaacattacgttccacctgggtcacgtccagggcgtgtccatcacggtggacgggcagccggtccagctcccgaatatcacgtgggcgccggtggtcgtgatcgaacgagggtga

SEQ ID NO: 2908 - DNA, 939 bp, Artificial
  Substitution in SEQ ID NO 2894
gtgcacgagcagttggggcaaattctgcgcgccaggcgcgaatcgctcggactcacggtcgaagatatcgaggagcggacgaaaatccgcaagcgctacattgaggcgctggaatcggggcagtgggatgtcctgcccggccgcgtgtatgcgcgcggttttgtccggagttacgccgaggttctcgggctggacggaagcgagcttttggaaaaatacgtggacggtggcgacgctggcagcgccgagccgggagtgagggccgagtctcccgcgctgacctcggaaaaccgggccgcggaccgaaagccggcggcgcggatggtggagccgagatcgctgaacgagatggagcggacgaggtcccgcgcgcacgaacggcacgagcggtctcggcgggagacgtatgatcggcccgtccgatcggtgggatcctgggtcggacaaggacttctcatcgtcggcgcgctggtggtggtcggagggctgtatgttctcctgcatcaccaccatggccaggcgacccataggacgaataccaccacgtccagcccgcagaagacgcaggcgacgaagcctgccacgcatcagacggctccgcccaagcggacgacgcagcctatccagaaagctcagactgtggtggtggcgttgccgtacgcgaacgggatgtacacgtacaaggtgcttcacgccgcgagcctccaggtggtggtcaccgtgaattccggcgagttgtggttcagcgcgaccgcggacggtcaagcggtggcgccgaacgtcatcctgcaacaaggtcagtcgaagtcgttctcggcccagaacaacgtcacgttccacctgggtcacgtccagggcgtgtccatcacggtggacgggcagccggtccagctcccgaatatcacgtgggcgccggtggtcgtgatcgaacgagggtga

SEQ ID NO: 2909 - DNA, 939 bp, Artificial
  Substitution in SEQ ID NO 2894
gtgcacgagcagttggggcaaattctgcgcgccaggcgcgaatcgctcggactcacggtcgaagatatcgaggagcggacgaaaatccgcaagcgctacattgaggcgctggaatcggggcagtgggatgtcctgcccggccgcgtgtatgcgcgcggttttgtccggagttacgccgaggttctcgggctggacggaagcgagcttttggaaaaatacgtggacggtggcgacgctggcagcgccgagccgggagtgagggccgagtctcccgcgctgacctcggaaaaccgggccgcggaccgaaagccggcggcgcggatggtggagccgagatcgctgaacgagatggagcggacgaggtcccgcgcgcacgaacggcacgagcggtctcggcgggagacgtatgatcggcccgtccgatcggtgggatcctgggtcggacaaggacttctcatcgtcggcgcgctggtggtggtcggagggctgtatgttctcctgcatcaccaccatggccaggcgacccataggacgaataccaccacgtccagcccgcagaagacgcaggcgacgaagcctgccacgcatcagacggctccgcccaagcggacgacgcagcctatccagaaagctcagactgtggtggtggcgttgccgtacgcgaacgggatgtacacgtacaaggtgcttcacgccgcgagcctccaggtggtggtcaccgtgaattccggcgagttgtggttcagcgcgaccgcggacggtcaagcggtggcgccgaacgtcatcctgaaccaaggtcagtcgaagtcgttctcggcccagaacaacgtcacgttccacctgggtcacgtccagggcatttccatcacggtggacgggcagccggtccagctcccgaatatcacgtgggcgccggtggtcgtgatcgaacgagggtga

SEQ ID NO: 2910 - protein, 1068 aa, Alicyclobacillus acidocaldarius
MAERYAHFVARFKYGIIAVWILAVALAHVLLPQLNAIVAHKNTEFLPNSSSVVIASNWLKRVDPARQAGSSAVVAMYNPHGLTAADKAWFTQKLKQVADHKPAYGVKTVTAAYNQSKSVQNQFFSADRTVEIATIGFPGNDVSKATDASLNQLHQVFQQPPKDAQILFTGDTPIENDNINISMDGASKTAGVTIALVLVILLVVFRSVVAPFLTLLSIGLSYLLTTNLVAVLANVGLPVSTFTDTFLIAIIFGAGTDYSIIVLNRFREEASRGLAPVDALARAMSGVAKTVVYSALTVFLSFATLYFARFGLFRSGVGVAVGLAVTLFACLTFLPALMMVLGRYVFWPRRNLDGASHKPSRIWDLTGRTALRHPWWTLAGVLVVLTPIALSFTDKRTFDPTSDIPTAPSVEGFHVVSKAFGPGKVLPMDVVIDTPDNLRTPEGLATIEQVSEAIAKLPFVQQVQSATRPTGSVIAEFELAKQNQLAANGLGKVQTGLNQVASHVGTKSAQQAANAANTLSSGASALAQAGGKLSQGAAQAQEGASKLAAGAQALSSGASRLTQANTQLASGAAQVAAGSQQVAQGADKLATSARSIASGQTALANGAAREAQAAQQLANAIAAWTKAHPAEASDPNWQQIVALAQGNAAGAQQTAKAASQLANGTSQWANGATSLAEGAGKVAAGASQLAAGSRGAASGAKGLSDGAAQVGQGASSLAQGLNQLSGGARQLQAGLGKWAAGAAQFSSGLSNAGAGENQLHSALVKLSNGVGTVKTALDETAKAQTSGDPGFYVPASAISSNKSLRQALDSYISPDGHVADIRVTLKSDPYSMTAIQEMPRLETVAQAAFTAAPIHTGQVGFAGTTPTQYALNQLSNQDFVRMMALILGSIFLLLVVMLRSLIAPLYVIASLTGTYFVTMACLQFVAVDVMHKAGISWTVPFFALLLLVALGVDYSIFLMSRFDEELRRHPELNLRSAMLYAMRQMGNVIFSAAAIMAGTFGSMSVSGVTTLVEIGLSVIIGLALYALIVLALFVPACTAIVGEAHFWPFRRVPREEQELRLPEELAAE

SEQ ID NO: 2911 - DNA, 3207 bp, Alicyclobacillus acidocaldarius
gtggcagagcgttacgcccatttcgtcgcgcgcttcaagtatgggatcatcgccgtttggatcctcgcggtggcgctcgcgcacgtgttgctgccgcagctcaacgcgattgtcgcccacaagaacacggaatttttgccaaactcgtcgagcgtcgtgatcgccagtaattggctgaagcgggtcgatccggcgcgccaagcgggttcgagcgccgtggtggccatgtacaacccgcatggattgacggcggcggacaaggcgtggttcacgcaaaagctgaagcaggtggctgaccataaacccgcctacggcgtgaagaccgtcacggccgcctacaaccagtcgaagtcggtgcagaaccagtttttcagcgcggatcgcacggtggagatcgcgaccatcggctttccgggtaacgacgtatccaaggccaccgacgcgtcgttgaaccagcttcatcaggtgtttcagcaaccgcccaaggatgcacagatcctcttcacgggcgacacgcccatcgagaacgacaacatcaacatctcgatggacggcgcttccaagacggcaggcgtgaccatcgccctggtgctcgtcattctgctcgtcgtctttcgatccgtcgtggccccatttttgaccctgctcagcatcgggctttcctatcttctgacgacgaatctcgtggccgtcttggcgaacgtgggcctgccggtctcgaccttcacggacacgtttctcatcgccatcatcttcggcgcgggaaccgactacagcatcatcgtgctgaatcgattccgcgaggaggcgagccggggtctcgccccagtggacgccctcgcgcgagcgatgtccggagtggccaagaccgtcgtgtacagcgcgctcaccgtctttctctcgtttgcgacgctgtatttcgcccgcttcggcctcttccgatccggcgtcggcgtggcagtgggcttggccgtgacgctgtttgcatgcctcacgttcctcccggcgctcatgatggtgctcgggcgctacgtgttctggccgcggcgcaacctcgacggcgcgagtcacaagccctcccgcatctgggatctgaccggcaggaccgcgctccggcatccctggtggacactcgccggggtgctcgtggtgctgacgcccattgcgctgtccttcacggacaagcgcacgttcgatccgacctccgacatcccgacggcgccttccgtcgagggctttcacgtggtgtccaaggcgttcggccccggcaaggtcctgccgatggacgtcgtgatcgacacgccggacaatctgcgcacgccggaggggctggcgaccatcgagcaggtgtcggaggccatcgcgaagctgccttttgtgcagcaggtgcagagcgccacccggccgacgggcagcgtcatcgccgaatttgaattggcgaagcagaaccagctcgcggccaatggcctgggcaaggtgcagacgggcctgaaccaggtggcgagccacgtcggcacaaagagcgcacagcaggcggcgaatgcggcgaacacgctgtcgagtggggcctcggcgctcgcgcaggcgggcgggaagctgagccaaggcgcggcgcaggcgcaagagggcgcttcgaagctcgccgcgggcgcacaggcgctttcgagcggcgcatcgcggctgacgcaggcaaacacgcagctggccagcggcgctgcgcaggtggcggccggatcgcaacaggtggcacagggcgccgataagctcgccacgtcggcgcgcagcatcgcatcggggcagacggcgctggcgaatggcgctgctcgcgaagcgcaggcggcgcagcagctcgcgaacgccatcgcggcctggacgaaggcgcatccggcggaagcttccgatcccaactggcagcagattgtcgcgctggcgcagggcaacgcagcgggggcgcagcagacggccaaggcggccagccagctggcgaatggcacgagccagtgggcgaacggcgccacctcactggcagagggcgcgggcaaagtcgccgcgggcgcgagccagctggcggccggaagccgcggcgcggcatctggcgccaaaggcctgagcgacggggctgcccaagtgggtcaaggcgcttcttccctggcccaaggactgaatcagctgagtggcggcgctcgccaacttcaggcggggcttggcaagtgggcggccggagctgcgcaattttcctccgggctctcgaacgcgggcgccggggagaatcagcttcacagcgcgctcgtcaagctgtcgaacggcgtgggcacggtcaagaccgcgctcgacgagaccgccaaggcgcagacgtcgggcgatcccggcttctacgtgcctgcgtccgccatctcgtcgaacaagagcctgcgccaagccctggacagctacatctcgccggatgggcacgtggcggacattcgcgtcacactgaagtcggacccgtattccatgacggcgattcaggagatgccgaggcttgagacggtcgcccaggcggccttcacggccgcgccgattcacaccgggcaggtcgggttcgccggaaccacgccgacacagtacgcgctgaaccaactgtccaatcaggacttcgtccgcatgatggcgctcattctggggtccatctttctcctgctcgtggtgatgctgagatcgctcatcgcacccttgtacgtcattgcgtcgctcaccgggacgtacttcgtgacgatggcgtgcctgcagtttgtcgccgtggatgtgatgcacaaggcgggcatcagctggacggttccgtttttcgcgcttctcctgttggtggcgctcggcgtcgactactcgattttcttgatgtcgcgcttcgacgaggaactgaggcgccatccggagctcaacctgcgcagcgcgatgctttatgccatgcgccagatgggcaacgtgatcttctctgccgcagccatcatggcgggcacctttggctccatgtccgtctccggcgtgacgacgctcgtcgagatcgggttgtcggtcatcatcggcctcgcgctgtacgcgctcatcgtgctggccctcttcgtgccggcctgcaccgcgattgtgggagaagcccatttctggccgtttcgcagagtgcctcgggaggagcaggagctgaggctgccggaagaactggctgcggagtga

SEQ ID NO: 2912 - protein, 339 aa, Bacillus selenitireducens MLS10
DGMAEARQGASDLSGGLDELQSGHYALLDGVGEGRNGLENFRKGLRDMLEGTEELNEGIGEAEDALRQVSKQEENPLEGLFIPNEAFEEEAFEEAFDQYVTPGGQVAGMELLFEEDPYSQEAMMILDEVEEVAAFTLRDTPFEDKEMAFSGITSSNRDLRDVSDQDFFVTAAVMLAGIFIALTFLFKSLIMPLYVLVSLVLTYIGSMAVAELIFVTILGYDGIMWAVPFFSFVLLMALGVDYSIFLMGRFREILEEGEEITIHDAIHIAMKRIGGTVISAALILGGTFAAMMASGVLTLMQVSTVIMTGLLLYTLVMLPVFVPACMLLLGSWNWWPLGR

SEQ ID NO: 2913 - protein, 473 aa, Listeria innocua Clip11262
PPMADLVREKGELKLPDGYPSSLATEMQKKHNPDDKGSAYIAVYTADHKLTGTELNNIKKSLDSIDKNKDELHVTNVVSSFNQPELKDKFLSKDGKTMVASLTVDDTDASVKSIRNALDKKMDVKGVDTYLTGNKLIQEDVVQGSEDGLHKTEGITVVFILVVLFLVFRSAVAPFIPLLTVGISYLVAQSTVAFLIDIFNFPVSTYTQIFMVCIMFGIGTDYCILLMSRFKEEMGAGLDPRESVHATYRTAGKTVIYSGVAVLVAFTSLYFVQFDLYRSAVAVGVGIVVLLAALYTLVPFFMSTLGTHLFWPLNKNISHKENKVWGAAGKFTFARPWIALLIVAAITLPPILLHTGTESFNSLDEISDKYPSKKGFEIVSDSFGAGQVAPTQVFIENDDNMRTTEYIAQIEKISDDLSHLKGIDMVMSASRPAGKRVDDIYIKNQAGQVNDGVGQATDGVGEVKKGLDSASSE

SEQ ID NO: 2914 - protein, 473 aa, Listeria monocytogenes FSL J2-064
PPMADLVREKGELKLPDGYPSSLATEMQKKHNPDDKGSAYIAVYTADHKLTGTELNDIQDSLNSIEKDKDELHVTNVLSSFNQPELKDKFLSKDGKTMVASLTVDDTDASVKSIRNALDKKMDVKGVDTYLTGNKLIQEDVVQGSEDGLHKTEGITVVFILVVLFLVFRSAVAPFIPLVTVGISYLVAQSTVAFLIDIFNFPVSTYTQIFMVCIMFGIGTDYCILLMSRFKEEMGAGLNPREAVHATYRTAGKTVIYSGVAVLVAFTSLYFVQFDLYRSAVAVGVGIVVLLAALYTLVPFFMSTLGTHLFWPLNKNISHKENKIWGAAGKFTFARPWIALLIVAAITLPPILLHTGTESFNSLDEISDKYPSKKGFEIVSDSFGAGQVAPTQIFIENDDNMRTTDYIAQIEKISDDLSHLKGIDMVMSASRPAGKRVDDIYIKNQAGQVNDGVGQATDGVGEVKKGLDSASSE

SEQ ID NO: 2915 - protein, 473 aa, Listeria monocytogenes FSL N1-017; identical to SEQ ID NO: 2914

SEQ ID NO: 2916 - protein, 473 aa, Listeria monocytogenes str. 4b F2365; identical to SEQ ID NO: 2914

SEQ ID NO: 2917 - protein, 1068 aa, Artificial
  Substitution in SEQ ID NO 2910
MAERYAHFVARFKYGIIAVWILAVALAHVLLPQLNAIVAHKNTEFLPNSSSVVIASNWLKRVDPARQAGSSAVVAMYNPHGLTAADKAWFTQKLKQVADHKPAYGVKTVTAAYNQSKSVQNQFFSADRTVEIATIGFPGNDVSKATDASLNQLHQVFQQPPKDAQILFTGDTPIENDNINISMDGASKTAGVTIALVLVILLVVFRSVVAPFLTLLSIGLSYLLTTNLVAVLANVGLPVSTFTDTFLIAIIFGAGTDYSIIVLNRFREEASRGLAPVDALARAMSGVAKTVVYSALTVFLSFATLYFARFGLFRSGVGVAVGLAVTLFACLTFLPALMMVLGRYVFWPRKNLDGASHKPSRIWDLTGRTALRHPWWTLAGVLVVLTPIALSFTDKRTFDPTSDIPTAPSVEGFHVVSKAFGPGKVLPMDVVIDTPDNLRTPEGLATIEQVSEAIAKLPFVQQVQSATRPTGSVIAEFELAKQNQLAANGLGKVQTGLNQVASHVGTKSAQQAANAANTLSSGASALAQAGGKLSQGAAQAQEGASKLAAGAQALSSGASRLTQANTQLASGAAQVAAGSQQVAQGADKLATSARSIASGQTALANGAAREAQAAQQLANAIAAWTKAHPAEASDPNWQQIVALAQGNAAGAQQTAKAASQLANGTSQWANGATSLAEGAGKVAAGASQLAAGSRGAASGAKGLSDGAAQVGQGASSLAQGLNQLSGGARQLQAGLGKWAAGAAQFSSGLSNAGAGENQLHSALVKLSNGVGTVKTALDETAKAQTSGDPGFYVPASAISSNKSLRQALDSYISPDGHVADIRVTLKSDPYSMTAIQEMPRLETVAQAAFTAAPIHTGQVGFAGTTPTQYALNQLSNQDFVRMMALILGSIFLLLVVMLRSLIAPLYVIASLTGTYFVTMACLQFVAVDVMHKAGISWTVPFFALLLLVALGVDYSIFLMSRFDEELRRHPELNLRSAMLYAMRQMGNVIFSAAAIMAGTFGSMSVSGVTTLVEIGLSVIIGLALYALIVLALFVPACTAIVGEAHFWPFRRVPREEQELRLPEELAAE

SEQ ID NO: 2918 - protein, 1068 aa, Artificial
  Substitution in SEQ ID NO 2910
MAERYAHFVARFKYGIIAVWILAVALAHVLLPQLNAIVAHKNTEFLPNSSSVVIASNWLKRVDPARQAGSSAVVAMYNPHGLTAADKAWFTQKLKQVADHKPAYGVKTVTAAYNQSKSVQNQFFSADRTVEIATIGFPGNDVSKATDASLNQLHQVFQQPPKDAQILFTGDTPIENDNINISMDGASKTAGVTIALVLVILLVVFRSVVAPFLTLLSIGLSYLLTTNLVAVLANVGLPVSTFTDTFLIAIIFGAGTDYSIIVLNRFREEASRGLAPVDALARAMSGVAKTVVYSALTVFLSFATLYFARFGLFRSGVGVAVGLAVTLFACLTFLPALMMVLGRYVFWPRRNLDGASHKPSRIWDLTGRTALRHPWWTLAGVLVVLTPIALSFTDKRTFDPTSDIPTAPSVEGFHVVSKAFGPGKVLPMDVVIDTPDNLRTPEGLATIEQVSEAIAKLPFVQQVQSATRPTGSVIAEFELAKQNQLAANGLGKVQTGLNQVASHVGTKSAQQAANAANTLSSGASALAQAGGKLSQGAAQAQEGASKLAAGAQALSSGASRLTQANTQLASGAAQVAAGSQQVAQGADKLATSARSIASGQTALANGAAREAQAAQQIANAIAAWTKAHPAEASDPNWQQIVALAQGNAAGAQQTAKAASQLANGTSQWANGATSLAEGAGKVAAGASQLAAGSRGAASGAKGLSDGAAQVGQGASSLAQGLNQLSGGARQLQAGLGKWAAGAAQFSSGLSNAGAGENQLHSALVKLSNGVGTVKTALDETAKAQTSGDPGFYVPASAISSNKSLRQALDSYISPDGHVADIRVTLKSDPYSMTAIQEMPRLETVAQAAFTAAPIHTGQVGFAGTTPTQYALNQLSNQDFVRMMALILGSIFLLLVVMLRSLIAPLYVIASLTGTYFVTMACLQFVAVDVMHKAGISWTVPFFALLLLVALGVDYSIFLMSRFDEELRRHPELNLRSAMLYAMRQMGNVIFSAAAIMAGTFGSMSVSGVTTLVEIGLSVIIGLALYALIVLALFVPACTAIVGEAHFWPFRRVPREEQELRLPEELAAE

SEQ ID NO: 2919 - protein, 1068 aa, Artificial
  Substitution in SEQ ID NO 2910
MAERYAHFVARFKYGIIAVWILAVALAHVLLPQLNAIVAHKNTEFLPNSSSVVIASNWLKRVDPARQAGSSAVVAMYNPHGLTAADKAWFTQKLKQVADHKPAYGVKTVTAAYNQSKSVQNQFFSADRTVEIATIGFPGNDVSKATDASLNQLHQVFQQPPKDAQILFTGDTPIENDNINISMDGASKTAGVTIALVLVILLVVFRSVVAPFLTLLSIGLSYLLTTNLVAVLANVGLPVSTFTDTFLIAIIFGAGTDYSIIVLNRFREEASRGLAPVDALARAMSGVAKTVVYSALTVFLSFATLYFARFGLFRSGVGVAVGLAVTLFACLTFLPALMMVLGRYVFWPRRQLDGASHKPSRIWDLTGRTALRHPWWTLAGVLVVLTPIALSFTDKRTFDPTSDIPTAPSVEGFHVVSKAFGPGKVLPMDVVIDTPDNLRTPEGLATIEQVSEAIAKLPFVQQVQSATRPTGSVIAEFELAKQNQLAANGLGKVQTGLNQVASHVGTKSAQQAANAANTLSSGASALAQAGGKLSQGAAQAQEGASKLAAGAQALSSGASRLTQANTQLASGAAQVAAGSQQVAQGADKLATSARSIASGQTALANGAAREAQAAQQLANAIAAWTKAHPAEASDPNWQQIVALAQGNAAGAQQTAKAASQLANGTSQWANGATSLAEGAGKVAAGASQLAAGSRGAASGAKGLSDGAAQVGQGASSLAQGLNQLSGGARQLQAGLGKWAAGAAQFSSGLSNAGAGENQLHSALVKLSNGVGTVKTALDETAKAQTSGDPGFYVPASAISSNKSLRQALDSYISPDGHVADIRVTLKSDPYSMTAIQEMPRLETVAQAAFTAAPIHTGQVGFAGTTPTQYALNQLSNQDFVRMMALILGSIFLLLVVMLRSLIAPLYVIASLTGTYFVTMACLQFVAVDVMHKAGISWTVPFFALLLLVALGVDYSIFLMSRFDEELRRHPELNLRSAMLYAMRQMGNVIFSAAAIMAGTFGSMSVSGVTTLVEIGLSVIIGLALYALIVLALFVPACTAIVGEAHFWPFRRVPREEQELRLPEELAAE

SEQ ID NO: 2920 - protein, 1068 aa, Artificial
  Substitution in SEQ ID NO 2910
MAERYAHFVARFKYGIIAVWILAVALAHVLLPQLNAIVAHKNTEFLPNSSSVVIASNWLKRVDPARQAGSSAVVAMYNPHGLTAADKAWFTQKLKQVADHKPAYGVKTVTAAYNQSKSVQNQFFSADRTVEIATIGFPGNDVSKATDASLNQLHQVFQQPPKDAQILFTGDTPIENDNINISMDGASKTAGVTIALVLVILLVVFRSVVAPFLTLLSIGLSYLLTTNLVAVLANVGLPVSTFTDTFLIAIIFGAGTDYSIIVLNRFREEASRGLAPVDALARAMSGVAKTVVYSALTVFLSFATLYFARFGLFRSGVGVAVGLAVTLFACLTFLPALMMVLGRYVFWPRRNLDGASHKPSRIWDLTGRTALRHPWWTLAGVLVVLTPIALSFTDKRTFDPTSDIPTAPSVEGFHVVSKAFGPGKVLPMDVVIDTPDNLRTPEGLATIEQVSEAIAKLPFVQQVQSATRPTGSVIAEFELAKQNQLAANGLGKVQTGLNQVASHVGTKSAQQAANAANTLSSGASALAQAGGKLSQGAAQAQEGASKLAAGAQALSSGASRLTQANTQLASGAAQVAAGSQQVAQGADKLATSARSIASGQTALANGAAREAQAAQQLANAIAAWTKAHPAEASDPNWQQIVALAQGNAAGAQQTAKAASQLANGTSQWANGATSLAEGAGKVAAGASQLAAGSRGAASGAKGLSDGAAQVGQGASSLAQGLNQLSGGARQLQAGLGKWAAGAAQFSSGLSNAGAGENQLHSALVKLSNGVGTVKTALDETAKAQTSGDPGFYVPASAISSNKSLRQALDSYISPDGHVADIRVTLKSDPYSMTAIQEMPRLETVAQAAFTAAPIHTGQVGFAGTTPTQYALNQLSNQDFVRMMALILGSIFLLLVVMLRSLIAPLYVIASLTGTYFVTMACLQFVAVDVMHKAGISWTVPFFALLLLIALGVDYSIFLMSRFDEELRRHPELNLRSAMLYAMRQMGNVIFSAAAIMAGTFGSMSVSGVTTLVEIGLSVIIGLALYALIVLALFVPACTAIVGEAHFWPFRRVPREEQELRLPEELAAE

SEQ ID NO: 2921 - protein, 1068 aa, Artificial
  Substitution in SEQ ID NO 2910
MAERYAHFVARFKYGIIAVWILAVALAHVLLPQLNAIVAHKNTEFLPNSSSVVIASNWLKRVDPARQAGSSAVVAMYNPHGLTAADKAWFTQKLKQVADHKPAYGVKTVTAAYNQSRSVQNQFFSADRTVEIATIGFPGNDVSKATDASLNQLHQVFQQPPKDAQILFTGDTPIENDNINISMDGASKTAGVTIALVLVILLVVFRSVVAPFLTLLSIGLSYLLTTNLVAVLANVGLPVSTFTDTFLIAIIFGAGTDYSIIVLNRFREEASRGLAPVDALARAMSGVAKTVVYSALTVFLSFATLYFARFGLFRSGVGVAVGLAVTLFACLTFLPALMMVLGRYVFWPRRNLDGASHKPSRIWDLTGRTALRHPWWTLAGVLVVLTPIALSFTDKRTFDPTSDIPTAPSVEGFHVVSKAFGPGKVLPMDVVIDTPDNLRTPEGLATIEQVSEAIAKLPFVQQVQSATRPTGSVIAEFELAKQNQLAANGLGKVQTGLNQVASHVGTKSAQQAANAANTLSSGASALAQAGGKLSQGAAQAQEGASKLAAGAQALSSGASRLTQANTQLASGAAQVAAGSQQVAQGADKLATSARSIASGQTALANGAAREAQAAQQLANAIAAWTKAHPAEASDPNWQQIVALAQGNAAGAQQTAKAASQLANGTSQWANGATSLAEGAGKVAAGASQLAAGSRGAASGAKGLSDGAAQVGQGASSLAQGLNQLSGGARQLQAGLGKWAAGAAQFSSGLSNAGAGENQLHSALVKLSNGVGTVKTALDETAKAQTSGDPGFYVPASAISSNKSLRQALDSYISPDGHVADIRVTLKSDPYSMTAIQEMPRLETVAQAAFTAAPIHTGQVGFAGTTPTQYALNQLSNQDFVRMMALILGSIFLLLVVMLRSLIAPLYVIASLTGTYFVTMACLQFVAVDVMHKAGISWTVPFFALLLLVALGVDYSIFLMSRFDEELRRHPELNLRSAMLYAMRQMGNVIFSAAAIMAGTFGSMSVSGVTTLVEIGLSVIIGLALYALIVLALFVPACTAIVGEAHFWPFRRVPREEQELRLPEELAAE

SEQ ID NO: 2922 - DNA, 3207 bp, Artificial
  Substitution in SEQ ID NO 2911
gtggcagagcgttacgcccatttcgtcgcgcgcttcaagtatgggatcatcgccgtttggatcctcgcggtggcgctcgcgcacgtgttgctgccgcagctcaacgcgattgtcgcccacaagaacacggaatttttgccaaactcgtcgagcgtcgtgatcgccagtaattggctgaagcgggtcgatccggcgcgccaagcgggttcgagcgccgtggtggccatgtacaacccgcatggattgacggcggcggacaaggcgtggttcacgcaaaagctgaagcaggtggctgaccataaacccgcctacggcgtgaagaccgtcacggccgcctacaaccagtcgaagtcggtgcagaaccagtttttcagcgcggatcgcacggtggagatcgcgaccatcggctttccgggtaacgacgtatccaaggccaccgacgcgtcgttgaaccagcttcatcaggtgtttcagcaaccgcccaaggatgcacagatcctcttcacgggcgacacgcccatcgagaacgacaacatcaacatctcgatggacggcgcttccaagacggcaggcgtgaccatcgccctggtgctcgtcattctgctcgtcgtctttcgatccgtcgtggccccatttttgaccctgctcagcatcgggctttcctatcttctgacgacgaatctcgtggccgtcttggcgaacgtgggcctgccggtctcgaccttcacggacacgtttctcatcgccatcatcttcggcgcgggaaccgactacagcatcatcgtgctgaatcgattccgcgaggaggcgagccggggtctcgccccagtggacgccctcgcgcgagcgatgtccggagtggccaagaccgtcgtgtacagcgcgctcaccgtctttctctcgtttgcgacgctgtatttcgcccgcttcggcctcttccgatccggcgtcggcgtggcagtgggcttggccgtgacgctgtttgcatgcctcacgttcctcccggcgctcatgatggtgctcgggcgctacgtgttctggccgcggaaaaacctcgacggcgcgagtcacaagccctcccgcatctgggatctgaccggcaggaccgcgctccggcatccctggtggacactcgccggggtgctcgtggtgctgacgcccattgcgctgtccttcacggacaagcgcacgttcgatccgacctccgacatcccgacggcgccttccgtcgagggctttcacgtggtgtccaaggcgttcggccccggcaaggtcctgccgatggacgtcgtgatcgacacgccggacaatctgcgcacgccggaggggctggcgaccatcgagcaggtgtcggaggccatcgcgaagctgccttttgtgcagcaggtgcagagcgccacccggccgacgggcagcgtcatcgccgaatttgaattggcgaagcagaaccagctcgcggccaatggcctgggcaaggtgcagacgggcctgaaccaggtggcgagccacgtcggcacaaagagcgcacagcaggcggcgaatgcggcgaacacgctgtcgagtggggcctcggcgctcgcgcaggcgggcgggaagctgagccaaggcgcggcgcaggcgcaagagggcgcttcgaagctcgccgcgggcgcacaggcgctttcgagcggcgcatcgcggctgacgcaggcaaacacgcagctggccagcggcgctgcgcaggtggcggccggatcgcaacaggtggcacagggcgccgataagctcgccacgtcggcgcgcagcatcgcatcggggcagacggcgctggcgaatggcgctgctcgcgaagcgcaggcggcgcagcagctcgcgaacgccatcgcggcctggacgaaggcgcatccggcggaagcttccgatcccaactggcagcagattgtcgcgctggcgcagggcaacgcagcgggggcgcagcagacggccaaggcggccagccagctggcgaatggcacgagccagtgggcgaacggcgccacctcactggcagagggcgcgggcaaagtcgccgcgggcgcgagccagctggcggccggaagccgcggcgcggcatctggcgccaaaggcctgagcgacggggctgcccaagtgggtcaaggcgcttcttccctggcccaaggactgaatcagctgagtggcggcgctcgccaacttcaggcggggcttggcaagtgggcggccggagctgcgcaattttcctccgggctctcgaacgcgggcgccggggagaatcagcttcacagcgcgctcgtcaagctgtcgaacggcgtgggcacggtcaagaccgcgctcgacgagaccgccaaggcgcagacgtcgggcgatcccggcttctacgtgcctgcgtccgccatctcgtcgaacaagagcctgcgccaagccctggacagctacatctcgccggatgggcacgtggcggacattcgcgtcacactgaagtcggacccgtattccatgacggcgattcaggagatgccgaggcttgagacggtcgcccaggcggccttcacggccgcgccgattcacaccgggcaggtcgggttcgccggaaccacgccgacacagtacgcgctgaaccaactgtccaatcaggacttcgtccgcatgatggcgctcattctggggtccatctttctcctgctcgtggtgatgctgagatcgctcatcgcacccttgtacgtcattgcgtcgctcaccgggacgtacttcgtgacgatggcgtgcctgcagtttgtcgccgtggatgtgatgcacaaggcgggcatcagctggacggttccgtttttcgcgcttctcctgttggtggcgctcggcgtcgactactcgattttcttgatgtcgcgcttcgacgaggaactgaggcgccatccggagctcaacctgcgcagcgcgatgctttatgccatgcgccagatgggcaacgtgatcttctctgccgcagccatcatggcgggcacctttggctccatgtccgtctccggcgtgacgacgctcgtcgagatcgggttgtcggtcatcatcggcctcgcgctgtacgcgctcatcgtgctggccctcttcgtgccggcctgcaccgcgattgtgggagaagcccatttctggccgtttcgcagagtgcctcgggaggagcaggagctgaggctgccggaagaactggctgcggagtga

SEQ ID NO: 2923 - DNA, 3207 bp, Artificial
  Substitution in SEQ ID NO 2911
gtggcagagcgttacgcccatttcgtcgcgcgcttcaagtatgggatcatcgccgtttggatcctcgcggtggcgctcgcgcacgtgttgctgccgcagctcaacgcgattgtcgcccacaagaacacggaatttttgccaaactcgtcgagcgtcgtgatcgccagtaattggctgaagcgggtcgatccggcgcgccaagcgggttcgagcgccgtggtggccatgtacaacccgcatggattgacggcggcggacaaggcgtggttcacgcaaaagctgaagcaggtggctgaccataaacccgcctacggcgtgaagaccgtcacggccgcctacaaccagtcgaagtcggtgcagaaccagtttttcagcgcggatcgcacggtggagatcgcgaccatcggctttccgggtaacgacgtatccaaggccaccgacgcgtcgttgaaccagcttcatcaggtgtttcagcaaccgcccaaggatgcacagatcctcttcacgggcgacacgcccatcgagaacgacaacatcaacatctcgatggacggcgcttccaagacggcaggcgtgaccatcgccctggtgctcgtcattctgctcgtcgtctttcgatccgtcgtggccccatttttgaccctgctcagcatcgggctttcctatcttctgacgacgaatctcgtggccgtcttggcgaacgtgggcctgccggtctcgaccttcacggacacgtttctcatcgccatcatcttcggcgcgggaaccgactacagcatcatcgtgctgaatcgattccgcgaggaggcgagccggggtctcgccccagtggacgccctcgcgcgagcgatgtccggagtggccaagaccgtcgtgtacagcgcgctcaccgtctttctctcgtttgcgacgctgtatttcgcccgcttcggcctcttccgatccggcgtcggcgtggcagtgggcttggccgtgacgctgtttgcatgcctcacgttcctcccggcgctcatgatggtgctcgggcgctacgtgttctggccgcggcgcaacctcgacggcgcgagtcacaagccctcccgcatctgggatctgaccggcaggaccgcgctccggcatccctggtggacactcgccggggtgctcgtggtgctgacgcccattgcgctgtccttcacggacaagcgcacgttcgatccgacctccgacatcccgacggcgccttccgtcgagggctttcacgtggtgtccaaggcgttcggccccggcaaggtcctgccgatggacgtcgtgatcgacacgccggacaatctgcgcacgccggaggggctggcgaccatcgagcaggtgtcggaggccatcgcgaagctgccttttgtgcagcaggtgcagagcgccacccggccgacgggcagcgtcatcgccgaatttgaattggcgaagcagaaccagctcgcggccaatggcctgggcaaggtgcagacgggcctgaaccaggtggcgagccacgtcggcacaaagagcgcacagcaggcggcgaatgcggcgaacacgctgtcgagtggggcctcggcgctcgcgcaggcgggcgggaagctgagccaaggcgcggcgcaggcgcaagagggcgcttcgaagctcgccgcgggcgcacaggcgctttcgagcggcgcatcgcggctgacgcaggcaaacacgcagctggccagcggcgctgcgcaggtggcggccggatcgcaacaggtggcacagggcgccgataagctcgccacgtcggcgcgcagcatcgcatcggggcagacggcgctggcgaatggcgctgctcgcgaagcgcaggcggcgcagcagattgcgaacgccatcgcggcctggacgaaggcgcatccggcggaagcttccgatcccaactggcagcagattgtcgcgctggcgcagggcaacgcagcgggggcgcagcagacggccaaggcggccagccagctggcgaatggcacgagccagtgggcgaacggcgccacctcactggcagagggcgcgggcaaagtcgccgcgggcgcgagccagctggcggccggaagccgcggcgcggcatctggcgccaaaggcctgagcgacggggctgcccaagtgggtcaaggcgcttcttccctggcccaaggactgaatcagctgagtggcggcgctcgccaacttcaggcggggcttggcaagtgggcggccggagctgcgcaattttcctccgggctctcgaacgcgggcgccggggagaatcagcttcacagcgcgctcgtcaagctgtcgaacggcgtgggcacggtcaagaccgcgctcgacgagaccgccaaggcgcagacgtcgggcgatcccggcttctacgtgcctgcgtccgccatctcgtcgaacaagagcctgcgccaagccctggacagctacatctcgccggatgggcacgtggcggacattcgcgtcacactgaagtcggacccgtattccatgacggcgattcaggagatgccgaggcttgagacggtcgcccaggcggccttcacggccgcgccgattcacaccgggcaggtcgggttcgccggaaccacgccgacacagtacgcgctgaaccaactgtccaatcaggacttcgtccgcatgatggcgctcattctggggtccatctttctcctgctcgtggtgatgctgagatcgctcatcgcacccttgtacgtcattgcgtcgctcaccgggacgtacttcgtgacgatggcgtgcctgcagtttgtcgccgtggatgtgatgcacaaggcgggcatcagctggacggttccgtttttcgcgcttctcctgttggtggcgctcggcgtcgactactcgattttcttgatgtcgcgcttcgacgaggaactgaggcgccatccggagctcaacctgcgcagcgcgatgctttatgccatgcgccagatgggcaacgtgatcttctctgccgcagccatcatggcgggcacctttggctccatgtccgtctccggcgtgacgacgctcgtcgagatcgggttgtcggtcatcatcggcctcgcgctgtacgcgctcatcgtgctggccctcttcgtgccggcctgcaccgcgattgtgggagaagcccatttctggccgtttcgcagagtgcctcgggaggagcaggagctgaggctgccggaagaactggctgcggagtga

SEQ ID NO: 2924 - DNA, 3207 bp, Artificial
  Substitution in SEQ ID NO 2911
gtggcagagcgttacgcccatttcgtcgcgcgcttcaagtatgggatcatcgccgtttggatcctcgcggtggcgctcgcgcacgtgttgctgccgcagctcaacgcgattgtcgcccacaagaacacggaatttttgccaaactcgtcgagcgtcgtgatcgccagtaattggctgaagcgggtcgatccggcgcgccaagcgggttcgagcgccgtggtggccatgtacaacccgcatggattgacggcggcggacaaggcgtggttcacgcaaaagctgaagcaggtggctgaccataaacccgcctacggcgtgaagaccgtcacggccgcctacaaccagtcgaagtcggtgcagaaccagtttttcagcgcggatcgcacggtggagatcgcgaccatcggctttccgggtaacgacgtatccaaggccaccgacgcgtcgttgaaccagcttcatcaggtgtttcagcaaccgcccaaggatgcacagatcctcttcacgggcgacacgcccatcgagaacgacaacatcaacatctcgatggacggcgcttccaagacggcaggcgtgaccatcgccctggtgctcgtcattctgctcgtcgtctttcgatccgtcgtggccccatttttgaccctgctcagcatcgggctttcctatcttctgacgacgaatctcgtggccgtcttggcgaacgtgggcctgccggtctcgaccttcacggacacgtttctcatcgccatcatcttcggcgcgggaaccgactacagcatcatcgtgctgaatcgattccgcgaggaggcgagccggggtctcgccccagtggacgccctcgcgcgagcgatgtccggagtggccaagaccgtcgtgtacagcgcgctcaccgtctttctctcgtttgcgacgctgtatttcgcccgcttcggcctcttccgatccggcgtcggcgtggcagtgggcttggccgtgacgctgtttgcatgcctcacgttcctcccggcgctcatgatggtgctcgggcgctacgtgttctggccgcggcgccaactcgacggcgcgagtcacaagccctcccgcatctgggatctgaccggcaggaccgcgctccggcatccctggtggacactcgccggggtgctcgtggtgctgacgcccattgcgctgtccttcacggacaagcgcacgttcgatccgacctccgacatcccgacggcgccttccgtcgagggctttcacgtggtgtccaaggcgttcggccccggcaaggtcctgccgatggacgtcgtgatcgacacgccggacaatctgcgcacgccggaggggctggcgaccatcgagcaggtgtcggaggccatcgcgaagctgccttttgtgcagcaggtgcagagcgccacccggccgacgggcagcgtcatcgccgaatttgaattggcgaagcagaaccagctcgcggccaatggcctgggcaaggtgcagacgggcctgaaccaggtggcgagccacgtcggcacaaagagcgcacagcaggcggcgaatgcggcgaacacgctgtcgagtggggcctcggcgctcgcgcaggcgggcgggaagctgagccaaggcgcggcgcaggcgcaagagggcgcttcgaagctcgccgcgggcgcacaggcgctttcgagcggcgcatcgcggctgacgcaggcaaacacgcagctggccagcggcgctgcgcaggtggcggccggatcgcaacaggtggcacagggcgccgataagctcgccacgtcggcgcgcagcatcgcatcggggcagacggcgctggcgaatggcgctgctcgcgaagcgcaggcggcgcagcagctcgcgaacgccatcgcggcctggacgaaggcgcatccggcggaagcttccgatcccaactggcagcagattgtcgcgctggcgcagggcaacgcagcgggggcgcagcagacggccaaggcggccagccagctggcgaatggcacgagccagtgggcgaacggcgccacctcactggcagagggcgcgggcaaagtcgccgcgggcgcgagccagctggcggccggaagccgcggcgcggcatctggcgccaaaggcctgagcgacggggctgcccaagtgggtcaaggcgcttcttccctggcccaaggactgaatcagctgagtggcggcgctcgccaacttcaggcggggcttggcaagtgggcggccggagctgcgcaattttcctccgggctctcgaacgcgggcgccggggagaatcagcttcacagcgcgctcgtcaagctgtcgaacggcgtgggcacggtcaagaccgcgctcgacgagaccgccaaggcgcagacgtcgggcgatcccggcttctacgtgcctgcgtccgccatctcgtcgaacaagagcctgcgccaagccctggacagctacatctcgccggatgggcacgtggcggacattcgcgtcacactgaagtcggacccgtattccatgacggcgattcaggagatgccgaggcttgagacggtcgcccaggcggccttcacggccgcgccgattcacaccgggcaggtcgggttcgccggaaccacgccgacacagtacgcgctgaaccaactgtccaatcaggacttcgtccgcatgatggcgctcattctggggtccatctttctcctgctcgtggtgatgctgagatcgctcatcgcacccttgtacgtcattgcgtcgctcaccgggacgtacttcgtgacgatggcgtgcctgcagtttgtcgccgtggatgtgatgcacaaggcgggcatcagctggacggttccgtttttcgcgcttctcctgttggtggcgctcggcgtcgactactcgattttcttgatgtcgcgcttcgacgaggaactgaggcgccatccggagctcaacctgcgcagcgcgatgctttatgccatgcgccagatgggcaacgtgatcttctctgccgcagccatcatggcgggcacctttggctccatgtccgtctccggcgtgacgacgctcgtcgagatcgggttgtcggtcatcatcggcctcgcgctgtacgcgctcatcgtgctggccctcttcgtgccggcctgcaccgcgattgtgggagaagcccatttctggccgtttcgcagagtgcctcgggaggagcaggagctgaggctgccggaagaactggctgcggagtga

SEQ ID NO: 2925 - DNA, 3207 bp, Artificial
  Substitution in SEQ ID NO 2911
gtggcagagcgttacgcccatttcgtcgcgcgcttcaagtatgggatcatcgccgtttggatcctcgcggtggcgctcgcgcacgtgttgctgccgcagctcaacgcgattgtcgcccacaagaacacggaatttttgccaaactcgtcgagcgtcgtgatcgccagtaattggctgaagcgggtcgatccggcgcgccaagcgggttcgagcgccgtggtggccatgtacaacccgcatggattgacggcggcggacaaggcgtggttcacgcaaaagctgaagcaggtggctgaccataaacccgcctacggcgtgaagaccgtcacggccgcctacaaccagtcgaagtcggtgcagaaccagtttttcagcgcggatcgcacggtggagatcgcgaccatcggctttccgggtaacgacgtatccaaggccaccgacgcgtcgttgaaccagcttcatcaggtgtttcagcaaccgcccaaggatgcacagatcctcttcacgggcgacacgcccatcgagaacgacaacatcaacatctcgatggacggcgcttccaagacggcaggcgtgaccatcgccctggtgctcgtcattctgctcgtcgtctttcgatccgtcgtggccccatttttgaccctgctcagcatcgggctttcctatcttctgacgacgaatctcgtggccgtcttggcgaacgtgggcctgccggtctcgaccttcacggacacgtttctcatcgccatcatcttcggcgcgggaaccgactacagcatcatcgtgctgaatcgattccgcgaggaggcgagccggggtctcgccccagtggacgccctcgcgcgagcgatgtccggagtggccaagaccgtcgtgtacagcgcgctcaccgtctttctctcgtttgcgacgctgtatttcgcccgcttcggcctcttccgatccggcgtcggcgtggcagtgggcttggccgtgacgctgtttgcatgcctcacgttcctcccggcgctcatgatggtgctcgggcgctacgtgttctggccgcggcgcaacctcgacggcgcgagtcacaagccctcccgcatctgggatctgaccggcaggaccgcgctccggcatccctggtggacactcgccggggtgctcgtggtgctgacgcccattgcgctgtccttcacggacaagcgcacgttcgatccgacctccgacatcccgacggcgccttccgtcgagggctttcacgtggtgtccaaggcgttcggccccggcaaggtcctgccgatggacgtcgtgatcgacacgccggacaatctgcgcacgccggaggggctggcgaccatcgagcaggtgtcggaggccatcgcgaagctgccttttgtgcagcaggtgcagagcgccacccggccgacgggcagcgtcatcgccgaatttgaattggcgaagcagaaccagctcgcggccaatggcctgggcaaggtgcagacgggcctgaaccaggtggcgagccacgtcggcacaaagagcgcacagcaggcggcgaatgcggcgaacacgctgtcgagtggggcctcggcgctcgcgcaggcgggcgggaagctgagccaaggcgcggcgcaggcgcaagagggcgcttcgaagctcgccgcgggcgcacaggcgctttcgagcggcgcatcgcggctgacgcaggcaaacacgcagctggccagcggcgctgcgcaggtggcggccggatcgcaacaggtggcacagggcgccgataagctcgccacgtcggcgcgcagcatcgcatcggggcagacggcgctggcgaatggcgctgctcgcgaagcgcaggcggcgcagcagctcgcgaacgccatcgcggcctggacgaaggcgcatccggcggaagcttccgatcccaactggcagcagattgtcgcgctggcgcagggcaacgcagcgggggcgcagcagacggccaaggcggccagccagctggcgaatggcacgagccagtgggcgaacggcgccacctcactggcagagggcgcgggcaaagtcgccgcgggcgcgagccagctggcggccggaagccgcggcgcggcatctggcgccaaaggcctgagcgacggggctgcccaagtgggtcaaggcgcttcttccctggcccaaggactgaatcagctgagtggcggcgctcgccaacttcaggcggggcttggcaagtgggcggccggagctgcgcaattttcctccgggctctcgaacgcgggcgccggggagaatcagcttcacagcgcgctcgtcaagctgtcgaacggcgtgggcacggtcaagaccgcgctcgacgagaccgccaaggcgcagacgtcgggcgatcccggcttctacgtgcctgcgtccgccatctcgtcgaacaagagcctgcgccaagccctggacagctacatctcgccggatgggcacgtggcggacattcgcgtcacactgaagtcggacccgtattccatgacggcgattcaggagatgccgaggcttgagacggtcgcccaggcggccttcacggccgcgccgattcacaccgggcaggtcgggttcgccggaaccacgccgacacagtacgcgctgaaccaactgtccaatcaggacttcgtccgcatgatggcgctcattctggggtccatctttctcctgctcgtggtgatgctgagatcgctcatcgcacccttgtacgtcattgcgtcgctcaccgggacgtacttcgtgacgatggcgtgcctgcagtttgtcgccgtggatgtgatgcacaaggcgggcatcagctggacggttccgtttttcgcgcttctcctgttgattgcgctcggcgtcgactactcgattttcttgatgtcgcgcttcgacgaggaactgaggcgccatccggagctcaacctgcgcagcgcgatgctttatgccatgcgccagatgggcaacgtgatcttctctgccgcagccatcatggcgggcacctttggctccatgtccgtctccggcgtgacgacgctcgtcgagatcgggttgtcggtcatcatcggcctcgcgctgtacgcgctcatcgtgctggccctcttcgtgccggcctgcaccgcgattgtgggagaagcccatttctggccgtttcgcagagtgcctcgggaggagcaggagctgaggctgccggaagaactggctgcggagtga

SEQ ID NO: 2926 - DNA, 3207 bp, Artificial
  Substitution in SEQ ID NO 2911
gtggcagagcgttacgcccatttcgtcgcgcgcttcaagtatgggatcatcgccgtttggatcctcgcggtggcgctcgcgcacgtgttgctgccgcagctcaacgcgattgtcgcccacaagaacacggaatttttgccaaactcgtcgagcgtcgtgatcgccagtaattggctgaagcgggtcgatccggcgcgccaagcgggttcgagcgccgtggtggccatgtacaacccgcatggattgacggcggcggacaaggcgtggttcacgcaaaagctgaagcaggtggctgaccataaacccgcctacggcgtgaagaccgtcacggccgcctacaaccagtcgcgttcggtgcagaaccagtttttcagcgcggatcgcacggtggagatcgcgaccatcggctttccgggtaacgacgtatccaaggccaccgacgcgtcgttgaaccagcttcatcaggtgtttcagcaaccgcccaaggatgcacagatcctcttcacgggcgacacgcccatcgagaacgacaacatcaacatctcgatggacggcgcttccaagacggcaggcgtgaccatcgccctggtgctcgtcattctgctcgtcgtctttcgatccgtcgtggccccatttttgaccctgctcagcatcgggctttcctatcttctgacgacgaatctcgtggccgtcttggcgaacgtgggcctgccggtctcgaccttcacggacacgtttctcatcgccatcatcttcggcgcgggaaccgactacagcatcatcgtgctgaatcgattccgcgaggaggcgagccggggtctcgccccagtggacgccctcgcgcgagcgatgtccggagtggccaagaccgtcgtgtacagcgcgctcaccgtctttctctcgtttgcgacgctgtatttcgcccgcttcggcctcttccgatccggcgtcggcgtggcagtgggcttggccgtgacgctgtttgcatgcctcacgttcctcccggcgctcatgatggtgctcgggcgctacgtgttctggccgcggcgcaacctcgacggcgcgagtcacaagccctcccgcatctgggatctgaccggcaggaccgcgctccggcatccctggtggacactcgccggggtgctcgtggtgctgacgcccattgcgctgtccttcacggacaagcgcacgttcgatccgacctccgacatcccgacggcgccttccgtcgagggctttcacgtggtgtccaaggcgttcggccccggcaaggtcctgccgatggacgtcgtgatcgacacgccggacaatctgcgcacgccggaggggctggcgaccatcgagcaggtgtcggaggccatcgcgaagctgccttttgtgcagcaggtgcagagcgccacccggccgacgggcagcgtcatcgccgaatttgaattggcgaagcagaaccagctcgcggccaatggcctgggcaaggtgcagacgggcctgaaccaggtggcgagccacgtcggcacaaagagcgcacagcaggcggcgaatgcggcgaacacgctgtcgagtggggcctcggcgctcgcgcaggcgggcgggaagctgagccaaggcgcggcgcaggcgcaagagggcgcttcgaagctcgccgcgggcgcacaggcgctttcgagcggcgcatcgcggctgacgcaggcaaacacgcagctggccagcggcgctgcgcaggtggcggccggatcgcaacaggtggcacagggcgccgataagctcgccacgtcggcgcgcagcatcgcatcggggcagacggcgctggcgaatggcgctgctcgcgaagcgcaggcggcgcagcagctcgcgaacgccatcgcggcctggacgaaggcgcatccggcggaagcttccgatcccaactggcagcagattgtcgcgctggcgcagggcaacgcagcgggggcgcagcagacggccaaggcggccagccagctggcgaatggcacgagccagtgggcgaacggcgccacctcactggcagagggcgcgggcaaagtcgccgcgggcgcgagccagctggcggccggaagccgcggcgcggcatctggcgccaaaggcctgagcgacggggctgcccaagtgggtcaaggcgcttcttccctggcccaaggactgaatcagctgagtggcggcgctcgccaacttcaggcggggcttggcaagtgggcggccggagctgcgcaattttcctccgggctctcgaacgcgggcgccggggagaatcagcttcacagcgcgctcgtcaagctgtcgaacggcgtgggcacggtcaagaccgcgctcgacgagaccgccaaggcgcagacgtcgggcgatcccggcttctacgtgcctgcgtccgccatctcgtcgaacaagagcctgcgccaagccctggacagctacatctcgccggatgggcacgtggcggacattcgcgtcacactgaagtcggacccgtattccatgacggcgattcaggagatgccgaggcttgagacggtcgcccaggcggccttcacggccgcgccgattcacaccgggcaggtcgggttcgccggaaccacgccgacacagtacgcgctgaaccaactgtccaatcaggacttcgtccgcatgatggcgctcattctggggtccatctttctcctgctcgtggtgatgctgagatcgctcatcgcacccttgtacgtcattgcgtcgctcaccgggacgtacttcgtgacgatggcgtgcctgcagtttgtcgccgtggatgtgatgcacaaggcgggcatcagctggacggttccgtttttcgcgcttctcctgttggtggcgctcggcgtcgactactcgattttcttgatgtcgcgcttcgacgaggaactgaggcgccatccggagctcaacctgcgcagcgcgatgctttatgccatgcgccagatgggcaacgtgatcttctctgccgcagccatcatggcgggcacctttggctccatgtccgtctccggcgtgacgacgctcgtcgagatcgggttgtcggtcatcatcggcctcgcgctgtacgcgctcatcgtgctggccctcttcgtgccggcctgcaccgcgattgtgggagaagcccatttctggccgtttcgcagagtgcctcgggaggagcaggagctgaggctgccggaagaactggctgcggagtga

SEQ ID NO: 2927 - protein, 209 aa, Alicyclobacillus acidocaldarius
MDTTLVFAAKRGDQDAFAALYREFRVRVWSWIRNYWIPGADREDLMQHAWIGFWEAIRDYDVRGKVPFLAFAKMCVVREIQTVLRMARRQKHTTHLTALSLDAECPWIEDAERTVLDVFVDPAAPSVEDVVFGPPKGVSAEELVAWAERHWGLRLTELEREVWRLRIEGHSYAEIQRMLGCGYKTVDNAVQRLRKKARKALARQEQAAS

SEQ ID NO: 2928 - DNA, 468 bp, Alicyclobacillus acidocaldarius; identical to SEQ ID NO: 2773

SEQ ID NO: 2929 - protein, 219 aa, Thermoanaerobacter tengcongensis MB4T
MGAVLVKSGAQQDYYQAYEQMEEEEIVSRAQQGDELALEYLIERYKNFVKAKARTYFLVGADKEDIIQEGMIGLYKAIRDYKNNKLTSFKAFAELCVTRQIITAIKTATRQKHIPLNSYVSLNKPIFDEESDRTLMDVVSTQCIADPEELIISKEEYVNIENKMEELLSGLEWEVLVAYLDGKSYQEIAEDLNRHVKSIDNALQRVKRKLERYLEMRNS

SEQ ID NO: 2930 - protein, 219 aa, Thermoanaerobacter tengcongensis MB4T; identical to SEQ ID NO: 2929

SEQ ID NO: 2931 - protein, 223 aa, Bacillus licheniformis DSM 13
MNLQNNQGKFSKEQFSKERFCQLEDEQVIEMVHVGDSDALDYLITKYRNFVRAKARSYFLIGADREDIVQEGMIGLYKSIRDFREDKLTSFKAFAELCITRQIITAIKTATRQKHIPLNSYVSLDKPIYDEESDRTLLDVISGAKVMNPEELIINQEEFDDIELKMGELLSDLERKVLALYLDGRSYQEISEELNRHVKSIDNALQRVKRKLEKYLELREISL

SEQ ID NO: 2932 - protein, 212 aa, Bacillus sp. NRRL B-14911
MINEEEKNYLQLEDEEIIELVHRGESEALDYLIQKYRNFVRAKARSYFLIGADKEDIVQEGMIGLYKAIRDFKEDKLSSFKAFAELCITRQIITAIKTATRQKHIPLNSYVSLDKPIYDEESDRTLMDVISGAKVMDPEELIINQEEFDNIEVKMSELLSDLERKVLALYLDGQSYQEISEELNRHVKSIDNALQRVKRKLERYLEVREFSL

SEQ ID NO: 2933 - protein, 214 aa, Clostridium thermocellum ATCC-27405 (JGI)
MKSNAQIDSVKCFSTMNDEEIVEDSRAGDDRALEYLINKYKGFVRAKARTYFLIGADREDIIQEGMIGLYKAIRDFRKDKLSSFRAFAELCITRQIITAIKTATRQKHIPLNSYVSLNKPIFDEESDRTLMDIISEESINDPEEMVINREEFSGIEAKMGEILSSLECEVLTSYLQGKSYQEIAVELDRHVKSIDNALQRVKRKLEKYLEESRI

SEQ ID NO: 2934 - protein, 209 aa, Artificial
  Substitution in SEQ ID NO 2927
MDTTLVFAAKRGDQDAFAALYREFRVRVWSWIRNYWIPGADREDLMQHAWIGFWEAIRDYDVRGKVPFLAFAKMCVVREIQTVLRMARRQKHTTHLTALSLDAECPWIEDAERTVLDVFVDPAAPSVEDIVFGPPKGVSAEELVAWAERHWGLRLTELEREVWRLRIEGHSYAEIQRMLGCGYKTVDNAVQRLRKKARKALARQEQAAS

SEQ ID NO: 2935 - protein, 209 aa, Artificial
  Substitution in SEQ ID NO 2927
MDTTLVFAAKRGDQDAFAALYREFRVRVWSWIRNYWIPGADREDLMQHAWIGFWEAIRDYEVRGKVPFLAFAKMCVVREIQTVLRMARRQKHTTHLTALSLDAECPWIEDAERTVLDVFVDPAAPSVEDVVFGPPKGVSAEELVAWAERHWGLRLTELEREVWRLRIEGHSYAEIQRMLGCGYKTVDNAVQRLRKKARKALARQEQAAS

SEQ ID NO: 2936 - protein, 209 aa, Artificial
  Substitution in SEQ ID NO 2927
MDTTLVFAAKKGDQDAFAALYREFRVRVWSWIRNYWIPGADREDLMQHAWIGFWEAIRDYDVRGKVPFLAFAKMCVVREIQTVLRMARRQKHTTHLTALSLDAECPWIEDAERTVLDVFVDPAAPSVEDVVFGPPKGVSAEELVAWAERHWGLRLTELEREVWRLRIEGHSYAEIQRMLGCGYKTVDNAVQRLRKKARKALARQEQAAS

SEQ ID NO: 2937 - protein, 209 aa, Artificial
  Substitution in SEQ ID NO 2927
MDTTLVFAAKRGDQDAFAALYREFRVRVWSWIRNYWIPGADREDLMQHAWIGFWEAIRDYDVRGKVPFLAFARMCVVREIQTVLRMARRQKHTTHLTALSLDAECPWIEDAERTVLDVFVDPAAPSVEDVVFGPPKGVSAEELVAWAERHWGLRLTELEREVWRLRIEGHSYAEIQRMLGCGYKTVDNAVQRLRKKARKALARQEQAAS

SEQ ID NO: 2938 - protein, 209 aa, Artificial
  Substitution in SEQ ID NO 2927
MDTTLVFAAKRGDQDAFAALYREFRVRVWSWIRNYWIPGADREDLMQHAWIGFWEAIRDYDVKGKVPFLAFAKMCVVREIQTVLRMARRQKHTTHLTALSLDAECPWIEDAERTVLDVFVDPAAPSVEDVVFGPPKGVSAEELVAWAERHWGLRLTELEREVWRLRIEGHSYAEIQRMLGCGYKTVDNAVQRLRKKARKALARQEQAAS

SEQ ID NO: 2939 - DNA, 468 bp, Artificial
  Substitution in SEQ ID NO 2928
gtgagcggttgtgtttcatcactaccattcatactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgatcatgaggcggcgaaattgaggaggagaattcgtatgcttgtgacaggttacgtgcggaaggtcgatcatctcgggcgactcgtgatcccgaagcgcctgcggaaagaccttgccattgggcaagatgattcgatcgagatctacgtggaaggcgacgccgtcgttctgagcaagtacgagcccaaatgcgtgttctgcggcgagattgccgagaaggtctttcacgagcgaggcgtctgcgggacgtgcttggaggagttgaaggcgaagagcaaagtaagctga

SEQ ID NO: 2940 - DNA, 468 bp, Artificial
  Substitution in SEQ ID NO 2928
gtgagcggttgtgtttcatcactaccattcatactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgaacatgaggcggcgaaattgaggaggagaattcgtatgcttgtgacaggttacgtgcggaaggtcgatcatctcgggcgactcgtgatcccgaagcgcctgcggaaagaccttgccattgggcaagatgattcgatcgagatctacgtggaaggcgacgccgtcgttctgagcaagtacgagcccaaatgcgtgttctgcggcgagaaagccgagaaggtctttcacgagcgaggcgtctgcgggacgtgcttggaggagttgaaggcgaagagcaaagtaagctga

SEQ ID NO: 2941 - DNA, 468 bp, Artificial
  Substitution in SEQ ID NO 2928
gtgagcggttgtgtttcatcactaccattcaaactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgatcatgaggcggcgaaattgaggaggagaattcgtatgcttgtgacaggttacgtgcggaaggtcgatcatctcgggcgactcgtgatcccgaagcgcctgcggaaagaccttgccattgggcaagatgattcgatcgagatctacgtggaaggcgacgccgtcgttctgagcaagtacgagcccaaatgcgtgttctgcggcgagaaagccgagaaggtctttcacgagcgaggcgtctgcgggacgtgcttggaggagttgaaggcgaagagcaaagtaagctga

SEQ ID NO: 2942 - DNA, 468 bp, Artificial
  Substitution in SEQ ID NO 2928
gtgagcggttgtgtttcatcactaccattcatactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgatcatgaggcggcgaaattgaggaggagaattcgtcgtcttgtgacaggttacgtgcggaaggtcgatcatctcgggcgactcgtgatcccgaagcgcctgcggaaagaccttgccattgggcaagatgattcgatcgagatctacgtggaaggcgacgccgtcgttctgagcaagtacgagcccaaatgcgtgttctgcggcgagaaagccgagaaggtctttcacgagcgaggcgtctgcgggacgtgcttggaggagttgaaggcgaagagcaaagtaagctga

SEQ ID NO: 2943 - DNA, 468 bp, Artificial
  Substitution in SEQ ID NO 2928
gtgagcggttgtgtttcatcactaccattcatactcgcattatgcgtatcatccgctgctccacgagttcgggcgctcggtggtgcatggcttcggctggggcatcggctggcaattggcgcggcatttaccgtttgcgctactgcttctcattgttgtcctactcggtgtaggatggatgatcataaagcggcgaaattgaggaggagaattcgtatgcttgtgacaggttacgtgcggaaggtcgatcatctcgggcgactcgtgatcccgaagcgcctgcggaaagaccttgccattgggcaagatgattcgatcgagatctacgtggaaggcgacgccgtcgttctgagcaagtacgagcccaaatgcgtgttctgcggcgagaaagccgagaaggtctttcacgagcgaggcgtctgcgggacgtgcttggaggagttgaaggcgaagagcaaagtaagctga

What is claimed is:

1. An expression vector comprising a nucleic acid encoding a polypeptide having at least 95% sequence identity to SEQ ID NO: 732 and wherein the polypeptide is able to dimerize and bind a catabolite responsive element.

2. The expression vector of claim 1, wherein the polypeptide is able to dimerize and bind a catabolite responsive element at a temperature at or above about 50 degrees Celsius.

3. The expression vector isolated of claim 1, wherein the nucleic acid has at least 95% identity to SEQ ID NO: 733.

4. A method of modulating transcription or transcription or transcriptional control at temperatures at or above about 25 degrees Celsius, the method comprising providing to a transcriptional system the expression vector of claim 1.

5. The method according to claim 4, wherein providing to a transcriptional system expression vector of claim 1 occurs at a temperature at or above about 50 degrees Celsius.

* * * * *

UNITED STATES PATENT AND TRADEMARK OFFICE
CERTIFICATE OF CORRECTION

PATENT NO. : 8,716,011 B2  
APPLICATION NO. : 12/380008  
DATED : May 6, 2014  
INVENTOR(S) : Brady D. Lee et al.

Page 1 of 1

It is certified that error appears in the above-identified patent and that said Letters Patent is hereby corrected as shown below:

On the title page:
In ITEM (56) References Cited:
OTHER PUBLICATIONS

Page 1, $2^{nd}$ column, $1^{st}$ line of the
$1^{st}$ entry (line 24),                       change "1911," to --1991,--

Page 2, $1^{st}$ column, $1^{st}$ line of the
$15^{th}$ entry (line 31),                      change "Functiona" to --Functional--

Page 2, $1^{st}$ column, $2^{nd}$ line of the
$17^{th}$ entry (line 38),                      change "Quarlty" to --Quarterly--

Page 2, $2^{nd}$ column, $3^{rd}$ line of the
$19^{th}$ entry (line 57),                      change "theremoacidophile" to --thermoacidophile--

Page 3, $1^{st}$ column, $2^{nd}$ line of the
$20^{th}$ entry (line 56),                      change "Trands" to --Trends--

In the specification:

COLUMN 7,   LINE 16,   change "390312.11|," to --390312.1|,--  
COLUMN 7,   LINE 32,   change "089786.11|," to --089786.1|,--  
COLUMN 35,  LINE 7,    change "308,325," to --308, 325,--  
COLUMN 50,  LINE 65,   change "are a" to --are--  
COLUMN 51,  LINE 18,   change "308,325," to --308, 325,--  
COLUMN 51,  LINE 19,   change "597,614," to --597, 614,--  
COLUMN 52,  LINE 61,   change "a nucleotide" to --nucleotide--  
COLUMN 53,  LINE 28,   change "1911," to --1991,--

Signed and Sealed this
Sixteenth Day of February, 2016

Michelle K. Lee
*Director of the United States Patent and Trademark Office*